United States Patent 7,833,706 (GENETIC POLYMORPHISMS ASSOCIATED WITH RHEUMATOID ARTHRITIS, METHODS OF DETECTION AND USES THEREOF) - sequence listing, part 10

SEQ ID NO: 10826 - DNA, 12393 bp, Homo sapiens
ggtaaagacataaaagaaagagacattaaagacaaaatttcactagtaaaaccaaaaaagaaaagagagtgaaaaatcagagggcagagccttagtgaggaaatccactctcagtcaggaaggcaggcagcaaaaagagaagaaaaacagcacaaaggctagaaggtatctcacaggttacaaaagaaagacttgactgtgttgtgttttaagactaaattgtaaggtaaaaaaggagtacttagaatactaagcagaaaaggataaacatggaagcaaggttcctaagaaaactgggtaccaggtaggatttatgttgacaagcaacttattaacttggagtaacaaccaattctgtttcatttctaaatgatttcttaaccagctagcatttaatcatatcttaagaactctataaacaatagcaaaattaaatatataggtagataatgaactgccaaacaagaaatttcactggcagcattcctggtatgaagtaaagatactgtcttccaaattattcattcaaattcaatagaaagaaaagtaagtggccagccacggtggttcacgcctataatcctagcactttgggaggccgaggcgggcggattgcctgagctcaggagttcgagaccaggctggccaacatggtgaaaccccgtctctactaaaatacaaaagaacaattagcggggcgtggcggtgtgcgcctgtagtcccagctactcgggaggctgaggcaggagaattgctagaacccaggaggcaaaggtggcagtgagccgagattgcaccactgcactccagcatgggcaatagagcaagcctccatctcttaaaaaaaaaaaaaaaaagagaagaaagaaaaaaaaaaaaaaacagaaaaggaagcctaactttttttttctttttttttttttgagatgaagtatcactctgtcgcccaggatgcagtgcagttgtgcaatcttggctcattacaacctccacctcccgggttcaagtgattctcctgcctcaacctcccatgtagctgggattacaggccaccgccaccatgcccggctaatttttgtatttttagtagagacggggtttcactgtgttagtcaggctggtctcgaactcctgacctcaagtgatcctctcgcctcggcttcccaaagtgctgggattacaggcatgagccgcagcacccggactctgactttttatttttatttttgaacatggttcttgctctgtcacccagaatgaagcacagtgtcaaactcacagctcactgcagcctcaacctcctgggctcaagcaatcctcccacctcactcttcctcatagctgggactacagacatgcgccacaatccccagttaatttttgtatttttatagagagacaaggtctcactatgttgctcaagctggtcttgaactcctgggctcaagtgatccactagccttggcctcccacagtgctggaattacaggcatgagcctctggacccagccttagagcctgacttttttaagtcttggaattctatcagttgaactagtcaaagaaatatactaaatagggaaaaaaatacataggccagttgcaatatttacttcatcttttccaagaaaacttaatgtggacagttggtctaacaccaatgtggaccaaaatattagaaataggccaggcatggtggctcatgcctgtaatcccaacactttgggaggccgaggcgggaggagtgcttgaccagactgagaaacatggcaaaactctgtctttaccaaaaaaaatacaaaaattagccaggcatggtggtgcatgcctgtagtcccagctatttacaaggctgagcccaggaggtggaggttgcagtggggtaagactgcaccactccactccagcctgggtgacagagcgagcctctgtcttaaaaaaaaaaaaaaaaaaaattggaaacattaatgaaataaaaattaaaaagtggcggtgtgtttataatgcctaataaagaatacaacagacaataaatatatttacttattgaacctatcagtaacaaaacaaccatgattcaagaaaacaggttttgtgtgtggggggggtttttttttttgagatggagtctcgctctgtcacccaggctggagtgcagtggcaccatctcggctcactgcaacctccgcctcccaggttcaagtgattctcttgcctcagcctcccgagtagctgggattacaggaggctgccatcacgcctggctaatttttgtatttttaagtagagacggagtttcgccatcttggccaggctggtcttgaactcctgacctcgtgatccacctgcctcggcctcccaaagtgctgggattacaggtgtgagccaccatgcccagctgaaaaccgttttcctaagtctagcttataaaatatactaattgattatctttaaataactaagttggccaggcatggtgcctcacgcctgtaatcccagcacttttggaggtcaaggtgggcacatcacctgaggtcaggagtttgagactaggctggccaacactgtgaaaccccatatctactaaaaacacaaaaattagccgggcatggtagcacgtgcctgcagtcccagctactcaggaggctgaggcactagaattgcttgaacccgggaggcagaaattgcagtaagccgagattgcatcatttcactccagcctgggtgaccagagggaaactatatctcaaaaaattaaaaaaaaaaaattaattgaataaataaaataagttatttacagcctttttttttggaacattgaaagggcaactagctacaaatgagagaaattcagtgcaatacaggccctttatactataaatattttacagcagtgaaacgtaaagagagcgcaaaatgtttttgccattcagttcagtctacctctaacctttccgactcttttgtgagaactgataataaaacagagaattttgaaaagaaagaaaaaaaagctatttgccaaaaatatctcccttggaaatgcattatcctcagaacagcatccagcccatgccacaagactgaaggcattttctgctctagcgcagaactacttctccagatccccttcctcaagaaatgaagtctacttatttttgttccacctcaatagttgagagtactgaccccagaaactacaggaatcagcagtatgctagaatcaagatatgcacgaattttacctataaaattatcttcttttctgtgtgaagggcagaaatgaacagtgtaacctttatccattctcccagcttgagccaagatgatacttcagacacccgtggcaggcagcctagtttgttgttgttgttgttgttaagatctttgcaggaaatcagtttacaaccttgggatgtttttaactctaacatgcgcaaagtcatcttaaatgtctcacaagcttccgcttcaggaagtcatcttttttaaacttactaccactgaaaggctatttctcctaaaactgactttgcttgatacagcagcgatacctcattcttacacaatgacattaaaacttagggaaaaaggaaatacagctataaagtaaatgacaaaaacttgaacccacacacactaacaaaactggtttagggcctcattttaaggattctcacccttccttttgcccaagaatcttctaggcggtttactaaaaaagtggctgtcctttttcagacctcgattcaggattcagcttcagatacgtggaaactagacattcctaaagattctcaccaccacataaaactaaaacaagctctttactgctcaggattacagggcaatttccagcaattacagtcattcagggattctaggacctgcctgaactgcacgagacccttactacttcacactctccatctccccattggcttttgacattttccctgctcaagggccaagcagtatttgaaaggctgagggaaagatcgagacattaacttctcatggacagctctaattaaaaaagaaaatgaaaaacttgtagagtaagaaatccattttcctttaaaaactacaatttatgattagctgagcctcctcccatcaccaaaagttggcattccctccactctacccagacgttccctgttcataacactgtttcatcacgtcatattatcattgtgacttcttcctccactagaggacaagagctgttttgtaatcagcacccaccaccatctctattacatagtaggtgctttaaatatgttcactggcttttattcttgccctgtctcccaatggataattaatattctattggatctgtcctggcataggtaaaaagttatcttatagaaatcagttaccgggttatagatgatattctgtaggttgtttaaggacaacatcattcttttccagcttcttgtcgattggagtctcttctgtgtatgacctaagattttaggcaagtttcatttaaaggttacctggattgaaactgaggcactggccctgtgtaaagtaaaaatagaggaaaagaaaagtaagcatgtagcatttttcttcatatcctattttaaaatttaaattatatattatgttactgatatttaccaaataatagaatattattacaatcaacgatctgcctcccattcttaccagtgtgctcatatactaaataattttggattgtgagtgtaggaaatattgacttaaaaaatacatcagtagaaaatttctaacatggaatttattattaaaaatactaaaataggccaggcatggtggctcacacctgtaatcccagcactttgggaggccaaggcgggtggatcacctgaggttcaggagttagagaccagcctgaccaatatggtgaaatcccatccctactaaaaatacaaaaattagccagacgtagtggcatgcacctgtagtcccagctactcaggaggctgagacaggagaattgcttgaacctgggagacggaggttgaagtgagccgagattgtgccactgcactccagcctgggcaacagaacgagactccatctcaaaaaaaaaaaaaatttaattaattaatggtaaatactaatcaaacagtcccgtacaattaccagaggtattcatttagattttcatttccataaaatgagaattacagtattcacatcattggtttgttctgaggattgagttaataaaacagcgaaagagtaagcgctatgttagctattattattgtgaatagaaagaattgctcttcctcctccaatttaaacaaatcaaagtagggaaaaatccaatacttttaatactattaagatacggttttctctgttgcttaaaaaaataataatcacagggcaggggagtgttggaaagcatcagccacattttttaagataaaagcactcatggacactacactacatttaatagctccaggaaaaactcgactttaagcagaactaaaggggaaatgaaaccagagcttcctgtattttacttccagcaattctgtcattatactgcacaccaacaatacacaccgatcaaatctatcactttttctttattaagaaaaaaaactgtatccctcttggtttaccacctaaatatagccccatgtcattaacttaattcgttagtcaaaacctcaaaactctggctccgtgactcaattcaggaagtaagaacaagagcaaaaagaatggatgccgagttgccatacacatgtataataacaagccagtgacccaatttaagccatctgcttgcattaaatcacgcaacccccgaagtatccccagggacaggtcccgccagcatgaacacttcgtatgcatcacaagcagccatcacttaagtttcacgtacggtcaaaggaagtcacatgacttgcgctttgcaatgtttaacactgcagtcaaatgactcggcatcctaaagagcgtgttagaggcagggaacgcaatggaggtcactccacrgtcactacaaattccgggaaggaaacttccccagattcctccacttggaggtggcgctcggcctcaggctaggagggaacaggtgagaaagcagcccaggtggggtgggtttgcagcgaggagacaccccagggcaaacagcctgaccccagccagggatgtccaagaaaggccgcgactcctgataatcccttatgccccggagygcctcgcctgcagaggcagcgtccccgccacccagccccggctctgccgcggtgaggaccggcgggtcggggtggactggacactgtcccacccatcaaatggtgatttaggagccgtgacatccgaatgccatcctccactggcgagaccctcagagcagccacgcctctagcgactgccccgccacccgaggccgggggtcgcgcgactcacccaaagactggtgtttcaggcgctccacggagcaggttgtttgtcagcagctaagtgccgtcagggttcccggctctggcgtccgtgggcggctacgggaagcgacaggagtcagtcctcgttcacttcccggctcgcgcgcctcactgctgtggtctccccaccctccccgcgccccgccttctgtgtctggggcgtccctggcggctctgctgggttttggacagggacccgccgctgatcgccacccagctcggcctcctgcacagcctctggagccttggaccgcgactggcttgctgtgggacgagcacagagggataaggacaaagaatgtgtcctgggtggatctggctgcctttgcccggaaggcggagtggggtgggaggtggtaggaaaatgggaaggaaagaaaagaaaggtgggccgacgtccacctggctgttccaggcctccaggtctaggagggagggcgctcggggctgggacttttcaggaccagggtggtcaccgcacaggccccgcctgcctggaccaagcgctggccttcccggggcgcccaggtccacggggtcaacgccagggttttctcagcttcctcgtctgcctcggatccaagtccagacagtgccagaagagacttggaggcgctgctttttgacagtacacacctctgtatgcaggtgaaacggtgggggaagggttcagtacgctggactgtgcccagcccaagctccccatccgttagtgataacttggactcgcagccactccgcgtcactcgccggttatcctgcgtgtgggtgttttctccaaattggacacttagggaacagtttaagcagtatggagcacaattctgtgcctattagatgctcttaaatacccgacttctcagggccctacactgactgatagtttgacctattggctgtaaacacaccagccagaaatacaaataaagttaaacaaagtcatgtcagccacttggaatggctggctgcttactgtttattttgtgttagggacctcaaagttctcatcttctctacttggcttttatccacatttgtttggaaagatatattttagtgtcattaacgtgggctttctcctccctggcttttgttttcattattttttgttttaattgaggaattcattacaagtcccataactgggaactcatgttctgattcactgttgcttttctctcctccttacccattttccaagcctgatgcacttctcaagatccaatctgaataggtgaatttacccttgacatacactgccttggatttatagctgtcttttggtatgtgttgtgtgttttatctatccaactcgactgtagtttgagaaaaggaacttgtcttatacagtctccagtgcatagtgtaatgctttgcataaaatagatatcaatgttaggttgaaatgttagattattgataaagtcaggagcaattgaatatcttcacaattctgcctgagtctccccccagccccgccactttgagacagggtttccctcaagtgatcctcccacctcagccccaggagtagctgggactatagacgcacaccactatgcccagctaatttaaaaatttttttttgtagagacagggtccactgtgttgcccgggctggtctcaaactcctgggctcacaatatcttcctgccttggcctcccacaatgctgaaattacaggcatgagacaccaagctgggccctgagtcaaccttgtacttctttacaaagctaaaataagttgaaataagtacacataaatgctgtgtttcttttgtaagtcatatttaggtgcaaacggggctgagtgaaagggccagagagcagagttaacaaagaaaatctggattaaaatgttcataaatcctaagaacttattcctagaaatatctccctcatttggcactgttgttcaattagcccagtgtgttattttaaataagcaaatattcactgaatgcctatcatggccaggcacagcagtaaagaatactagcatgcaaaggacctcatgggcccttctagatagagtcccacatctcttacattattactgcagtatcctaatcggtctccctatatttgcccttgcccctctgcaatgtagtctcaacacaacagccagagaagtcatgacaaaacataattcagatcatgttaatcccttactaaaacctacttttttttttttttgaggcagtctcactctgttgcccaggttggagtggagtacagtgttacattctcagctcactgcagcctctgcctaccgtgttcaagtgattcatgtgcctcagcctcctgagtagctgggactacaggtgcgcgccaccatgcccagctaagttttgtatttttagtagagatgaggtttcaccatgttgcccaggctagtcttgaactcctgacctcaagtgatccgcccgcctcggcctcctgtaacctgggattgcaggtgtgagccactgcatccggccaaccgtctactaatttttgctcattctttgagtaaagatccagttcttacacgagcacttcctgatctgcccgaatcctcacacactgtgatttcatctcctactactttccttctcactttttctgcagcagccacagcgactttgctattctcctagcaggcctgtcacactcccatcctaaaatctttactcaatatttccttttcccttttcaagtctactcaaatgtcagttctcagtggggcccttcctgaccaccaatatttaaaattgcaaacactctcccaaaacacactcatacacactccctagcaactcttccttgctttatttctggctaacatttgtcatgctaatatactatataaggtgcctttttattttatgttacttcacccatcataagactataaactccatgagggcaaggagttttgattgttcttgtttcgaggaagcttatactctagttgaggacacatacagtgatgtgttttagagaagattaaattgggagcacctgagtggcaaccttagttgggtgacaaggaaagtctctcagaggagtcaaagtttaagctgctggtgagtgaaagaaaggaaacagccatatgaagatggtggggaagagcattccagccttagcgagcagctgctgcaaagtccctgagggtcttgagaatgcattaaatgtgttcaggaaacaaaggccaccaaccagtatggctgaagcatgagggaagaatgatatgacatcatgagattggatggcaccacctaggagagtagtgggagaaaatcacctcggacagccctggggagataagacaacgccaataaatgagactgagaagggacaaccaggggaatttgctgagagtggtgtcacagatgccaaagaaagagaaacagcctgtgtgccaagtgtgctgagaggccaaggaggacggaagtaagcaatgggcttaggaacatggatgtcattgctgactctgactctgaagtgtgttgagaaatgggaggtgaagaactggtggaaaccatgactataaagatttcagaaaggtttgctgtgaggaggaatggagaagcagcattatagctgaggaaggagtggagcaaagggcagattcaggttttctcctgttgtttttttttttttttaaagagaagatactacattggtgacttttagacttcttttttttcaagtgacctgccataagaattacatttccattgagacttactacacacatacttaaaattacgaaaacaaaaattttgaccaggcacgttggctcactcctgtaatcccagcactttgggaagccgaggcaggtggatcacttgaggtcaggagtttgagaccagcctggccaatatggtgaaaccctgtttctactaaaaatacaataattagctgggccttgtggcgcatgcctgtaatttcagctactcgggaggctgaggcatgagaatcgcttgaacccagaaggccgaggttgcagtgagctgagattgtaccactgtactccagcctgggcaacagagtgaaactgtgtctaaaaaaaaaaaaaaaaaaaaaaaaaaattgtacaaaacaatactcctgttatgtgtaaaacaatctactttttcattttaaaaaaatgctgcttatagtccactaaaatgtttgcaagccccactaatgggctgtgagctgaagtttgaagaacactgggtagtatgttggtgttagctcatactggcttgtgacagccatttttgtacataacttccatgttgataccttgaagttatccagggcaactgctagaacttaggaactttttcccccaaagaacaagatcttaaacatttaccagcacgctactgactttactcatgtgaatgatccgtggagaggagaaactgatcatgcaggagaggggatggtgttcccaataaaagttgcgaaaaccagtttcagaacaatagatactgccaattatttgccacaactgcctgagagttatgcagataaaaggatcacttctggtaggatcaatttctttttcatctatattgtcctctttccttgcccaagaagccacatttatatggtataatatagccacacatttagaaatagtctttttttttttttgagacagagtctcactctattacccaggctggagtgttgtggtacaataatggctcactgcagcagtgacctcctgggctcaagtgatcctcccacctcagcctcccaagtagctgggactacaagtgcacaccaccatgcctgactaattttttttttttttggtagtgatggggtcccactgtgttgcccaggctggtcttgaactcctgggctcaagcagtcctcctgcctcaacctcctgaagtgctaggattacaggcatgagccaccatacccaggcaaaattaagtcttacaagcaaaatgttaaattatatatatagagcccacattttttaaaaaactagtaaaaaaatcatgattttagacatgaattgtaagctcttgctacttagcagggttaactgattaaacagaaatagatgccatattctatcgacgtgaaccgtattgtttcaagctaaggaatactctggcagtgattttgcttattgttttgttgctgtgttacttttgttaacatgattgtaaaatttttggaccccctctccaaccatccatgaaatagcggtgctaagtgctgggaaaatgtgctccaactcaataattttggaatacaagttagatatgataaaagagtatcaagaactttaaagaactgccttggtatgctgtgaatttagaaaccagaactccgtcacagaacctgtgacaataatgataaaaaaaaatatgtgaaagcaaaaatttgccacaatggattatacatttgtgagcgccgagaacacataccctgctattctcatgagaaaattaatcaaaatatgtaggttttaaattatgcaacatcttcaggaatgcattctttacaaaaccacaatactcacatccttatacatacatctgcttccccaggaagtgtcatggacggtgtcttctacctcttccgattatcttccccaatctaaaggaattcatttctcctttgaatcctcttgctttgacctaatctcccctacaccccaatactagccccatccatgagcaccaaactcttttttttcaccctccagaccccctatgatctgattcaccaggcttacctccgaagttctacaggatcatgtcccaaatccagtcttttcaggtgggagaaacaagcttctagaactatggttttgtcataaaataaaagaatcttagtgacgagagggatcttaggaggagtataaattaattcatctcaatagctcaaaggatgagatagcctattttgtgaaata

SEQ ID NO: 10827 - DNA, 234734 bp, Homo sapiens
  misc_feature (1)...(234734): n = A,T,C or G, or insertion/deletion polymorphism (see Tables 1-2)
ggtctccacaattatttttaacctgaacattcctttctatcaatcccaggtctttagacaaactcaaccaattgtcaaccagaaaatgtttaaatttacctatagcttggaagcccccgctttgagttgtcccgcctttctgaaccaaaccaacgtatttcttaaatgtatttgattgatgtctcatgcctctctaaaatataaaaaaccacgctgtacactgaccactttgggcacatgctctcaggacctcctgagggctgagtcatgggccatggtcactcatatttggctcagaataaatctcttcaaatattttacagagtttgactctttcagtcaatagagtttaagtataatgtcaaatataactttgtttcacaactagttgcatattttaacaaagacatggatgttaatttttaaagtatcatgtatttccctatcttttaaaaacaaatatgtggatagaattttcttaataaaaatgcctaaggtcaacagaatcatcaaatgtaaaaattaatctatgttcaaatatacttacatctgcaggaattaatgagatcgttcctacattattatgtggtgccttctttgttttctaggatggctgactaaaagaaatgagcatttagttgattctgaataaggcacagagagagtaaattcttcaaccatgtttaatatgaagcagcaaaagaaaagcctaaatatcgttatctgcgcaagaatgtgtggattcacaaattcttttcagacagctgttcagaagatagtattatagcctctgatcaattttgtcctatctacccctaagtggtatttactgaacagaatcaaaagagcaaactggtaggatttcattggtggaactaaaacatgaaagacaaatacttccaacgtgattattcattataatcaggttgagcattccaaatttgaaaatctaaaatctaaaactttgtgagcaccaacatgacactcaaaggaaatgctcattagagtattttggattttcagattagagatcctcaaccagtaagcacaatgcaaaaattaaaaaaaaaaaaaaattccaaaattcaaaaaaacttctggtaccaagcattttatataatagatactaaacctgaagaagaatatttgtctagtctagagagagtagggtatcaaaaaagaagaatgaaggggctaaggaaaggggctttacttgctaatgtataaaacaaaagggttagattatatgatacggaaagtctttttctagctccaaaattttatgattattatgcatgattagaaaagggtacaagagaataagaaatgacagttaatagacttttactttatatccctattctctcatagagagtctagtatatagtaaattttcaaatataccaatgaatgaattaataaactataaaaaatgctcacagaccccaaaaagcaatttactcacttagagtagaaggaaaaagaaaatgtatatctccaagagaaacaacatattagagtacaatagttgacaacaacaggcaatcacaatgagaaccctgaggcatcaaaaagaaaaaaataagaaagaaataatgttcccaatttcttgtttagaaaattaaagaaatggcaagatcatgttttattttcatcattaagtgtggttaaaatactttattacttagcaaagctaatattcaattttctggaagattcatttatgtagaacagctcatgcctctgcaatgtttaatgaggtattaaaatctatttatcctgaatacttgcatggtaataagccaagttgaacaggtcaatttttaacttataacatatgtagctagtgctcatcccagattaaagattcacccctaattatatgcaagtacaataaattttatttaattcattgattgtatgcactgatactttcttcaaaagcattcagatcatgatatgtattgcatgtcatttacctgctccaaactatccaatgacttctcatcataagaataaaatacaaactccttaccatggcctataaattccacatatggccctgcctacctctctgacaatgacttctactgctgtctccccatttcattattctgcttcagctgcaatgactttcttagcattcctaaaacacttcagtcttgttttggcctcctggcttttttatttttgcttactggcaggcattacctccagatatttgcaaattgtaatccctcacttcattattcaggtctcttcaaatgccactttacagaggctttccctaaagaatctatctaaaatagtgtcaccctgcctttgcttctccaatcccttactaggtttatttttctttcttgagtttagcactaattggaaagtatatgttatctggttacatatttattgcttgttttccctctagaatgtaagcactgtgagagcacggagttcatctgcacaccagcacctaggacactgcttgtcaaatatttaggacccaataaatacttgttgaataaatgaatgaataaaccagtacagttttaatagacttatagcatgttaccatttgtatttttaaaagatatatatgtatatgcatggtcattcccagaagggtacacaagaaattgataataccactttccctatagaagggaaatatgaaggtctgagtgagagacaggtttattttccatttcatattcttttgtaatatttaaattttaaacaaggtctaggtatttttatttcaaaacagacaaacaacaacaacaaaaccactattaaaatttaccttaatcgcaacatttaatttagtaacaataagttatattttctattgagctcatatcccacaaatagaaatgtactaacaattgacatactcttactaaatcgtcataacaacctatgacataaaccctgtactgtcattcctattttattaaggcagaaagtgtaatacagagaaattaactggctaaagtcacacaactgaggaagcacatgccatgggatttgaactcagactgactgaatctaaaggccaaatacttaatcactactctccctgatgtaaatatataaccctcagaaattttcttatagaagttaaaaatatatatattgcttacttttttagaaattttaaaacatttaattggcaaagattgtataaaacgaagatgtacaatgtgatggtctcatattcttatacacaatggaatgattaccacaattaaattaatacgtctatcaccattgatgctgtacattaaatgccatgaacttatttatcttataacttaaagtgtaccctttgaccaaaatctccctatttcccccaaaactcagcttctggtaccactctcttatatttccttacttttgatagaaacctcagggcctggcacaggagctcttgaatgtgaaaataaaactgattatgatttctctgtacttgtcagatatcacagagtggccattctcaataagtatgctttaacaatgcttagattaggttgatatggtgataattattaataatgaacaacaatgcttttcatttgagtatgtacactctgtctcatgcattatagtaaacacttgacattcgtcattgcattcaatccttataataatcacgtaaggtaggttgtagtagtatttccattttacaaaaacaaagacttagccttaggataagtaacttttccaagatgacgtaacaagtgggcaaccaaatgtcaaatataagtcaattcagtcaaagattcacccctaattttatgaaagtactataataaatttaattcattgattgtattcactgatacgttcatcaaaagcattcagatcatgtgatgcatcacatggcattcacctgctctaaagtctccaatgacttctcaccagaagaataaaacacaaactccttaacgggtacaaatctaaagtccatgttattaacagctaggttctactggaatcagaagagaatgcttccaaacaatgatacagaagtagagtgacagttatgatatattaaatacaaactcaaacctgaattagattcagattcaacaaacactgtataggactgaaaacgatactcaacactatcatctacagtccatcttaaagctctttttggaatatcagtcttgggggcactactcccaccaacttacaaccatcagggaagaataaaaggttcaactggagggaaggccggcactgacagctgagctattttttttcctcttagttttcacagttgtcagcaaaaaaaaaaaaaaaaaaaaatcatttttatcgtgtctcttaattgatttggggtatttctatgatgggacaagatgcactttcaatataaaaatattatgtatttgtaaatacttttcaatagtagaagaggaagggctgggtgccctgcctcacacctgtaattcctgcactttaggaggccgaggcgggcagatggcttgaggtcaggagttcgagaccagcctggccaacacagtgaatccccgtctctaccaaagatacaaaaattagccgagtgtggtggcaaacgcctgtaatcccagctactcgggaggctgaggcacgagaattgcttgaacctgggaggtggaggttgcagtgagcagcgatcacgtcactgcactccagcttggaccacagagcgagactctgtctcaaataaatgaataaataatagaaaaggagattaattactactattaaaggcagataatcttttaagtttttttctttgtgattgtgctttgtagataatctttgtttattgaaatagttcttacaaactatgaacttaataagaagcactatctagtcattggatatcacattctctagcatcaaagtttataaaaaccttacaaaaacgaaacaggaggctagacgtggtggaatgacactaaaaattaaaatctgtagagtgcctaaatttctacctaattatccataatctaaactatatattataccacaaaatcagttcattctggtcaaatactctcttctcatataataaacagcagtcagtcttggcttctctgtaactgagtgactaatgagctcctaaaaaaaaaaaaaagtcctgcggaaaccaagaacagactataggactgattctaaatgtttacagtttaatttcatctgcagagcatttgccaaacagtatctcttccgtacctcatctgatcctcggcaatcccgttaggcagtcagagcggcttttatctcgatgctacctacaactggggctcaggaggggttcccgattgaccagtgcaagactaacagttaaagctcttcagacaaaaattttatgcagtgatgaacaaaagctcctcgtttgataggtaagcccctgggtacgcttatatgtgagtctgaaacaaaacactcccaatttggagtccggaaaaaagctgacactacaaggtgctgggcagttaaagttctctgccagtctgggaaaggggccaagatgccctttaaaacttaagacttcctctcaggacttaaggagatccctgcccttccagctgagcagtcgaggattacggtcaagcagagctgtgctcttagcaggttctcgaatccctttttcctttcactttctccccaggtaccctgatcccccacccctcaacgcttctgtgtttgtcaagaagcccacctggtcttctagacctgaagcggcaggaccctccgttcccaataatacaagtcaccaaaaggagcgtcccagagtccagttttaccttcatgtgcctctcactcacttcaggcccaggccaggttaccgcaaccacttcactttaatgtccgcctcccagcgcttcagactcaaccacaatattcaaacccaagccactttcctcagcgcttcgtttcattggctgccgctcgcgtgatgtcatcacgtcggacgctgtcacggctcgcggcagcttggcgccaagaagctcagcctggctgcgcaggggaagctctttgcttgctcgtcaccgtggcaacgcgcgcggccgtttccggaggcggtggccaaagtgggcggggctaggccggagctgctggtgggaggcagccacttgagatcaccaggcctcctgtagaccggcgggtgcagggcmcggtcccagagttaagggtgtgagtgagactgctgcgggcaggggttggcctatgccctctgctagggggagaggtggagtttgggtgtggattaatgggttctgggtgtttattttcttttctctgagtagtgaggcctccaagaagttgtagggacctgtttcttccagacacattaatatgggccaaaatgtggggtctcttcacctgaattaattggagatcttttgggttgaggcctcaggcttcatttctcaggacttccaggcctactcccattagtactgaccgtgaaactattttctgtttggttactttttacattctctgtctaatgatggcataacaaaataaatttaaagattttggcttggtttattattaggtgaagtgattttttttaagtcccaggttatagatattatttcagcatagacactttaaaaagagagaaaatacctggaacaaatcggaaatacgtttgctaaaatmactttatttggcagggtgtttttaataacagtatctgaatttcattgttctatatattactgttattgtatccatttagcaattatttagattttagacacaatagtatgcaatggaatcaaactcttccctcttggagcttatattttgtggattcaatatcactttataaataggatgactcatacccatgcagagtattataaatgcaacaatatatggaaacctctgtattatggacatttatttcctgttgaggaaaatcgggagtattgtgtactgtatgtgatgcatgttatattattgtttctgatcactagacagaggatcaataaagctactacttatttttggctgtattacgtgtatcttagctaatgaaatggttatttgtgtgctgctggtcttggtaataaaatcgagatgtctttatttccagtaagaactcattgtatagtactttacgttttgacttcccaggtattttattagtccctttacatatggtctctcagttaattctcaaaacagcccatgagacgtaggtaatattattttcatttttctgagagaaaactgaagttttcagaaaattcctaacacaaaattttgtcttgaactatacaggcaaggcaattcagaattgagtcatttgtctctgaaatactttctggattaagtgacattaagagaatatcttaatccagtctgaaaatatgcatattttgccagttgcttgtaaaattgcatggatcattggtgaagaatagaagtgttttaaagtttgtcttttttgacacccacattgtataaggtttatcagtgccacagatgttttcacacctaatccaagtactttagatttcaaattcagtgttacacttgccatttaacagtgttcagatgatgaggtccatattttaaaggaattgtacatttggttaaagcagagagattttgacattacaatcaatcccactactgtgccaccttgctccttgtagtttctaaacatagagctaatgagacagaaattcccacttttagttaaaaattggagtataactgctgtgttatcagaatacaagtttaatatactttcattgtaaaccaaagagcagagataaggataaatgaaaagttagatttaaagttgtttcagaccaaaaaataaaaatggaaaaagtaaaagtgaatttaaacatggcaatagtraggtcttatttatttcccccaggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcaggtgaggagaaggggaccgagtcccgggaactcgttttggaaaccaccaaacctttgggggtactccacaggggtcgctggattcgtccggagcaaaagaaaaatacgcccctgaccctctccctctcttcaacacgccttcaacctgggtttggaagtttccgaatagtttttcctcgtcagagcgtaattcttaggcaaaagggtgtatttttctctttccttagaacctctttcactttctcagcgttcgtgtgccagccgccacgtcgcgtttttgtccttaaaaattacattttcaaacaggatttccctgccagacaaaattgactgcaatgattataattgttagagcccttgagggagtatccttcatgggcatcactcacctgtgtgttttcacaattaaaagagtaatctggcaattttatgctctcaacagccaaaagtgaactttgcttgtagagaaaagttaaatgacttaactaggagatcacagaggcagttttcctgactccctgcttccttatgaccagagggaacttaatcttaaatcatttagggtagctggccactagcagactgcaggagagctccaagttgtctggtaggaaactgggctccaaaagagaagaatataattttctttagagcatgccacacccccagcttccatttttttagggaggtattgcaggaaacaagaggcaaatgaactatttgtcaccctttctccaggttgactcaagttggcaggcaattagttcataataaaatattcaggctttgtgccttgaccatagttgaataaacacatagagactgaatgcaatagaaaaaaattaaatgcaagtgatagcgttttttgtttgtttttcccccgctactctgcgttttcctgtatagttcttattcctatgttagaattgatgatactacttttctttttagttatcaaaatctggacatatagggtaggttgttccagagttcactttttaggcgtatacattgtacgttcattactgggaaccccgcagcatactgttatttttaagtggaacagagccaagccattggatgtcggttccttaataaaatgaatctatgagatattacagatatatagtcaatttaattgaagtactattaaattacataagtggattaaatagttccagtgggcaatgtttatagcatggagattgagttcaggctctgggggtagactgtgttacaattttagctttacggctctctagctatgtggcctttggcaaattacttctctgttttccctgtctataaaatgggaataatatttcaagagtcgtggtaaggattgaatgaggtagcgcatgtagtgtggttataatagtaagtggtgcttagtaagtgctaaataaatgttagctattattttgtaaactgttagaaacactaagtcagagggtagttgagcttacttttgtacgctttccagaaaccttaggcataattaataatttggctatttcattgctgccaagcaaccaaaaatctacttagatcactcattcccccccccaccgacattttttcaatgtcacatttgccacacaattctgcagattatagctttggtgaagttaacatattatcctcaaggtaacatcttgttgatgttacatcatatttgtatttctttgtgttttattacgtgtgatcagcttttcaacgtttttaattttttttattgcaaaaggaaagacagacatatttaagtgggatttatgcttcttgtagtattttgagaacatatggtttttggtggggtcagtcatgcaggggaaatttcccaaagtgaggattgataacaatgctaattctgtggagtctggaattaatccattcattcattttcttcagaaaacatttattaagcactgatgtgcatcttattttgtgtatacgaaggtgtgggtcatattcttaaataactaataacctgtaaggaaagaatagtgttaactgggtagtatcaagcggtgtttactgtggtagtatcaaaaactttgcttgaaaccagctgggtataaaatgcatggtgttttcaaaaggtctcctgttaatatatgtacataaatcctttttttcttctgcattttaaagagttatggattgctgaagaaaatggagcacctatggtaaatccaaggaatatatcaattatttgttttttgggtgccggggacagataattaaaggtagacatgaaataccgaagtgtgctcagttgagtgtttatacagtcatagtttaaactgatatacactccactgatacagggtacagggagatgatctcgtcagagaatcggactgatagactgattatcttttttattttttggatgtgcatgcgtagtcttttcccagggatagtstctgaagatgagaatttagcattgtgagaaaaacaaatacaagagcttgaaatagaagaccatctgaatctaaaatgtaatacttttaatccgttcagtcatcctgattacttttcaaataaacagttttaattcattgaatctactttttagccttaattaaaattcaaaaaagtatgtttcataaaaatgttgacctaataatcaattttcatatccctaatggttaaaatgttaatgatattagaatgtattaggctacattaaaaattgtatttaaattatgtttaaattacgtctctgggtcctcttaggttccttgctttgtatatataagaagggtttgtcacctttacttgtttaagatgttaggatcatgagtcttaacttttttttgatgtgctaaatattgcatattaatttgattttccccaagtattagaacattcttttaaaaaaatccaacaatcatattttaatttttttttctagatttgtttacctacaaaatgcttcggtatccatatttttgtagaatgtataaagaatgcctttcatgttggttggaatctggcatacctaatttaggtgtctggccaaamagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacaggtgagttgaatttttattttttagcaagtttttgttgagataaaattcacttattgtaatattcattattttaaggtatacaattcagtggcctttagtatacagatgaatcccaacttttgatggttgatgcgaaagtgatacacattcagtagaaattgtacttttcagtgccatacaaccatgctttttttaactttcaggacaatattcatataagttacatgagatagtcaataacttgattataaaataggctctgtgttagctgattttgcctaactgtagggtaacgtaagtgttctgagcatgtttaaggtaggttagactaagctatgatgttcggtaggttaagtacttaaatgcatttttgacacatggtgttttcaactaatgaagggtttgtcaggacataacccccttgtaagttgaggagaatttgtattgataagcttatgaccactgtttaattgaggaatgtgtttgtcatcccagtatgaaaccccattcccattagtattcactcgccattgacatccttcccccagcccctgacaaccactaagctattttttttgtctctatgaatttgcttattccagacatttcatttaaatggattcatagatatgtggcattttttatctgccttcttttactcagcatgttttcagggttcttccatggtgttgcatgtatctgtacttggttcttttttattgctgaatcattgcattgtatggatatgccacattttgtttatccgttaaccaaatgatgagcatttatattgtttctgctttgtggctattgtgaataatgctactacgaacattcgtrtacaagttttcttttcttttttttgaaacagagtcttgctctgtcacctaagctggagtgcagtggtgtgatctcggctcactgcaacccccgcctcctgggttcaagcgattctcttgcctgagcctcccaagtagctgagactataggtgaacactaccgtggccggctaatttttgtatttttagtagagatggggtttcaccatgttggccaggctggtcatgaactcctgacctcaggtgatcctcctgccttggcctccgaaagtgttgggattacaggcttgagccaccatgcccggccttgtacaagttttggtatgtacatatgttttcagttctcttgggtatatatatctaggagtggaattcctctaggcttaactttttgaggctgtgacaaactgtttctcagagttgattggttttgtcaaattacagtcttaaaagaaaaagaacattacactggctgagtggttagggtatgaaaactgaatccagtagagcttcttgagaattttatttcataatcctttcaggaatggctggagacaaagatatgaatctgaattccttttcctgttttctaagccttggttttcaactaccctgaagtattagagttccccagagaatcaaaaccaacagacagttgacccttgaacaatgtgggaatttggggtgttgacccctacagagttgaaaatccatgtataacttttgattctccaaaaaattactaataacctactattgaccagaaaccttgctgaaaacataaacacatatttctttttttctttttctttctcgttttctttttttttttgagatggagttttgctcttgttgcccaggctggagtgcaatggcatgatcttggcccaccgcaacctctgcttcccgggttcaattgattctcctgcctcagcctcccgagtagctgggattacaggcatgtaccaccacgcccggctaatttcgtatttttagtagagatggggtttctccatgttggtcaggctggtctcgaactcctgacctcaggtgatccacccaccttggcctcccaaagtgctgggattacaggtgtgagccaacacacccttccataaacacatatttcatatgttatgtgtattatatactgtattcttacaataaagtaagctagagcaaaaatattaagagaatcataaggaagataaaatatatttactatttattaagtggaagtaggtcatcataaaagtcttcatccttgtcttcttgttaagtagactgaggaagaggaggaggggttgatcttgctgttgcaagggtggcagaggctgaagaaaatccacaaataagtggactttcgcagttcaaacctgtgttgttcaaggataaatcgtgtgtgtgtgtgtatacccatacacatatatatgtgtgtatatatatacacatacatatatgcatgtatacacagacacacacacatacacatacacacacacacacacacacacacacacacacaaccctaccgattttggatttaccagtgcaccacaatctcctaagccaattccttaacataagtctctctctttatagaaagagaggattaaaggattacataagatctttcattatgaccttatatcataatctagatatttaatttagattaaattaaataaggtcttagattattatttaaagtcataatctaagaccttctttaatcctgccatgaatactgtaaggtaggtatgatctctttaaagcaatgtaaaaaatgttggttgatataatattgaaaacgaaaaagctagaaactttctgatatgtatattcattcacaagagaaaaaagtattgtagattgtcttcaatttttaaagataatttaatgcttatatttcttagtgtactgacttcagaaatgtgatcccttattctagaagctactgtttttatctaaatcagttatttttatatctttcttctttttccaacatactgcttagtggttaagagcaaagattctggaactggactgcctaggttctaagctcttgtctaggaaacatgtgcatgtgtgcacacacccagcttttcttttttctgaaactttttcatgttggatcaggcagttttcatgaactaaatttaagctatatgtataaggtgtactacaatggctagatgttgctcatacaaaagccatcagtgatacgatgtgggttcttcataaaaatattatttaccttctcctcaggcagtatacacaggcaagtttacacacaaaataaatccagcattctttaaaaaatttttttttaaattttaattgttctagagagagtctgtctctgttgttgaggctgaagtatggtgatgtgatcataactcactgtagtctggaactcctgggctcaggtgatccttcctgtctcagcttcctgagtagctggtcctatgggtgtgagctgctgcacccagataaacccagtattcttaaatgaatttacgtgtataaagtatttagctcaatgctgtcatgtagtgggactccaaatatacatgaaaatgtaaattaaaatattaaattggataaaacttcttgttgaatgtgagtgacttcatcaaaatgaaattctcttcgtgctttaaaaagatccataatgcaggggtaacaattaaaatccatacataagtgtgagttttaaaaaatgtatattgaaatatatgtgatatttgttagtgtgtgtatatatacatacatatatacacctatatatgtgtgtgtgtttgtgtgtgtgtgtgtgtgtgtatatatatatatatatatatatatatatatatgaaaggataggggcagttagtaaaaattggaaccaaattcagtggcttgaacttgacttctgaaactaaaaaccgaagcacattgtattagtttattaaaccctagtaacaaagccaaatgcttatgttgcactaagccatggagtagaaaaacaaacaaaaacaaattgcactacatcttctagcaaatcagtattgtatccaactattttctaaaaccaagtggaataaaattagataattctacaacttgacctacactgctgtttcattctgttcaagtacctacaaatgtaatgttggtttattttggcattttcctttttctgatttgagttgggttttccagtaactttttataagaagtttaatgtttccaatgttacttctaaaaactttcttgtgaggtacacttagagacaatgttatttcttaccttttctgctgtctggcagacagctttattcactattcccttaatcttcaagtaataaagaactggtgacagtccttggacaggaaaggtcttcattttgtccataatccattatttgcttctcttcttcctgagccttttccccaaaatcattttccttttcaaactatgagtcatacactcacttgcatcagtcacttacttacttactattacctttttctgcatcaccttcaatgatgaatttacagatgaaacttttttttgtttttttgtttttttttgagacggagtttcgctctgtcgtccaggctggagtacagtggcacaatctcrgcttactgcaagctccacctcgcaggttcactccattctccagatgaaacttttgatgtaacaggaactttaaaaaatatctgaatgtatttgaagtgaggtgcaaggcattttatagttcttttttctttaatacttgaaaggtgctcacctaaagaaaatagtgattttgggaatttctttagcatcatagctagtttactacctatgtagtttactacagatttgtttttcaaatacacttaaaatatttactagttttaattatgagaaaaatatcctctttctcttggaaggtatttaaaattttaattgttaaggagaaattaaagaaattgtaattatttctccctgcttagtttgcatcatttcatattctaggtgaataactttttgtgaaaatgtattatcctaagaacttytttttttctcctggagatattttagtctgggctaatagattaactttttattcttgatttctgaaaactggagaaaaaaaagtttggttattttctaaatagctaaattctgcttagtttaagatggtagcagtttggagagtataggaaacctgatactcttgccccagtagtagtgctaatttagcttggtgccttggggcttctttgagtgttattataagggtacaagtaccccactagtacaagtagctgtgcagtttggtcaattaactttccatggttgtgcctcagattccttatctgtaaaataaggaaagagaacctatctcactcctggttactgtaaggattagatgagttaatatacataaattgtttagaattgtatcttccaagtagttgagcccaataaacattagctgttactatgggaatagaaagagtcaaagttgttagctagattaaaaaagaaattcaggagaaaaatgcaaggggagagcaaaggtggaaccaacctgtctggaactgaaaaagtactgtttcctctttctggaactctcctcatcttcatccttcaggcctggagtcaggttttacctttttatgggaacttttcatgagcctccacagaagacaggtatcccaattatatatcatgtacttttcttcatagcaacttaataagtcataattataattatgatgagattatttgttcaatatacacctctcttagtagattgccctccatgaagccatggacatatttgtcttgcttaccattatatctctagtgcttagcacaaggcctgccacatggtagttttgtaatgatgttttaagtgaatgaataaaagtcaaagtaaactagaagacagatgtgaggcaccaataagaggaatgtcccttgggtactgaggtagcttctctggctcaagacttttatataatttcagcrtcagtatggcaggccaggtctgatcaagtaactgatctgaaaaaacagatacaaaggctgagaaaataagctggcacctaaacggaagcaaaatagattatgatgacaaatagtttaaatttgctaggttcggttataaatatttcaaagtaagtttttacctattttaagttataatgtttagtattactttttataattattagattttctatagttatggtactagctttgataattttctttattaaatgcattatgctctgtacaatggaattttcttaagatcagtagcagtattttacttgttttatttaaaaatctttgcaatctttaatggagagtagacatcaaagagaaaaatactaaaactgtatgtttgctctctttaaatattggaggctgatgacgggagtttattttgtttgactccaaattgttaaagagaaacttttctaaggaataggaccaatggcatagcacctagagggagatatctttttaaattttttttgagacggagtctcactctgtcgcccaggctggagtgcagtggggcgatcttggctcactgcaagctctgcctcttgagttcacaccattctcctgcctcagcctcctgagtagctggaactacaggcgcctgccaccacatccagctaatttttttgtatttttagtagagacagggtttcaccgtgttagccaggatggtctccatctcctgacctcgtgatctgcccgcctcagcctcccaaagtgctgggattacaggtgtaagccactgtgcccagcctttttttttttttttcttcttaagaaaaaacttaaaatttcatatgagatggactgttgatgttgtgttttccctctgttattttttaaaatacaggtttctttgaagcaaattttattttacattgcattcttcctttgtttggagaatgttctaaaaaatgtagcacattaagtggcctttgtattaaaatatcttctgaaatgtgacactgccagtgctgttctggtaaaggtttaacacctggctctctgggggtaaggggtggtatgtgaattaaaaaaaaacaaaaaaaaatcctgattttagtatttgcaaatttccatggggtacgttcctgatgtcatggaatgtagatttagtctctgcctatttcttcaacttctgtttccctcttcttgaattttgtatcaatcacgatgcagttttccatacactttgtagtatttgatgcttctgtgcccttatacttgcccttttccctgtgacttgttggtctgagaacatcttgttcatatttcagtatctgggtttgtcaacttatccttcttaaagtttctctgcaaagttattcactctttcttctcttgactgcttcagaacccttgtcctttttttctccttttttctttttttaaattttaatgagtacatagcaggtgtatgtatttatagggcacatgagctgtctcaacacaggcattcaatgtgtgacagtcacgtcagggtaaatgggtcatctgtcatctcaagcatttatcatttctttgtgctctgaacattccaattatattattttagttattttaaaatgtacaataaattattgttgactgttaccctgttgtgcttttaaataatcttattcattctacctaactatattgaaccttgtcctttttaaaattatggagtgtattacattgtattataattatttcttcattgttattgattggaaacttattaagaataaagacaatgtctttttcttctttgcttccccagcaccagtatagtgcttgactcttagtgggagggcaataaatatttattttaactgtagttgaactgatgatttattagtgttatcagttgatttaacttaattggctttttaatttatgcactgggacctgaggagagtgctgtctttgggccctgtgctatacaaaaatttgttgcttcatttgtgtaatagatttagaaagaagaaattttgacacttctaataaaccttaaaagggtttcaaaatattcttaacctgaactttccaacatagctattaatggtttataacagaacttgagaatgacaacatgttattaatattatagtacacattttagaagcgaattatctttttgaagaaaacaatttatttttcatatttatggtttttagaaatagacaattgttttatgatgatatcttaagcaaaatgaatattgttgctttattttactgttgaaggttctatattgaagattttttctatgaaaacttttaaagcrtatctttgatatgtgtttaaaagtctcattagtattggattttatgataagctttatgtttattatatgcaatattttaagagtggcatgtttatctgttatttgggataaatgtagcatttataggtaactcgcactgcctggcaatgtgatgaatattttgcatgctgttgttaaggtatttaaaatctttagggagtcaaagtaaatgcagaactactagacaacaattaaatgttgaattcttatatttgatcatttaataaattgtatatgatatttttagttaataaaagttatagtttattaaaactgtaatgtgtattaactccatcttactcactcaaagtatcaagtttagaaattcctcttacagagtcttggtgtgaggagtgtgggaatatgaatcctacaggtaaatttaacatttttttaaaatgagaatgtttatggattatattttttataaaatgctttgttcatatcatgttataaaatgtgaaaaactgatgcagaaattagttttcttggttatctcttcaaatcctagtatatagatgtgtgtatatgtgtgtgtgtgtgtgtgtgtgtgtgtgtgtgtgtgtgtatatatatatatatatagtcttttaggtaaatgaggtagttatgcctaaagtgttacttaatctctttaacagttttttagagttttagaagtaaacattatttataactaaaatgaaaataacatattttttcatgcttattttttccataatgacgggttaacatttaaaatattgtttttatatatatatgtatataggtgtgtatatatacatttatgtatacatataagtaactatataattaggttttcatattcaaatctaataattacagtgtatattgaatgtataacttttttttaaaatttggcattcatgaaaatatgcttgtttttctaccactgaattaatgcattttcatcatatataattctctttatttgaattgtgaagcaaattattactaggacatcaaataattaagaccaacaacttattcaattatttttcctatccagtggctttaaattatcttttttctagttgttctttctcatggtcccaaactaattctttgctactaaaatataagaattaagataaaaaaatcaagcttccaaggtaattagaaattagtttttaaaattaaccaaaaaattatggtttcatagttgataaaaatgttacactctcatgtttaaaaatcagacgtatgtactgaatccaaattttaaatttgcttaagagccattctyctggttcaggaaatagacatgacccaggcagaaaacaggttcattgtatatgagaagctcatagaaagaaaagggagaaacgagtgaggtttttctgttcctaaagcacatacacacgagtcatcctcagtacttgttactctctaggtcagcattagtccctgatcaatagtctaatcatagttactgcaagagtctaggcttagtggctctgtcttttcccattgttcccctaagttgcatgttgttttatgaagagtggtaggaagtgtaccttgaccttgtgattctcataacattttattttactcttcttccactgccttctcctcatgtaacaaactactgagctgaggtgtaagtagcatacgtaaaatgttattttacaataaaccaagttgcaaggccttatggtgactcatcttataatgttctgtaaactctcttttttcctttgtggtcagttgctagtagttgtcccctttgggtgaaacaaataccaggaggtaatatgcatttaaatgttttatttttcttggtgaatattgctttagaaagtatgtgcattttttatagctacttattttctctctgttggtctgtataaactatttcctttgttcttcaatgtttgagatgtcattttatcaaattacatgctaatttaggcatatattttttatctttgtcctatttggcctgtgtcatctgtaataggtttctatataattaaatttcaagataaaactgaaatctttcttttgttacatgtatttttctttctggcaagcaaaagaagtaaactgtggatatttaatatattcataaagatggagaatttcccacttgaggcgagtatacactgggaagaagattattaataataacaacatagagttgtataagattttacwgtttatgaagcacttttatatattattgactgtgcttttcattaatactaatttcagtagtgttttgtgcaaagtatcatgtcagatatggaaagaaggacaggaaatgtctctaatgcatatgttttactggaaccatatagtaataaatgacattttttggacttgaatgcttctagctaataatcaggttatacagtatgctttttcccctcaaacctaagtgttcttatgttstagaggacaccctagaagatcttcagagcttgttatcaggccccttaatcccttaggacagctatttggcctaacgttactagagaatagatcactagccccctgagcacttgtgactatgcccaagctcagtcatttggagcacgttatgctgttcttgtcttcataaccctctgcagaggagtgcagacacatctaattggctagctcactgaatttttcagagcttgatctcagattgatctctcactcgtgcaaggaaaccttatatttataatgacagtatcagaagataaattgctcaaagaaagatatgggataagccaactagagccattaagtgactgaggcttagaaatgagggtggagagaaactgtggtgttgagggaaataaaaaactgtaagaggatgacttgaagaaatggagtgttaatactaaaaaggaaagcaaaaactccatgaatttctgtcctttctgtacgttttccctgctttctctagcaccgaggtaccattagtctcttgtctatggctttaatattactcttaactttgtagcagaaatatgaaagaattaaaattgacctcagttttatacccccttattttaaatgacctatataatggttatatgaatactttaatttttctaccggtatagaatatcatcgccaagacagtttcttctttgagcaatacatatgaaaccaacattttttagtagaaaaacttgatttttctccaatttaaaattaccgaaatagtgaactacttttatgaatgaaaatgtaagtaacttctcttgctagggcctgttttagaagttaaatacagacaggtttttcagaaaattgagataactgtgagagaggaatgttgtagaatgttttcttgtttttgtacttatttttgtaatatcatgttagtaatagaaaccatccagatttttctaaagttattaagctttcccctgaggagtttaaaggcatgattgatagcatataaaataaatacttttatttcaagatttcttcagagtaggtattaaaatttctttgagcaatttatatcagggatatatcagttttgtttaaggtaagtatgccttctgaaagccaggagtaagttgtgtagggtcaaattctccatttcctgtgaaatctgtgtatagattgacactattctggtttgattgtgctgatgatattatatctgagttctatgcagttggataaacgagtatccatccaaaactctgaaattttgtttcattttttttatttcagtgtattctattctgaattttggaaccaagctagctgattttacacgtttgattttatgattacatatggaaaaaaatcaaaaccgcaatgttacaggtctctcacacctttcactgtacttctgtaataaagggaattagaataatttattggttaaataaggtaactataaaccaatttttaacaaatttgattttgagttacgatgattgcgtattccaggtacaacttaaattgctgtaactgttttgttaagttcttttttggataaaaaatcttctaaaatcttatttttctgaaatgtaaacttaccttatagtatatgcatcttaattaaactgttcttgatcgacttaaggtagtaattttgaatattttttgtttccgtattctacgcatcagtggaattctaagtgacttaattccttatttctccaaatccacacatggctatgtatttttgggtgcctttatttcttttcagctagtgcttatatcttagtatgctcactccagcaattgaatcttcttgacgaaattttccagtacatttaatctaagcaaattggtgggattttcttggtgaaagtaggtagcacattaaatcagaaaacctagagtacacatcccacagatatacacatggctgactctctcactctggttgttattcagatgttaccttttcagggatgccttccctggccaccctgtctgaaatttcaactaccatcttcaaatgtttggtatcctccttccttgcttgtttgtttgttttttccttagcacttaacagtgatatgctgtatataccattctctttttcttcttaactgtctgccccttcctcccccaactcccttctctaccgccttcctccatagcacactagcttgaaaggtgggatttttgtctgacttttaccactgtatcctcagtgctaagagcatttgatatgtagaagataccccataaatatttgttgaaataattattgaatggaggaatgaaaagaaaggtcctacagaaagagacattgaggagatagatgtggcaatgattgggtgaagagaggcaaggatagggagaaattaaaaaatggcagtgaggtgttatatctgagttttagtgtgaaaattaaaccattctcttatttattcagaagatgtctattaagtttctactgtatatcaggtacaatgcacttagtactggatatgcaatatagaacaaaattagacatggtcttagcccttaaggagcttacaatttagtggttgaaatgggcatttatcaagtaattattcaagtgaatatgaaatttccactgccatgaaagagtatatagtgctcttagatctccgaacaggaggatttaaagtggtaagattttcttgagtgggaagtaatcataaggacaaagaatctagacaattaaataggttaagaggagggtaaagaacatttcaaagaggaaagggaacatgtacaaaagttctgtgctgggaaggagcttggtaagaatgaaagattgtaagcaagccactgagtgagtgtgctgaaaatgcaaagagggagatggtgcaagatgaggctggagaggcaggtggaggtgagagatgattaagtctgctttttaaaaagataattctctctacactgtggaggatggattggtccagattacttatgaggcttttgtccagacaaaagataatgagtggtaatagttgagacattggagaagaatgggcagatttgagggagatttaagaggtaaaaagcataggacaaagctgacatttattaaatactgtgtgagttcaggctgctagaacgactaggttgcttaaaaaaaaatggacatttatttctcacaattctggagaagggaagtctgagatcaaggtgcccacagatccagtatctgttgaggacctaggacttgaagaaaaagattgttttctggcgccatgaagctggagtgaaaggtaaattgtttatgatactttcaatacttgggctattttcttaatatttattcttaactttttccttgctattgttaatcatatttaagttccaaaacacccacatgctsatccactgtatacacattattttatttcatttagaaacttgtatctgtaaagtgactttaatttatttgaaagaagcattttattgctattttatgtagaataagcattaccacatagaaccaattaatactgttataactattaatctatataaaattatataaatttttctgtgtaaaaattttatgtaaacttttatttacatgaaagtataccaaagaaatcaccccgacagttaaaagtttgccagcttagtaaccatgacattattcatctttggtacattatttgaaatttgctgtttcttttcatgtgtttatagctacattgccttggactaatattcaacctattagttgacttaccaccattcagagactggtaaattaagtgtcaggcaacacccacttgagtctgaatgtgatttcttacttgtatcttttcatagctattttatgaattataatgcctaatagaaaagaaggaaggattttcttgcatgtaaatttccattgaatgctctgtgggcattttcatatggcaaccgttttagccaagatagaaactttgtttccctatttatgtattaatggtgttttataggttgggtaaaaaataaattaaggatagaaaaaaaattaaccagaaataacagtataatctctagattaatgcatgttgctgttaggtactatatactacattcatattctataagaatgtttaaaataatcatataaataataatttagctttaatcaatataatgctagaaattgaaaatagtttgtatgagaaagacattcggggagtacagttttgtaaatgtgttgtttgctgaaaatcaacattatgtatgtatgttatatacatttattttcaagcttcttaaaaattggacatgttgtagtttctatagtttttcctcaaaataattttaatgctagtgatagaaacttaaattttttacaatggacattttatatgaatctttcgctgtggttttattttgcaatgttttgcgtaaaagttgaaaagtgagcggaaactatgcaatcactctttttccctttgtagaattcagggatatgggatttgctgtaaaagtgtgagtagggaaactaaattctataaaatgaattttatgatcattcagatttagtacttaagactttattatttaattagtcttaggtgatttgggatattctgaccatcaactaaattttttagtctaatctaaagtggtactaatggtgttttaggagagtacaaatacattaaattcactatactgtataaattagcctttgatggttttcctctttgttaggttaatttattctaatgactcagactgggggatccttttattttttatttttttaatttctaacttttttgtttacatggtccttttgttgctggatttctcaacttgtcctcataggacatgatggagaaagtcctcataggacatgatggagaaagaaacatgttctaataacatattctcaaggttagcttacaaaggtattcctctgtcaaacacttgaggaatcttttagatgctattcatttacacagcaactcagtagactaggtcaacatgtctatgaataagtggttatcttgaatatttgaaattgtttagatttcccccaattttcttaacattttatatagtgattttgtgacattgcagaagaaaaacacagtcatactttgacattggtgtttgtactttttcttaaatataaaacttgggaaaaaatcttcaaatcatataaaattactttttttttttttttcttttgagacggagtcttgctctcttgcctaggctggagtgcagtggcacgatcttggctcactgcaacctcctcctcccaggttcaagagattctccctccttagtctcctgagtagctgggactacaggtgtgcagctctacgcctggctgatttttatatttttagtagagatgggatttcaccgtgttggccaggctgatcttgaactcctgacctcaagtggtctgtctgtctgtgccttccaaagtgctgggattacaggtgtgagtcactgcgctcagccccttataattagtttttaaatatgctataaaagaactttaaaaagttgaattcaataaacatgtattaatttttttatgtattttgcattgtgttgggggatctggggattgctaaaatagtgagtgaataagtgtggaggggataaactatgcccagaagatttatcttataattaaaggcttattttgtggaataccagtattaagaagacactgaatacaatttgatcacctaaatctataattgatggagaaaaagctagggtacacaattcatggggaaaagagaagagggctttcatttaaagagcataccaggcttggcatggtggctcacgcatataatcccagccctttgagaggctgtaattggaggatcgcttgagctcaggagttcgcgattagcctgggcaaggtggtgagacccccatctctacaaaacaaaaaaaataatgctgtatatggtggtgtacacttgcagtcccagttattcgagaggctgaggttggaggatcacacgagccctggaggtcaaggctgcagtaagccgtgatcacaccactgcactccagcctgggtgacagagtgagacctggtctcaaaaaaccaacaaaaaccaacacaccttcttggcagccttgcgtagggtgatatgtgtgaggatggatttaaatatcagggtttataatccaataggtaggatagtttgtatgcacataaccataatagtcatactatttgaaaaaataagtgttataagaaaggcatgctgttcaaattagagaagggaaaacacaagcagatgtatacatgtgagtactggatctttaaagaacagaatatttcaaatttcagttagaatacgttgagctgatggaaaggtctagcaactgactgagagagatgaaggtcactggatttgaggtgtacatattgtcaaagtatgagacattgtgtcagtctacatgcgcagatgttgcattcatggttattctgtttataagtacaaacacttaaacttgaccacttaaatatgacatatggcattgctaaatatgacttgattttctgaagtagagagctattcttggttaagtttcttttgatttatgcaatagttacatttctagaaaattcagtgtatattaattaaatccttataaaaagtactgtgtgatatgaaaaatgacattttgttttaggcttggataattgttgctgccccctctccttcatgaatagacactgtaagtcatggagaccttggatcagtttattttgtagcatgtgctgtgcatttgtgcattgcaggatatccaccattcctgtagctcacccattaagtgctagtggcatcctcccattttttttttttaaattacagtctaaacacattttcagaatgcccccattgagcatttctaggttagaggaaagaaggcacagagcaatatgtcgattagacccaaggagaaagcttctattttgcacagtgaccaatacgatagagatgtgaagcagagaatcacctggcaacagagtttcaagtacgttcctgaaataaaattgccatgaggcaaggtggtaargttttcttaccatctcaacctcctgtccacatttagcttctttcctcgcaccatctctagcccaggtttacctggtagcctggttatgttaacaccggtggccccagtgagaattcttgactggttttggtaaagtgtgtaatttcagcatactttctaactaaattagcatttttcttcctttctactatacttccaagcattttttttttttttttttttgccatttgaaggcagtcacaaaagatgcctgatatttctcaggtaaatgtttatttctcttatttttttcttgctgttaggtaaatgtgttgcataaaatgtaatctttgtatttctgtttgattgtgaacatatccaaatgcactaaaatgcattggaatcagtgaagatgatcattgcagttttatcttttgttcaaattgataaagttttaatagagccacctttggccaactttaacagtttttgttgtcttggaagaatcgtctcatatgcagcagattacttctaatgatcctgataaatcggaagtattactttcaaaagattaatgttataaagtctagccttgttgagctatttagttgttgtacttgttctaaatttggtgacctttgtaatgtggaacagtattcttcattttaaataaaatttagagtgattaaaaaaatgattatttacctggggcattaaaccaagtctgatgaggtttttagcttcatttgtgatgtaaaacccatagtgaagattagaagtagttcctgaagtatgcataccttgtgaaatatatttctagtttcaatatctttcctaggggaaatgcccatgctatggaaatcactatgattagcattaattgttatgcttcttgggtctccttgcaaagaagccagacttgtaaaaacgaacctctttttttgccctgtaaaggtcatagcaacagacattgtcttaaaatggaatagtataatggtctcttgactgatttaaatggtaatatgtaataatatacaattatattgtatgggtgatatgggtggtatctttcattaagttacatttctttcatattaaaatatatataattttatgtgagaaaaattgaatatttcataaaatccaatttgttcttgtcccttaaccttacctttaatatattacttattctgtgttttaaactggttgaaaataatttcttctctctctctgtttttatcataatcttgaaaatgaatcagttaaatcaattaattaatttcagctgcttttaagtttgtcttgcggagggtttcttccatgagattttcataaactataactgagtttatatttaccctacagtgaatttttaaattatcctttgaaaattcacattggggtagcttatggtattactacatttcaggagaattatttcatcatctttgatatatgatacagttgcttgtgttttgttttcattaccacagattcctgaaaagtttgtgaacactgaatttcaaaatcttctattttccccactgcattatattataatcttagtatgttttatttgaacttagagtactgaattaatacttacttacaaaattggtgtttgtatttttaacaagaagatacatttttttgagttttaatttttatctccttagaaggcagtccaaaaacatattagaattatgatgcataaggaatttaattacagtttctaagtcttacaaagtaaaaagtattaattggtgttatttgttgaaatatgtcataaagaacaatatcctaactgggggtatggcttaagagcaatctgatttaagaaaaagacgaaaagtaagatcttagggtwtcgtaattttgtaaatttttgtttcttggaatatttagaaaaattgattttaaaatgtctcttggaatagctgggctagaaatggtggttcaagggtgcaaggagattgtagaatcctctaaagggagcgttttttactacaatggcagggaatagatgccttatagatgggagctatgactcgtgttaaaaaccttcaagacaatttcaggcttactgtggtcactttaggtcttggcatttgatcaattgaggaagattttgaaaaaaatatatttctcttaacacactatggtagccagtctacaagatgggttccattgattatcactgcctaataatcatgctcaaatgtagttccctgctgcattgaattaggttgaccagtgtaatccataagatactgcaaaaatgatagtgtgcaacttcaaaggggaagtcataaaataaattttggcttcttccatgctgtcttttggattgcttgctcaaggtgggacagctaccatatcattgtatgcttaagcagcccatggagaggcctatgtagagtggaattgaggctcctaccaacaatcagcacccagtggttgagcagtcttgggaatatatcctctagtcttaaccaagcccgcaaccttgtgaaagagaccccaagttagaatcacctggttaagctgctactgaattcctgatccatagaaaccatgagataatgaatatatatttggtttaagccactaaattttagggtaattttttatgcaggatacagaagtaatatacacagaaataaaggcaaagtttcaactatgttgactgctctaaaggaaaggtatgcattactatacgagtgaccaacagacttcttttttaatatggaggtttgggaaaagcttgtgagctcagattcaaagaacaggaaagacattcctaacggaacaacatgtgaactggccctgttgttgattcaagatttttttgctgcttagctcagcaaggtccatgttcttgtctcatgaccaggaagaaatagccacgtggacattgaagagcgagtaggtgtagtggattttgttaggtgaaaaggaaagctctcagcaaaaagaggggtcctgaaagcaggttgccggttgcccacttcacagttgaataaaagggctttttacatatataccaatggtctgggttccctatttgtataaagcgcaaattcctggtagctccaccccattcccccgtgcgtatgtgggctcttagttggcggtggacatatttaggcaaggcccctgtgcaagttcccttatctgcacaaaacatgggttggaggttctccagggatccttctggtactgtctgtcaaaagcaagctggctaacccctttcattccctccttcagcaactgctgttgcgaaaaagtggacgaagacctctcttaactgcttcctgctgacaggaggcgctgttttggaaamgcggcagttaggactcctcctgaggtcagtttaagggtcctgggaagaatggcatgtccatgcatggtttcatttgcatcaccatttgaagtttaatggcctccaagcaaaaaggaacaattcgggttattagaagacatatatcaaaaygaaacaaggggttaaggactgctcaaaaatcccaaggctgccaatgtgctcagatagctggtagctagctatagttactatacctgctaagatttgggtgcatggggcttggctttggtagctctcttgatttttccaaacaaagaaaccttgagttatgggctctgtgtttactcttatcatatggtaggatttgcaggataattttccaggactagaatattgatccagatttttatcacccatcccttttgtttcttctgagctacagccagttatygctggttggttcacaggaataagcagggttagtttaaaatgtaggcaaaaacttaaaaacaactgatgagattagaatttaataacaggtatatgataagttttgaagcataatttttctttcttcagtcctcatttttgtgaaaaacaaatcatgataggactgagttgttggcaaaataaactttagtcctatacttgaccagattattggtgcagcaagaataattatttttcacataggcttctaagttggctttaatggaactctgttccacaaggaatctcagataagacctttaaaagctgagcccagtcatgggtttgtaccctcaaatacctatgagttgggtaaattcctccctttttgaggtcacaagaacctggggctcctgggcctgtgagaaagtgatattctttactcaccacaggttagtaaccctttatggggactgtgtagacaaggtatgaggccagatttcccaaggggcttttattggctctgcaagccatgcttgattccttaaagggaagcaaacccttccagtcaaaaccttggtgaaacaaccagtttctccaattgtgtcctgttgcaaaggaaaatgaattattattgcatagatgcaaataactatattgccgtaagttaaagaatactcacaaatagtttccaaattctggagatgccaggcggggagaaataaatatcctccaaattttgttcacaggagtataccttactcaattattaaaggctgtaattagctcaaaataaatttccttgactctaaaaacaaaacaaggatgagcaacattttaagcacaaaaggttaaaaagattacttcagttttctgttagttcagtccattctgttaactcttgttctacttgatattcatgaacctttcagctcttcatgagtcctgtatgtttctctctattccagtgtcccaatctccaaagatatcagaaacctgcctttaagagcacctgtcaaagtactatatctgattataagccatcttttgaaaaggatcaaagctagacaacaattgtctgtgaatagcaaaatgtccagggtagttacctcaaaaacactatggacaaagaaatttgtttatttctgtagcaatatggtttggctgtgtccccacccaaattttaccttgaattgtaataatcccccttgtgtcgagggtgggccaggtggagataattgaatcatgggggcaattttccctatactgttctcatagtagtaagtctcacgagatctgatggttttataaatgggagttctgctgcacaagctctcttgcttgctgccatgtaagatgtgcctttgcttctcctttgccttctgccatgattgtgtgggctccccatccgtgtggaactgtgagtccattaaacctctttcctttataaattacccggtcttgggtatatctttattagcagaatgagaacagactaatacatgtggtttacaataacataataaccttaattatgattgatagcatatactcagacattagaatggtagacatcctatatgattttaaaacacatattaatattattcattaaaatataacctatggaagattaaacatcactttggcaatcctctgtaactaaacatgtcaaataatcctgtttacctctctcttggatgctctaggggtcctctagcatccaaaagctaggggtcaggaaagacaatttttgaagctgaagtttgattttgggaaatatgttaaatatatatgttagaggttcaaaagcatgtgatattatggaatagaattccagattaccgtaagttcttttgccaaaatgatgacttaaaaaaaaaaaaggtaaaacctttcattatcttttactgttacatgaaaatcctgtttaagagagaaaaagccagatttcacccttacgttagtctgctattaatgtcaaccccaattttttgttttagtggaactttatagataattttatccaatcttagccagtttgaccatgaggtgagattttggtaaaccttttatcacactttacaaatttctgttaagtagcagatcagtgtgttaataaaaccttgttgtacttctatttcaatgcgcaatttatggaaagaccgtataatacctttttgaagttaatcaatatgttctcatatagaatttcttttggaagattaatttttataaaccttccactctttgtttaaaccttcagctttatcttataaacaatcctttaaccctagtctgaaatttacactcccatgccttctgataatcttttactaaaaacacattttactttctttatgcaccttgcgggtgaatctgttgtcaataatctcaattatatgttataacagtaactgttagcaatttttaattttagtgtaaaggctggcaagttgttttaattatgtgctaggtgcagataaagtctgactctttccaacatagttaagggcgtggttaattccatatgtcctcaagccttatcaaattgtaaagcaggcaagtcaaacagttctcaaaagccaaagaagcagtttgtaaccttcgaacatgtagcaaacctagtatctgaccagcataattcagatcacatatttacattttgaagacatttgtattttaccatttgtcttcaaaaatatttctatttctcaaagattaaagtcacttgaactaacaggcattacagcttttattttttttttttcaaaaaatattggatctaagcacttatttttctttaggccaatcaattagagctattttttataaaaccatcacacacataacacatgtrtgattatacagacacagacagaagaagatccagtaattgtaagattcttcattttctaatctcctagtcagatcattggcctcagggtggtacccttcaagagcagggctaggaaagcatgcagtttctagggaccagtaaacaggtatagctggaagacaaaaacagattttgagaggaatctatccaattttaattgctggagttccatgtggaaaacaagggattttttttttttccaaaatggggtttgtggcaccttctctgtttctcgccaggtgtcctaggctatcagaagttatcttagggcctctcatgtgtgcattaagagtagcaaaatgaaatggagaaaaataattcatttgactgagagaaagtcctttttccagaaaaacaagatccatgaagtgtaaaacataaaggccttttaaatatacctctagcttggatatccactttaaattaagctgagtgctttttaagaaaatccttttaaatccctcattaccctactttagccatgccaagtggccaatatttctaacttttgaacattaccaaaagtaacctcacaggtgaaaccaacaagcctcaatcaaggttatggcttaactgtgagtgtacaaggtattttcaaagaagtggtaagcacttcctacaaaatctagaatctttaaaggtggctcagagaaagaaagatttaagaaagaaagctagaatttgttcacagacgggaagagaatcagcaaattctaaaagtcacacagatactaaccrgaaagtactcattccctatgccaaaattgaacccgggccaccattttaaaatggcagaggccaaaagaaggtactgccacgtggttacaaggtcaagctcccaaggacgtaaaacaaaatggaaacctgcagcaatgtttgttactgcccagtttgctggttggcttgaacaacaggcttatggggtcctaggcttgcattctatcctaaggtattcctccttatcatggaaccatacaggaagacacaaaaagcacaccagattggctacagcctaagactagcctcacaaatccttttttccattaatccagacttcacagaggacacaaacagtaattttatcatttattcaaccggtctgcacagggagagggaggcccgaagtccagctgttaagaacttttactcttttaccagcatgtcagacttctgggtttccttcccctgagctcacttttaagccaagcagtttaaggtttggggaaactaacttttcctactttgggggatatatctgaggggagtgtcctgtggtatggggacacaattacccatctgtgaagagaggacagagtaaggatttttttttccctcaaaggaatcccagtgattcaggaggcatttgagagaaatacagactgaagatgattggttactcaactagaaagaggggaacaagtcatccctagttccttttttctcccagggaataaccgggttatgtgagggagagagagaagagctgtcctcacatccctgagtccctgtaaccttgggatggtgcagaccatgggtgccaatgtggcttttcacccttgttaacagggggcctaggaggtgggaattatccgcatttacccacatgctgcctttcctctgctgtcagtaacctttgagttccctagaccttgtctgtgccatggatgctagcatgacctctatccatgaaatgggaggggtcctaactggcaggaattagtcatgctaaggtaaatctgtggtgctgagtcctcctcaaacaagggagagtaaagggtgtcttgtgagttggggtcctggcttaataagatgttttccaaaaggaaaaaaaaaaaacaaaactcttgcatagaaaagctccctgttttcacagggccatgttagaaaagaaaagaaaaaaacagcttaaatgcaggatggagaaaatgcctgagggaaaatcctctagctctatgcaaatgggttcctccaacagggagagaaactcttaatcattgttccctccttttgcctaggccaggggtggaaagactctgtggacccatggcgggagttggtggctgcagctcattcctgccccatgtggctgttggatggagcatgtgcatgtgcagacatgtccatacaccctagctgggagggaagcagggaggatgggtgcctccgcttgcctttctgttccgagcgtgtgcctgtggcccttggggtgggggtgtgagatgtgcctctaagaacagatggaaatcgcattgttctgaatggcatttctgatggctgggctaaatgctcactctacctagtagtatctgcagtttgcagcaacatctttaacattataaaagaagagctaagtgccaggataatcctggaacaaaagaaggaaaatactgtagaaaagactggtttggaataaggctgacattcccaacccttgagagtgataggggtttttgggggtactctccagcatcctgtcctctgtagctgtgccattcattcttatctggctcaccagaggtttggtgctgcatctgccttcagaaaaagtctgaggaggagaagactcagaaatgaaagcaaaaggtttcagatctgcagtttactcacctgccaggtattctggacaagcccccaaaatgatgaagggttttttgctccttagctcagctaggtctaggttcttgtctcatgaccaggaagaaatagccatgtggacatcaaagagtgagtggagtagaatttattaggtgaaaaggaaagctctcagcaaaaagaggggtcctgaaagcaggctgctggttgcccycttcacagttgaatacaagggcattttacatacatgctgatggggctgtgttccctacttgtataaggtgtgaattccttgtcgattcaccccatttcccctgtgggcgtgtgggcacttagtccgctgcgggcatgtttaggcaaagctcctgttcaagttcccttatctggaccaaacaaaggtgggaggttctccagggatccttgccttactgtatgcctgaagctggctaactcctttcattattatagccaaataggttcttcttgcccgatgcccagaaagttaatatgctgagaacagcagtagttgcagcagagatagtgtttagtcatagcactttaattgggaggaggatgggagatatttctcaaatctgcctctctaasagtttggaggctagggtttttagcggtaatttggtgggcagagcactagggaataggtattgctgattgactgggcatgaaatcatggtattgtccaaactgtcttcatgtgctgagtcagtatctgggtgcaggtgttacaggactggttgagtcagttccttgatatgaatcacggtcctgttggtatcaggtggtatggccgaatgcacgagtctgaaaaatatctgaaagatcaatcttagtttttgataatagtgctgttatctaaaggagcaactggggaagactttgactttgggagacagagacaaaatcagaggcaggaggattgcttaagcccagaagttggagaccagccttggcaacatagtgaaaccccatctctacaaaaaaattaaaaaaaaaaattattctggcgtggtggcatacacctgtagtctcagctacttgggaggctgagttgggaggatcgcttgatctgggatgtcaaggctgcagtgaactgagatcccaccactgcactccagcctggttaacacactgaaaccctgtatcaaaacaaagcaaaacaaaataaaataagataaaataaaataaaatcttgtgactcctgagtagtaagcaagctagggaacaatggctggttattgcttaatgatgcttacagcttaacagaatttaggtccttaccataattctaaccttgtggcctttcattattttcacaaaggcagtttccatcctgaacaaagaggaggttagttttaagcagggactattatcatccttgcttcaaactgtaaactaaattcctcctatggttagcttggcctacacggaggaatgaacgtacagacaacttatgaggttagaagtgagatgaagtcagctatgttagatttctctcagtcgtattatttgcaaaggcagttttactgttatgggaaaaagcaggacacttttgagaaaccaaatgtcaaaaaacaaaatgaaaacaaatttagtttaaagatgttaattgactttgtttatgattctagaattgtacaacacttcattccataaaatagaatgagtgttacagtgagtggactagaggagattggttttatagatagaaaagggccaaagaaaagagaaacaaagaacaagaagtggattggtcacttcaaagttacttttctagtaaggcaagaacagggaaacagcacaataaaaaaataactattaatatcaggttacttaagtttacttatttttgggtaagtgttaaaggaagaaggaacttgattgtcttgctgcctggcctattttggaaatttggctattatttttctctcctgatttattggaaagtcagataactttttgatttggtgatagggaactttaatgctttgattttgatttttagtctagtgtgttggggcctagtgcaggagcttagcccaaaacagtagatttctataatttttatttaacgtgaaagcccattgtggctaagtgtagacagcaaggatgtatggaaaaagatgaagttaaggagaacagaaaatgctaggccttagaccatgttaagaatatttggtctttaaaagctgtgggaattcattgaaaattcattaaattcattttgagcagaggatgtgggctaactagattagatagatattttgtaaagaacattcagattgcctagtggaaaatagattagaagtggtaggctgggagtgggttgtgcaacagtagatgaaaggagaccagttagaaagcaattgtatttattgaaagagatggtggtagtttagatagagtggtaacagtttaaatggagagaggtgggcagataggaggggttttgaatataaaataaacagaatctggttaagagctagatatggtaagtgaagagagggaactgtaaaggtaggtgtgtggccttgtcgtaggatgaacaaggaccctattttttttttccttaatagaagatcacatttttttggacatgtttttagatacttttcagacagccagaatagggtttcaagagtctgttttggagctcagaggtaatgtctgagcatgagacaaagatttaccagatttaattcttattaagtcataacccatgtgatacagtccttgaggagtcttatagtcaaaagaacacagtacattaaarcaacaattatttaaaaacgaagcaagttctttatgcatttctcaaaaccatgaagggactcttaattcccagcagtactctctagtattgctcttgttccctttctcatcttttgttttcatcaaatgtagctggtgttccattcttttttcaaaaactactgaagaagctacccctctactctcatccaggctagttttattctaattcatccttcttcttttgtactttgctctgtactatttacgttgatgtaacggttcctattttgacaacataggaccttccttgcagtggatgatagggaaagaagctggtagcataaagccagatgttcctttgatgccttaggaaggggaaagtcagagaacagttatgggaacaaagacgcattaatgatttttgtcatgtaactgaatgatcagcatgtaagtaaaaactaaaaccatgagtctagatgaattttgccttgagaaaagatatcttgatcgttgagtagttccatcatttaatgactcggtttaggaagatgagcatagaggagactgattaggatctcttttgacatctgactggaacttctgagctaactcttgctttaggctgcagcctaggcatttgtttctttgaaaagccttttttgacatttcatttccaggttaggttctgctccagcaggcactgattgcctattatggtccttatcattgctataattatttatttaattgcatgtggtccccaatagactctaacctctgggaggatgagagacaagttcatcattttaaccccagtaagtgtaatcttttatgtagtggattgcaataagcatttgtttaattaattcaggcaggtattctcgtttggctcattaggtttcatatgtgtatgtcaatattttctacttagcttactgccaaaatatatagatctgttctttagaaaacaacataaaatagctgtactccaggttcttatatcagattatgactttgacctctctgtcacctaatacctataaaaagtttgggggaaataaaatttatgaaggactgcagtgtacttggaccatataatattcgcagtcttagaattactcatactcatgtttcactgttattccatagcttatatagagaaatattaaaagtaatgcaactttgaaactcattattgtgtttactccagagatggaggaggaagtggtaatttactgtcttatcagtttatgaggactaataggatttttttttcaaagtgcagtagcaggaaggcttattttgaatgaccagggtttagatatatatatgtgcgtgtgtgtaatttttggtggatatagtgaataatgcaaccatttatgtttctctcttgtagtggtttttaggaaactcattggtaaattttgtgktctgcttatattaaaggatgtaaacattttatgtcctttcttttgagtaacagtcataccactgattatactttttattgacacactttattcagatagcagtctgatcacacatgatccaagaacactgaaatagtaagtcaaatataatcagatgttaaagacttgtcatacattataggcaatggtgcaatgcttacttatgattgctccaatataaaaccacatttacacctcagtggccactgaaccattcagcacagcttccttaactgtcagctgttagaagctagcagtgtaagcactgttgactatttttttcaggctctgaatagctgtcaggatctcagtaggagttggaggagttagctcaactttggcttaatatctaaatgtggccaatctaggcttcaaatacgtcacagcagtgttcaccagcgctggagcctcctcctccaggttccagacaaatcagaccatggttttaggatgaaaaatccatggccccaaatggctagctaattatacttttaaaattcctcctatctttattgctaccttcatctctttcatatttccatttctttactgttatactttctgtactaatttacctttgtaagtcatctcagaattttttaaatttaatttttttaaaatttttcatatggcatgaaaaaattacttgtagacatctataacataatggatctcttattggtaatttgtttgggaactgacttggtactaactttgatttctctcactggattcctagactctccaggatgttagaactggctttggcctgtggaacacctcgtcttgtgcattctatttcctgaataaagggtcttctttgttttccctgcaaygagtggtcttttgctcctcatttctgtggtcctttacccattctcccaacccaatggcatttcaaaactatttaaaatttaaaaaaattattaatataattgcttacattattactctgtgatttaataaactgagttagataaactgtataataaaagttattgtgttctttttcatattaatgttttgtaatttttttgaagaatcatttaaagctttagatttattctagaaaagtctgtaattgaattataccatgataagctaaatctgaaaatgtaagcaagtttctatggggtagatgtatgatgattttaggcttttcttcgcatctgaattttgtttccactgctattttaatgagttaggaaatatgagatatttaaatatggcttggtgaagttcattgaacactttaatgttggttatattatttatatcctctatatagtttaaaaaacagctagcatattttatagatatatttgcaagactgattttaaaataatatattttcattgttttgttaacaaatcaaacttttcaagctatttctgactgttaaaactttctggaaagttgttccatatccttccggtcatctaaatttatcacaaggttttaactaagaaggttggtgaaccctctttccttttgatcttgcatcctggcgagtgcttggatatttcttgtgtaagaaaagttttggtagatgagtcagtgtactgagtcataggcagcatgaagcctctagtgttctatactaactaattggaaacagtttcaagattaattaaggcacagttgtcagctcagtgttactgattgacatcctaccaaagtattttgtcttttggcaacttgcttaattgttctttggtatttagatttttgttctgcttcatagatttttaaaaatctgttgaatagacctgtagttaccatgttgatttttattttttagaatcctgtaatgaaccctgtgtcattgtgattaatttcttccttgtttgatgccttttttctcttaaaaatattcaatacaatatcttttctttttatcttgctaatttatcaatctatgagaaagtgtgttatgcctcacacaaactagttcataagtaatagcatattgatttgttcaataatagcccactatccaattagatgttacgttttacttaataaaaaacaaattaagtggcttgcttacattcctttacattgcattaatttgactttaataaattcattaaaaatgacgtttttaaaagtcttttccttcattaggttcatatttgtttaaaataaagtatttgaaagaaaatatttcatttatataaagaattttgcaaagagggattgattaggtgttcttcatgtttatagaagaataaacaaaagtaaatcaagaccaggaaggtattttggcttaagagagcaagtatgttctggcaaaatgataaaatgctagaaaggattactgaataaaagaggaagagaagggaagtcacatattaaatacctgataggtttcaggcactttatatatattatttttctaaatccttccagcatctctgagatgggaattatttacctataatcaaatgtgaatcttgaagcctcaacaatatctgtataataaacacctaatgcaatctacaacagcattttagtgtgctgtctagtgccagattcaggcgttatgctaaaggaaaattcaggagaagcatttgatctagttacagagtagacaatctttagggcaataagtggattacatatctttcagtcattcctctgaaatgtttcttttgaagttattgattgaaattgagacacattttataattgatgacatgttataatttaattggcagtaccttttctttatagtatgtaaaattaatgctgcatctcataatcagtatcatcttagatttgatagagtacagtagatggtcagtctttgatgggatacagtatatgatcttaatcattccttaggaaattttaagaacaacagtaacctattgggtttttgttcattatccctaagttctgatgagatgatctttgaaaaattctgtggtcaaatatgttttaaaaacacagcataatctatccttctcttggagattttcagtgcctactagcatataaaaattctagcaaaaaaacaacatttttacctttgtttaacccattgtacaaacttatttgatcatatatttcctccaccctgacaaactcttttttacttacctagttttcaaaggacattatgaatgtgcctgaggagtttaatgctctatctaactttgggaaatgctgggttacttggttttttacctacaattgagtattaccagttagagtctaaatctttctgagggtccacacagttttctcttcagtcttcttatccaacctcattttattcatgtatattttgctcatagattggccagaaccacattaccaatttcttattcttttgtttcaacttttacttcttgagtcatatcttgggaatatagtttttcatttgctagcaaattgtgatatttgaaatttattaactggatgtttagagtttcattaaagattctaaacagagaattaatgttcatgtataaattggaaaggaaagaaatcaatttttcttgcattttatgatacctaaaagtcagtaggttatggtagccttatttccatgttacgctgattgcttcaaaggtacaacatttttcatgaacagagactctctgaagagtaaatctctattccctgctatttttcttgtttctttcttcactccctggccttcacatcttctttcttcaccacttccctctaccttctctcaaaaatctggactcaacttatttactgattctatgttctatcagcattatttaattctgtaatattgggtcatgcttatttccaattgtattttccatttttataattttgcttctctagtcctacttttagcactttacaagagaacttgtctaagtctttggctttttatacctaagctaaatgagcttctatttaccaatttccccgattgtcacagtagtttatcacatgtaagtcaccaagggattgagataaactgattttatttcaactttttcaaaattcttccttacctattgtatttgtagtcatggtctatgcttgtggtggtcagtcctgtcaagtagtattcttaagtttgttttcttcctatcactgtgctaaccatcttagactttatatattctgtgtttttaaacactctgatctcagtgaggaaaaacccattaatttataacttactgcattcatagcataataatactgcgttaaaaggatgggaaatgagaatagaaatgtggattggtaccacattgtttagcagtttgacggccagactaagacactgctaggctaaggcagcttttgagaaaggcaataatacactttattttttctattctgccatatagttagcttaaacacttgaattatttcaagtaggagcttggtactttatcatcacatcttctggacttcaattcattttctgattttttttttttttttagccatttctactttgaggaacckatgtaataggatttttctgataattagaggttgttcataaagtgtttaactgacagtacttggcacagacagagatgataatataatgacaaaaatactggattatggatgtagctgaagtgtgtgtgtgtttgtgtggcaggggtgagtggtgggtgttgaactaccaaatgtgctctaatctagccaaactagccatgtatcagatgtaccacaccagggccattcttgcagtttgcattttttagactggaaatcaagagacctgggttcttatcccaactctgtgttactttgcaggttacctttccttctaggccgtggtgccttcatagataaaataatgaatttggattaggtaattattagatttaaaatatatgattctttagggataggcaaggagtggctgaggatccattaaggagaacatgtaagtaggatcatctcttttatctcattgcactgtttctgatggattacccaaaaccgaactggtatatgactttggaatttatctgcttcccatagaaatttattttcgatacaaaaaggcctatataaaaaagcactataacaaaacagtacttaaattttatttaaaatatatttgcatttctcaaattgagagtcaataaagaaaattctgaggcaagaaaacatctctgagatgcyttgcaattggaaacactcattgagacaactgaggaatttagaaaaataaattgaataatatttgataaatttacactctcagcaaacccagggcccaatgtcgcttctttgaatttyaaatataggaaactataggcctgccatttctcagggtacatctcttgggcaggcagtcctaaactcctgctcagattaggtttgaaaggtttaatcagttcttatccactgcaccccagccctccaatctcctacagtgctcttttgtgtcttattgtcaacagagtggggctaaaagatttccaagataactttcaatttattagttatactacactagtatagtattgatcttttttcatttggcttttgtgtttcattggttcttttgttttctcttttctgttgcctattttctatattctttcttcttgttactgtctacttaggccatgaaattgaggtggatttttgtgagagatattgagggaaaaaaggaattggactgataaagcttcactaacacctcttcctcaaacaaacacacaaactaacatttattattttgaatatgaagagggaggagacactgagaagaaaattaaaaggagaaaaggtgaggatattgaattggaaaaagtattctaaaaatatctgtactaactttaaaatgggggtgattttaaaaaatgaaaaatccctctcctttatacacatatcgcctgtgtgatagaaaaaaaaacccctaaaatttatataatttcattctaaaggaaagagctttgttgctctcgccttctagttatcagtttagaaatcctgctcattagggttggaatgttaaaaccaagaaaatcattgctgccttttcaagagttgagactttagctttacttttctatgagtctttatttatcaaaggtattctcaggaggtaatgatgaacctgaaactgttccagcctgtgctgaaatactcccacaccatgttgttggaatagatgtaagcactctttgtaaatccatgccagaaagttcttcccatttgaagtttttgccatcagattaagaggaggaaattcccatctgttcagaggcaacagtgaccaaaaaaaaaaaaaaaaaaagaaaaggaaaaaaaggtaataaggaaagttttccgtgctttttgtgatgaaaggttttcattgggacgaattgttttcacatgataaatatttggatctgatgttcaaaagatgtatttggacctgaattaaaaacaaagttataactctaaatattatactatatataatttacttgttttggttggtatttggatttaaaactattagcatacttgactgcttattattcacccctctcccttctttaaaacatcatgtgcccaccttctcatctcttaccgtgctgactgcaagaacctgttaattggccacttactttcaatatatcttttaatttactgttatatggatctaactttagatctcatcacatcattttctagggtaatggtttgcaaattactggcaaaatatacaaagttcctttaccaccaggcccattttacctcttcaacctccccttctgccaacatgcgttacttcctacttgataaccatatgaggcacataattttcttttcaggtctctgactttgcacttgcttctgtscattctttcttccatgatgacatttattgcactgttsactaccctgtttgctctttcttccaggatggagttattacactttttgtaattgtctcttaacttgcctgtttcctctttaaaactatggagggttcatacctactttatatatttctagcatttagcacagtacctcattcaataacagtttattgcattactgtccctccttctgtatcttgtaaatttctgagtgtctcagcccaacaaagtttagaatcttaagtaggcttatagctgttcttcaagacctgtcaatttcctgagtgttcccctcaataattctttaatttttatacccactgttattggtcccaccctcttccttcagatttcaataatcaaatatagttatttgcttctgaaataaagaaggtcaattcccagcgtgagtgcctggtttatttatactatataacactagttagtggatcttgtatttctacttttatttcccaagacttttagaytttcccttctgtctcctggaccacacctgctactttatatacattttagacaggtgaactgagatttggaggagtgaaatgagttgcccaagatcatggagctaggaaatgatataattagttttatatgtcctcaaagcctatgtgtgcttttttttttttaattaactgcagcacactgctaacctcataagcactaggcctaagctgctgtcttaaattatgtactaatgtcccttatgttgaattcatttctcatttccaaatggatggtgaggaggaagtaggctttaggatataaattttttctttttagtcaattttgttgaaaggaatttgtttatgtatttagtgatagccatatgatggtcactaaattttgttttttaaatatagtttgacagagaaaaagggaaaaaatgttaggaaacgtttcttttttttaactcacagtctttgagggcctttttttttgtacattggaaaataattttgaaaaagtaaaatacagccatctcttagtgtccatgagggattggttccaggatccccttggataccaaaatccgaagatactcaagttccttatataaaatgatgtcatatttgtatataactgttacaggaaaggggtccgtatccagaactcaagagagggttcttagatctagtgcaagaaagaattagaaaggaataaaagagtggccactctataggcagagcagccctaagggctgcagtttggctatttttattgttatttctagattatatcctaaacaggggtagattattcatgagttttctgggaaaggggtgggcagttctcagaaccaagggttcctcccctttttagaccatatagggtaacttcatgacgttgccatggcatttgcaaactgtcacggtgctggtgggagtgtcttttagcatgcaaatgtattataattagcatataatgtgcagtgagggggaccagatgtcactttcatggccrtcttggttttggtgggtttgggccagcttctttacagcaccttgttttatcagcatggtctttgtgactatatcttgtgctgacctcctatttcttcctgtgacttacaatgtctaacctcctgtgtctcagccttattttacccagctcctattcaagatggtttcactctggttcgaatrcctctgacataactacgcacatcctccctttaaatcatctctagattacttataatatctaatataatgcctctccatccctttactccaatgggattcaacagtactctccatgctggcaaattcaagttttggtttttggaactttctggaatgtttctttctgaatatttttgatccttggttagttgaatccatggatggggaacccattaatatggagggctgactatattctaatgtgtgatttacacagttgggattggataaatggagagagagtgaatagataaaagaaaaatttgagatacataggtagatgagcccatgaaaatattagtctgttggttgcttgtaagaaaataaagaattagaaaacttcattttactgttgtacttaagttttgtttgagtgacccagtctactgagtgggcaaagaatgtgcttagaacatgatggaattggcatttagaaaatccaacagataaaatattatactcactgactcatgaaacagaaacaattaaggtcccaatttagcattctaaattgtccagattctggacagaggatctaatcgttaggctcattttacaaatatccatgtggtagagttggaaggatgagctaagcgcagaaattggtagtgctgggaaaagttctggtttaaaatttgagcctctgttaatctctataaattgactcatttacattttaatgtaaatttctaaatatcaattgaaataatggagctgtttgaattttcaaagtgggttcttacctgatttttctgttattgattctttcatgtgtaactcataagtgcaaagtttatcttaatttcagaggagctggaaggaaattaggaggtacaactcgtaattgaaggggagattctagcatagtggttaacaacacaggctgtggagccagactgcttgaggacaaatctatgttctttctctttcttgttacttgctttatgatcttggacaagccacttgatttcccattttttttgttttctcacttgtacgatgtggatagtataatacctaccttatagggtagtaaattcttggtaaatcttaacaatttgtagtttcttccttgccatgaacgtgttctgtaatctttggcaagtcactttatatctttgggctttgtttattaattttgtatgagggtatagataagctctagtttaccttctagttctagaactgattttagtagaataaaatggcatatcacagcttatggaataagtgtatgaaaaatatataaattttgttattagataagtacttgaataaataaagttgtaatgtcagaggtctgtgacttggtactgtgtcactttggrcaagtctgttggcttctttaagctttattagttttacctataaaatagaataataagaactctctcatacaaggattgtgctgattttaagaaatgacacctgcaaaatgtcaattataatgcctgattatatagtatgtagttaataatgctactgcacttaaatccctcttacacagggtctctgtttttctcagttctctctcacaaaggagtatctctctaatttatgcatttgaatttgtgccattctcagtataagatgattttagcgtatgacttaagtgaatttgtgagacaaaactgggcaagttttatccagttctttgtggaaggaagagccattaagaaactacaaaagatagaagtttctcctaatgggatttattttggcaggatcaggattgagaatacaaggaaaagagaattaagaaagcaggttaaaggtaaggtgttctctagatgtctgcagcattaaggtagcattttatgggaaactggtcccagcttctttctatctcattcctttattttgttaaggtttctctctggtttaggattgtattagatccaatacatccccattcataatgatttttagaatgtaatgctctccaataggaatatggcattggttctttaactagttttgttaggcattgaagaaaaaacaactaacttttctaagtttcagcatcttcttttacaaggggtggaggagagaacgagattaaactagatgatttaaatgtttgcctttagagccaattcttgatctgtccaggaacatggaccttattactttacagcctcaataatgcatcctttctctctttacttttaactttgttagaattcactgtcttttccttcccacctctgccaggtttctggagtgctctgtttgaattaatggcttatggaccctcttaacagagatgagagggagaggatagggagaccatattgcatataggatctgtaggtttgtgtgaaggccaaggaagaatgggcaatgcagggaagaggacaagaggttagatcttggataaagactgtgtgagttcaaattctggcttttttgtgtgcctcaatttctttgagtataatgaggataataactcccataggactgtattaatgagattatgtatttggtaatgatcttaagacagtgcttcattcttagtaagcattaaataaatggtagctagtattacaattttttaaaaggttttttactaagaatcttataaggattacatcaggaagcaggctgtctctgtaaggtcacttatatgccacttgagagtaagtatagtaattaatagcgcgatcttcattttgtgtggtaaacgtgasttagcagaaactaatacgactgaagttgaagactgaataaatgtaaatttcttctttaagattaatattttgcttggaaagttttgtatgttcccatgtgtgtctaatgtgttattattctttatactttagagcctaaaatataccccaggatgggaaataagatttggaagtcacctcrtaaaaaaatatcattcatcccttggtctttacagaagacatgatcctgaaaggtacccagttgaggaagaagtaggagttgaggacctgaaatccctattaagtcatatacaatttgagacattttctatttttaaaacaagtaaaatggttagamatttatctttctattcatgtcataaatgcatttcatgtttttgagacttcaacataaatagatttcagtgtgttaagaaagtgtatatttagttcaaaatgccataattgttcctgacggtagatattcagtacaacagaatctcagaagcctttaaaaatgaccttttcaaatagataaatatatttgcccataaacatttatgtcattactttgtagatgttttaagtcacttttgtttttcttctgaagtgttaaaaattaccagtggctttattcccagggagaagggaaagggaatgagataaccaaacatgtgtacaaggttaattttttaaatgatacaaactccaaaaattattatttttatgagctttcagatttgcctgtagacaaatttgtttcatttctgtgttataagattatatatattaactgaaaaacttataaatgataatatagacaattattttatactttggtagctttaccaacaaatccattggatccacccaggagataatggccttgaaacacaaataaaggcacagaaaaatatctttgacagcaaaagattgcaaaaacagacactttaaattgtttctgaaaacatgtttgtttaatctgtgatagatataagataaatggtatttaacccttattcctgaaatcgtaaactctttatttttttatttgcaaaaggtcttatgattcttacttgcaggccctgtgatggctaatactgagtgtcaacttgattggattgaaggatacaaagtactgatcctgggagaggtattccttctaaagtgaaggataagttgctgcatttggcctctcctacatccaacaaagaggcacaatgctttgtagacctatttgcattttggaggcaacacattcctcatttgggtgtgttactccagccaatttattgagtgacctgaaaggctgccagttttgagtggggaccagaacaacagaaggttctgcaacaggtccaggctgctgtgcatgctgctctgccacttgggcaatatgacccagcagatccagtggtgcttaaggtgtcagtggcagatagggatgctctttggagcctttggcaggccccccataggtgagtcacagaggatgccgctaggattttggagcaaggccctgacatcttctgcagataactactccccttttgagagacagctcttggcctgttactgggcattggtggaaactgaacatttgactatatgtcatcaccatgtgacctgaactgcctgtcatgaactgggtactttctggcccatctaggtattaattgggtcatgcacaggagcattccatcatcaaatggaagtggtatctacgtgatcgggctcgagcaggtcctgaaggcacaagtaatttacatgaggaagtggcgcaaatgcccacggtccccactcctgccacccagccttctctccccaagcctgcaccaatggcctcctggggagttacctatgatcagttgacagcggaagagaagactagagcctggttcacagatagttctgcacaataccgaggcaccacctgaaagtagacagctgcagcactacagcccttttctaggacacccctgaaggacggcggtgaagggaaatcttcccagtgggcagaacttcaagcagtgtacctggttgtgcactttgagtggaaggagaaatgaccagatgtgtgattgtattcagattcacgggctgtagccagtggcttggctggatggtccgggacttggaagaagcatgattggaaaattggtgatgaagaaatttggggaacaggtatgtggatggacctctttaagtggtcaaaaactgtgaagatatttgcatctcacgtgagtgctcaccaacgggtgatcccagcagaggaggattttaataatcaagtggataggatgacccgttctgtggacaccttcagcctctttccccagccacttctgtcatcatgcaatgcgcctgtgaacaaaatggccatagtggcagggatggagtttatgcatgggctcagcaacatggacttccactcaccaaggctgacctggctacggccactgctgagtgcccagtttgtcagcagcagagactaacaccaagccctcgatatggcaccattccttggtgtgatcagccagctacctggtggcaggttgattatattggacttcttccatcatggaatgggcagaggtttgtcctcactggaatagacacttattccaggtatgggtttgactatcctgcacacaatgcttctgccaagactaccatccatggacttacagaatgccatatccaacgtcatggtattccacacggcattgcttctgtccaaggcactcactttatggcttaagaagtgcagcagtgggctcatgctcatggaatttactggtcttaccatcttccccatcatcttgaagcagctggattggtagaatggtggaatggccttttgaagtcacaattacaatgccaactaggtgacaatcctttgcagggctggggcaaagttctccagaaggctgtgtgtgctctgaatcagygtccaatatatggtactgtttctcccatagccgggattcacgggtccaggaatcaaggggtggaagtggaagtggcaccacttaccatcaaccctagtgatacactagcaaaatttttgcttcctgttcccgcgacattactttctgctggcacagaggtcttagttctagagggaggaatgctgccaccaggagacacaaaaattccattaaactgaaacttaagattgctacctggacactttgggttcctcctacctttaagtgaagaggctaagaagggagatacagtgttggctggggtgattgacctggactatgaagatgaaatcagtctactacgccgcaacggaggtaaggaagaggaagagttgcatggaatacrggagatccattagggcatctcttagtattaccatgccctgtgattaaggtcaatgggaaattatagcagcccaatccaggcaggactacaagtgatccagacccttcatgaatgaaggtttgaatcactccaccaggaaaaaaaaaaaaacacaacctgctgaggtgcttgctgaagggaaagggaatacagaatgggtagtagaagtaggtagtcatcaataccagctatgaccacgtgaccagctgcagaaatgaagactgtaattatcatgagtctttcccccttcttttgttaaaaacatgtttgtgcatgtatacacttgtactaagaaaatatcgtcattttatttcctttctcctttatcatgtgacataagatttattgacttcacatcagaatttaagtatcgttaactttatgtaatagtatttgggttggggattgctgcatttccagttgtacgaagaatagttgtattatgttaggcataattatgaccttattgtctttttttgaagattatgtgtgatttcaggagatgtgtatgagttcaagttgacaaggggtggacttactttggttaatactgagtgtcaacttgattggattgaaggatacaaagtatttatcctagttatgtctatgagagtattgccaaaggagattagcatttgagtcggtgagctaggggaaggcagacccacccttaatctgggtgggcataatctcatcagctgccagcatggctagaataaaagagcaggcagaaaaatgtgaagagactggcctagcctcccagcctacatctttctcccatgctggatgcttcctgaccttggacttcggactccgtgttcttcagttttggcactcgaactgagttccatgcaatataatggaatatatatatatattccattagttattggatattattccattcgttattggaatatatatattccattatatatatattccgttagttctgttcctttagagaaccctgactaatacaagcctattgttgggaagtgatcaaggaggaaatgatgacacaatccttctcttaagggtattatacyattttcagaattatttatgtaaaacaataggattctacaactaaagacctggcttaagtttcaggattaagattttggtagagcttaatttcttcaagaatgatttccttgatattctttataaatacaagttcatggttaaatatcgatctgctgagtttattttttgtgtgaccctggcttcttaaaggcaatcctgattactctttaaaaacattgtaatacattggagttggtatacttaaatttgccaaagaacttgtgcctatgatatcaatatgtgagtgagattttgcaataataacatattatagttatttgaaaatcttaacaataatggtaacaattaccattgctccatttcttgtatataaatgtactatataaccataataataaaataaacaaaccaagagtaaaattttcatccctttaataagcctagcaagacaatataacttatttaggtagctcttcatttagtacattgattctcaatcatattagacccaacatcctttttttataataaatattttgtaggcaccctcttactggaaaatacagtcagaaatacacactaaaatatcaatataatatactagctgtaattgaaagaaataaaagcaaagtaaatcacattaagtattaagtattacagtatacaaatgaaagatgacagtgatatagtcagatgtttgcaccttccttttttttttttgttttttgttttttgagactgtgtcttgctgtcttgcccagtctggagtgcagggttacaatctcagctcactgccactgctgcctcccaggttcaggtgattctccttactcagcctcccaagtagctgggattacagatgcaggccaccaccccagctaatttttgttttttagtagagattaggtttcatcatgttggctaggctggctccaactcctggcctcaagtgatccacctgccttggcctgcttgcacctatgaatgtttggaattaagaaaagtaggaagatcataaatcatttcttacataaagggtactaatttgaaagaattgatgtacaaatggacactagaataaaaagtgatgttagaataagtaatagcaggtcacatttattagtttttgatttaagcaaaagggaaataattttagccaaagaaggaaaactatgagaagacaaattatatcctgtcaaattgaagaaaatgagttgggccttattttaattgtaatattatactaattgtctaggttgtcgtaaagggtgatataatgaaaattgaatagaaaatatgacttgtattttgaaactttacatcttgaaaaaaaggaacataggatgagtgataattttgggatggtgagttcagcctgggatcttttgaatatgtgctgttggcaaggcactgttgatggaaatactaagcaggtggttgaaaatgaaaattacaatttcagataaggttatgtcaacaagatttagttttgagggtcacttacagagcaggaattattgaagccattagattagatgatactgcaaataggataatagtaatcataaaatttaacataaaaactgctaacatttgttgatgtttattatataccgggcactgttcctctttttgacttattttttcacatatttctctcaaatcctctgtaaaataagtaccattattaccaacatatccttcttgcagatgaaactgctgacacaccaagacgttgccatagttcagacaacttagctagtagtagagtttggatagaggttcaggcagccaggctctagagccttcttccaaaggaaggatttttgaggagctcattaattttggaggcaactgtaacaagaaacaaacacctgttaggtaaaagaataaattagagtgtacattgtcttggaaggctaagaaacagagtatggtaggtagtatcacaggtttcagagcagtttagaaaaggccactagatttgatgattagtaactttttggtaaatggttattcaataatgttgcaaagcccaagaaaatgatctaagcatgtgttttcatgagactttctagaaattttcaatatgctttttatttgtccattagctattctggactttaagatacaaatgctccttgactgatgatgaggttacatccttataaaatcatcataagttgaagatgtcataagtcaaaaatgtattgaatatacttaacctactgaacatcattgcttaacctagcctaccttatacgtgctctggactcttctattagcctatagttgggcaaaatcatcaaacaaagcctattttgtagtagacaaataggtaaaataaattattttgtaataatataataagtactgattatcatgtaatttattgaatgtgatgtgggagtgaaaaacagaacgtttgtctgggtattcaaggtatggttttgactgaatgcatataactttcacaccatagtaaagttaaaaaattgtaagtcaaaccatcataaattggggactatctgtattctatcagataggtagtattttgagcttaagcaaacatggtgtagattgttttaagaaattctgtgttattctcaagggaaatctatcagaaataagcaatctaattttggatttgtttggggcaatagaatttgttgaaaataccaaatgcaatgattaaattagttctagatgaaaaggcagatattgctgaaaagtttaatgtgaaaagtgaaaaaagtgtgatttgtaatacgtagtcaagaagaagcaactcattcttgggtgtgataatgagtggagaaatattcatgtgggtgttttgatgattaatttgttgatttgtgtaaaatgcttgaagaaaaaaaagtatggcataaattctaaatattattattttattcacagaattctgtcaggcttcatggtctttttcccatgtgctcatctttctgcacctgttaccagaacttcattctacagcagccctgcttttgctgtcatttgaaatcggttccaaatttttcctcttgtaactctctccccatgctgttactcggttatctaattttgcatagatctttctaataagatgcttcttcttactgatctctctctctctctctctctctgtgtgtgtgtgtgtgtttgtctggagaatacacaatcaaatgtatttcctcaccttcaatgacttaggtaaaataatgttatctatttaattttcccccagaatcaattgccccaaaatggcttataccctgagaacttaatatacttttttttaaatatctttaactaaaatttagtgagctatttttattgttgttaattttttaagtcctttttttctgtagcctggaagctttttctttgatcattaaagtaggaacctcaatttgaaaacttgccacaactgaacatatgtcccctcttgtattagaaagagttataattttaatacatttttcaaattatgatttatgtctctttaggagagattctgtttgttttttaaagagccaagccaaaattttttcttactttataattaatgggattacatttatgttttaacttaaatctgaattttagaggtaattgtaattcagaagaaaatgcaaacatcaaaatatcacatgtatagctctttaaatatgaacattaattatctttggagattgattattgccaaaataaaatcactatatctctttgggtactttatgttaatatttcacttattacatacacaaacacaacatatgcagaagctcacacacgtaacggcttatttgtgaacaaaatgattacttaaaaacacacattaggaagtgatgttatcataatgtgatcattctcctgggatgtcataaaacaagaaatactgaaccattgccttcagtttcagggtttataagtaccttatgaccactgttttaattcactattgatactgtagaacgtatttatttaaaaggaatatgtatgtttctgcttgaaagtgggtgaaactgacattgccataatttataggtttttcccccatatttagccatacatgattttctttcactttggaaaattagtttataattatctcaattttttaaaaaagtgttatttctaattgaccaattataataatatatatttatggagtacagtgtaatgttttgctgcatatgtacaatacggaatgattaaatcaagccaattaacatgtcacttattttttatggtaagacatttgaaattaactcttttagctattctgaaatatacattattatactttaagttctagggtacatgtgtacaacgtgcaggtttgttacatataacttagtcatcctgctttgcagtagttctcagagacttattcctcctgtcttactgaaactttgtacccttggagcaacatctcccatttcttccctcctccccaggcctctggtaaccactgttctactctctaactctatgagttacacttttttagattctacatataagtggaataatgcagtatctggctaatttcacttagcataatatcctcccaggttcatcccatgttgtaacaaatgacaaaattttcttctttttaaaaggctgaatatttttccattatgtgtatgtactacattttctttatgcatttgtccactggtagatgtttaggttgattccgtatcttggctattgtggataaagctgcaatgaacatgggagtgcagatatctctttgatatattgatttcagttatcttgtatcatctagaatttgattgctaggccatatagtagtttatttttagttttttgaggtatccatatggtttttcataatggttgtattaatttatcttcccaccaacaaagggcaaggattattatttccacatcctcgaaaacacttgtgttatttttcatcttcttgttaatagccattctacagttataaggtgatatctcactgtaatttgcatttccctgatgattaatgatatagagcttttttcatgaacctgttagccatttatatgttttcttttgagaaatatctgttcatgttctttgaccattttttaattggtttacttgttttcttgctatttagttttttgagtttgttaactccttattagatgtatggtttgcagatattttctctcatcctgggttatttctttacaactaattatttcctttgctgtgtaaaaacattttagtttgatacaattccatttgtctatttttgcttttgttgcctatgcttcagggttgtataaaaaaaaaattgcttggatcaatgtcgtggagcttttcccatatgttttcttctagtagttttcgtattttctgataatgtatttaagtcttcagcttgtgacttgatttttgcatatagtctcagataaagatccacttttattcttctgtatgaagatatccagtttttccaacaccatttgttgaagagactgtcttttccccattttgtggccttggcacctttgtctaaagtgtgtgggtttatttctgggctttctattcttttccattggttgatgtgtctgtttttattgccagtaccatactgttctgattataatggctttcaaatatattttgaaatctgggaatgtgattcttccaactttgttatttttgctgaagattgctttggcttttcagggtcttttgtggttacatatgaatttaaggattgcatttttcatttctgggaaaaaatgacactggaattttgatagagattgtattgtaaactcaacgttttctgagtctggtggtatacttaactaatctgcattttctcttttccctccttgtgcaaacactaatctttatgctgattatctaattctctgctattagtgcctggatatgatgtaggattagtttctgtgttttcaaagataatgtgaatttatggtttcatttggttagtctggaaagcaatgtaggtacacaagaaatgtcatggtaaaagtagagtgaggtacagaatacaaatttcctagcctgttttatgtctttgtagctttcttcttggttatcatcctcatttttgatattatgagctataatgtgtagtttaaattctgaattctagagaacttacgttctggttcaggattcatttgtgatgttttattaaattacttttaagtggttctggaatcttaggctgggacttcacaatgaaaaaatgctgaaactggccaggcatagtggctcatgcctgtaacctcagcactttgggaggccaaggtgggcagatcacctgaggtcaggagttcaagaccagcccggccaacatggtgaaaactgtctctaccaaaaaggcaaaaattagccaggcatggtagtgaatgcctgtagtcccagctactccggagcctgtggcaggagaatcacttgaacctgggaggtggaagctgcattgagtcaagatcgtgccagtgcactccagcctgtgtgacagagtgagactccatctcaaaaaaataaataaaaatactgaaaatgaaaatgcatatttcatctattctttctatatccggcacttctgacctaaccttttgattgtatttgttattcttttgttcttttgtttgtccttctgaattaggaagtttggtattgatagacacagtcattaaataatggagctttcaggaactttgagtgatctttgcttatttaaacaaatgaatgtggctaattattacagcgggagttaggatgggtatattttgggtgactatgagttggaagtcttgtctgtaaccaagaaactgactctggctgtcttatgcagaaaaggaatttattgaagtaggttgggcagctctcagaatcagcaagaacatgggagaaccagatctgaaaatgagcagaaatcaaggaaagctcagcagtggcaaacacaaccagggtcgtgccaccaaatagtccaccttgcgaatctgtcactggttcagctctgctggattctcaatcttgttgctgctgaattctcaacactgttaccaccgtagtacttttttctctatgcagataattttttaactgtccctgagtcttagcagccctccaggattcagtattccagttgggaacatctaattatgtaagtataagtcatttgatgctaaggaatgagagcctaatggatcatctagtcactggggcttacataagatgagatggagtagcatttcctatcacagaatcccacagtacgagattcacctgtatatactagattcatatctagtatcaatatactagatacgaaaaaatatataaatttatactgtaatgacaaaatcctataatctttctcagatgttatttcaacaccttatcaactttatcatctgcttagattttcttttatccaacataagttaacttttttattgaggttctttccttggtttaatatttagcctttgaagtggtggacaaaaattgcattgattttataaaacctttttatattctaaaagacaggaatgcaccagtccattttttttagaattaaaattagaagatcgaaatgaagattatttaaaacctgtaattcattatttttatatacatttagggaaagattcctatactgacatcagttttttrctttctttttctttctcttcctctggttttcttccctcccatcctgtattaagccctctttgtctttgcccatatttattgaacacttctatattcaggcatggatgtttttcttttagaaaaaataagacaatgtcaccctcatcctcatccttgaggaaactcacagtccagtgtagaatgatagacaagcatatgtaaactaatttcattagcaagtaagcaattactgctgtaattgagaaataaaaaaaaaaacctataaagatcagaaatctttcttaaatagatcatattgagtagggtaagtaatgaacataatcttgcattcattcttgttcttttagagcaaacaatcagtagtttaaatgatgctttttttttttaattatactttaagttttagggtacatgtgcacaacatgcaggttagtgacatatgtatacatgtgccacgttggtgtgctgcacccattaactcatcatttaacattagatatatctcctaatgctatccctccccctccccccatgccacaasaagccctgtgatgctttttgttaaggagaaattttaaaatacagaaaaacacaaactgtagtacaaatattacccatattctcatgtacctgaattatataatatagaacatatttgtggaatgttagtgcattccacaccaaaaaatggtatttatcacaccatttaaaaatttacatggagaagacattgcaacagatgaaacagccggtgggaaaatgctgacactgaaaacagagggcaattcagggaagccagagcgtaagacagaagatggaagcaagtgactggaggcaggtcaggaccagattagaatgacctttgggccacagtaggaatttggactttaacctgtaggcaacagggaatcactaaaggttttgaaatagaagagagacatgcccataagatgctaagatgaagtttcacaaggtaaagtggaggttagaccaaaatggagagagactggtagagaaaactgattaaaatgtatgtttaataatgtaggcaaatggtggtgagagtttaaataaagcaatcatcattactattgtgagaggggaataratttgacagagaaatatgaattctgtattcaaaaaactagatagggttattagtggacaaacaaattcaggagccgtggctgttataagtactttgacaacttcacatagtaaagattctccagatattttttatcttggttgttcaaatatttgaaagctttagatttaaaactgatattatgatttgaagatttttactgctttcatatttctataatatttttaaaattatattagaaattaaaagcaagttgatatagaagaaaacaagcattaaaatgttgatctggatctatagatctgaaagatgatgtaccagaattactggctgtggaatcacaggaggtgatttctgttttgtttttgaaattccttagtcatttttttgaatgatgaacactattttttaacattaaaacttgtttttaacataagaaacacatagtaaacactcccgtttcttgagctatttaccagagttgtgaaaccttatttagataactacgttaatcataaatctatggctatgtgaataatataaataattcaaagttaatataagcctttctttcacaaaacacttggttttcaaaacctaatgcaaactcctactagataagaataattctattctcttacttttgcagcagagtgttgttattttaaataaagtgattttgaaaatttttcctaaagcctgaacacaagcaaaatttgtatttgcttatttactaatgattttcttctactctgataaccctggttgagtgggtggttgagtaagtatgctctggtgtggggggtaggatgtggttcctgttgggcttctgtactgagtgactaggctgacagctggttgctttgtttgggagattctaaattttagtgactgtaggtcttttctcttctgctgatcagattttccagagaattctctaatctctcaccagaagatagcaataggttgctcagaaccaagtcacggagctgtgatcccagagcacaggatggggacttggacttaattgctttcatttcattttctctgacctctgctgtgcctggtaacctagcacctaggttttcctggttggtttctccagataatgaatttcttgtctcttaggaagcatgaggagaggaaggggttgtgggtgaagctgttagcggaaagggatctcaatccagaccccaagagagggttcttggaccttgtgtaaaaacaatttggggtgagtccataaagtgaaagcaagtttattaagaaagtaaaggaataaaagaatggctactccataggcagagcaacagcttgggctgcttgattgataatacttataattatttcttgagtatacgctaaactaggggtgtattatgcatgagttttctgggaaagaggtgggcaattcccagagctgagggttcatctcctttttaaaccatatagggtaacttcctgacattgccatggcatttgtaaactgtcatggccctagtgagagtgtcttttagcattcaaatgcattataaattgtgtataatgagcagtgaggaggaccagaggtcattttcatcgctatcttggttttggtcggttttggccagcttctttattgcaacctgttttatcagcaatgtctttgtgacctgtatcttgtgctgacctcctgtctcatcctgtgacttacaatgcctaacctcctgtgtttcagccttattgtacccagcccctattcaagatggagtcgctgtggttcgaacacctctgagaaaactaatccttatgcagaattccaaccattactgctttttctatcccatctcttctgtcttctggagaagctggccactacttcagctcccttggactattaggtttccacttatgttctgttccatctttgagcacttgttgacatctctcatctttgttcttgggaatttatacctttttatatttctttaagcttaagtggagttttgggagtgaatattaattttaaaatgagagaaagataaataatgcatggtagttgaagtgtcatgcggagaacactaaacttgagatcaagtgacctcagatcagtcttaactctttgtgacttgtagtgcagcactaggtaagtggcctggctttttaaagcctttgtttcttatttccatgatagaggcaatattacccatcatattaggttgtattgaggctcataagagaggatgtatatgaaaaggtttgccaaatgttcttaatgtaattttttaaaaacgtaactggaaagtgagataaaacaatttgtcttaattgtaggtaattctgactttattttaatctcagttttcagtaatgagaatgaacagttttctaaacattttaggtgacatttcgttttaacacatttttatcattagcaaactagcatcatttgagcaatgctaaatatagtgatgttattgggttcctaacagaaaacctcatattcttgaawgtttacttctttgatactttcataatttgagtatttatatatttttaaaaattttcaaatctttgtttcccctgcccgccgcctctctctctctctctcttttttttttctttttttagggacagggtattcctctatcacccagactggagtacagtgacaaaactgtagctcaccacaacctcaatctcctgggctcaggtgatcctcctgcttcagcctcttcagtagctgggactacaggcacatgccaccatgcccagctaaatgtcttgaaaaattttttttttgaagagatggggttctactatgttgcctaggctggcctcaaacttttgggctcaagcagttctcctgtctcagccttccgaagtgttgggattacaggtgttagccactttacctggccatgttttcttaattttacttctaccataatcagacaaattaatatttctgattcaggaatatgtgatttttttttctttcaaaacaagacaaaatatggcttcacaaattttagcacaattttagcataaagtccatttaaatgaactggagctgatctataaagacaggataaatagatcagttccctttttcctattttctggtagcttgtattattctagggttgattagtttactgaatgaaatttcattaatagagtcaatatgtttttatttaaaatacggcaacttagcttcaaaagcatcacagcagctatagctcaggttactaatttgataattaaagctcagtattactaactttttacttttttattgctttagagattgctaattttctttacttcattcctgtattctaccttgttattgttcctaatagcttccatttattataccgttttagcactctactaactgccttacattctgttttacattgtgtcctcacagtcacccaatacatattaaatcctcatttttgagataaagagactgatgcaaagaaagactgaatcagtttattcattgtctcagacattgcgttaggtactagtagcctgtgagggagctgagaacagtttttgtattctgattttctaatatcagtcctatgtgtatttctcaaaaatgaatagacagaaaatagcatacagagctatgagcaaactattcaaggaaagaagagcaaagtatggagagcttagaagaatatctctccttttgttggctacttttttttgttttcctttcttctttcacatttcactttggtatttcaggagactagaaattaatgagtgattgggacaactgatttcaatatgaagaatcttaaagacttaacgaaactcttataaagaggtttgatagtaactgatgaaaagtctctagcatattttaacttttttgatatttattttttaaaaaaagagacaaaatttttaatatagattttgtttttttgaacagttcaagaattaaaraaaacttgtaaagatactacagagttccctaagctatagtctgaatatttgtgttccccacaaattcatatgttgcaattcttacctccagtgtgatggtattaagaggtgggacctttgggaggtgattagggcatgagggtgaagcaatcatgaaggggaagagtaccctctaagaattcctagagagcttatttgtctcttataccaagtgaagatgcagcaagaaggcaccatctgtgaaccgggaaaaaatccttcaccagacatcaaatctgctggagccttgatcttagatttcacagcctccagaactgcaagaaataaatttctgttgcttataagccacctggtttatggtagtttgttatagcaacccaagagtactaagacatgatataacctatactcattttctgctgttatttaacatcttacattagtatggtgtatttgttataattattgaactaatactgatacacaatcattaactaaagtctgttctttactcatatttccttagcttttacctaatgttcttttcctgttccaggatcacatccaggatatcacactacatttagttgtcatgtccctttagcttcctcttggctatgacagtttctcagactttgtttttgaagaccttcgtggttttgagatgtatacaatcaggtattttgtagaatgcctctctattgagttagcttgatgtttttctcatggttaacttaagttatgggtttcggggaggaagactacagaggtaaagtgccattttcattatgtcatgtcaagggtatgtactatcaatatgatttttcattgttgatgttgacctccattacctggctgtgtttacagatttctccattgtaaagttactcattttttccttttgccatgctgtactctttgggaggaagtcactaagcacagtgcatacttaaggagtagggagttacactgccttcattgggggtggaatatctacataattaatttggaatttttctacacaggcaattcgtctcttctccatttatttgtttgtccaatcttttatttatatcagtatggactcatggatatttatttatacttaagaacgattgtttttgttttactgcttcttgattttgaatcatagtgagattttcccactacattttattataaccaaggttttcccactgcattttattataaccaaggtttatctaataccgcattgttttatttttacctttaaataccaaccctatttggaatttactgtaatatgcagcattatttcaaatttattataatatctacagcataaagtagggactcaaatattaattccagacatatttttttaagatctctattttgggtcaggcacagtgactcacgtctgtaatctcagcactttgggaggctgaggcgggcatatcacgaggtcaggagattgagaccatcctggcgaacacggtgaaaccccgtctctactaaaaatacaaaaaaaattgctgggcgtggtggcaggcgcctgtagtcccagctactcaggaggctgaggcgggagaatggtatgaagccggggggcggagcttgcagtgagaagagattgcgccactgcactccagcctgggtgacagagcgagattctgtctcaaaaaaaaaaaaaaaacataaaaaagcaaaaaaagcaaatctctattttgaactgtaaaaccatacatctttctatgtattgaagattttctttggaattctttttttttaaatttactttattttaattttattattattttttattatactttaagttttagggtacatgtgcacaacgtgcaggttagttacatatgtatacatgtgccatgttggtgtgctgcacccagtaactcatcatttaacattaggtaaatctccaaatgctatccctcccccctacccccaccccacaacaggccccgatgtgtgatgttccccttcctgtgtccatgtattctcattgttcagttcccacttatgagtgagaacatgcggtgtttggttttttgtccttgcgatagtttgctgagaatgatggtttccagcttcatccatgtccctacaaaggacatgaactcatctttttttatggctgcatagtattccatggtgtatatgtgccacattttcttaatccagtctatcattgttggacatttgggttggttccaagtctttgctattgtgaatagtgctgtaataaacatacgtatgcatgtgtctttatagcagcatgatttataatccttagggtatatacccagtaatgggattgctgggtcaaatggtatttctagttctagatccctgaggaatcgccacactgacttccacaatggttgaactagtttacatgaattcttacaggcatcagttaaaaattgcccaaatgacttattaactttcttaaacctgcatctcctcatatctcagtaaatggtatgagcacataatttgccagagtcaaaaatctgagtatcaccttcaaacttcttactcttcccctattaaatcaccaatccctgttgaacttatatccagaattgtctaaaatatatttagctcttttttgctgccattgccctaatcttggccactactatcattttctttgatcactgtaattctgctctgctcttcatgcacaagacaaattcgtgccctcaagaatctcatatattggtgtaagagatagaaaataaatgtgcaaatatatatatatatatgtataggcatataattttttagatgatgagatgatactataatcaaagttgtaaattttgctgtagggaggtcaatttaatattactraggagtttagaaagaggaaagaagactgaacgtaagatcagttaatgaataaaaagtaatgaaggctggaataatggcagtggtggaaggaaatcatagatttttaaaaataaattaaaaatttgtatttttgtatttcaaaagaaatatatttagaaaatttaaaaaatatagatagacttgaggaagacaaaaaaatttctcctgtaatcctgctgttaaactgttaatctcttggcttgtatctttccaaggtgttgcttgtgtttatacagtttttcttttcttacagaattacaatcatactatttgtattttgtcatatttagcaaaagttttaaatgtctttttctctaatgcagtcattaaaagcctgactctggaaccacagtgtctgagtcagaatccttgccttacgatttttactagctatgcccttgggcatgttactctactcctctgtgtaccagtttcctcatctataaaattagtacaggagtataataagggttaaatcagttaatattaggaaatgtttagaatagcatgtggtacctaataagtatttcttatcattaccattcactcctttacactattaatttttattgattgtatagtattgcatcatatggtatgcagtctcaggagacagtattatgtgtggtctttgtggccaagtggacttggctaacctgtcagttattatctatctgacctttagcagttgaccttagctctgtgagattcagttgccttacatgtaaaatggaattatgatattactgtgtatggtttttgtaaaaaaggaaacatccatatgaaataacaacttagaaaactgcctggcaagaaatacacacttgataaatactacctgttattcttgtcaaagtggaatagctggataatggacatcaaaagtctaaacttttcaataatattttcaaaattgagaaggcataagttgataaactttttgcctttcttttataaatataataattcttagatggatacactagaaggacagttctgtatgaataaaagctgaattcccattgtagtaatttcttggtcttccacattgttaatttaagatatttggtaagtccttttataaataaacactgacagtgtgtgaaagaatatatatatttgaagtttgaaaatacataaactttgtgttaaaatagtaaaatgcaatatatgttttgtaaagaaggaattagcatctgacattttattatgaatacagatttccatcagtgaataaggcttccaattgaaaagatttagtagagttagatttttaaaaaaagtacttggcctgaaatcaagaaaaatgctggtttcttcaaagatgattgaaacaaatgtcttcaaatttgaaacatttgctggcaaagcagatgtttcattcgagacaagtgttttaggttgtgtgaagactccaagtaaaatgttttctatgcatgtaaaaagctgtatttaatatgaaatatggcaatgtaggcccaacatttaagttgtatggattaggtaagaaaaagtgattttttgggaaaatcagaatatagaactctggggatttgaaagttatattacttacatgatgaaacgaattaggaaagtatttgatgttgaatgttttctacatttaatttattaattttcatgattcttttggcgttggtttcctcatctgatataatgaaagcgttggagtctattggaaattagatctgctagagtttttttgggtccttagcaggagcatttaatgtgaaatcctgaagagaggtcaatagttctagttacttcagataactgagtggatggatagatagatggattaaaaacaaaagtttaataacccttcatgaatttattgtaaggctatgggacaaaattgaagacataagcataatcgaagacagttactcttattatattattacattgctgatttggttgggacttaaacacttttgatctcaggaaaagaaagaatatttaacccaagttaccttctttttactttccatagaggttagaagtgatttgatgagtggctgcccaatttgcatgagttatcatttgcctgcccagacattctactgagaagtttacaggcagcgtggttgtctattcaggaatatgccattatgaatacccatacacatacacacattcactcctcataaaccagcattcttttaggtggcaatatatcattaacatttttatattagtaaacataagtaaacaaaacctgtttactggagaatactctgccataaaaatgtatcagttattttaacaattcgctgctattagaaatttactttgtctccattttgggtattatctgtagtgttgcaatcaaaattattaactcatgtaattatttcactgggattaattatttgaggtgcaccaaaggtaacgtacattttattgtgtttgatatatgttgctaaattgccctccagaaaatatctaccagttgacattctattagcagtattatcattactctttccctacaaggccagatattaatagtctggttttttttggtcaagaacactatttttacattttaatgtgctttcccttagtgtatgtgaagtgtaacatttaatcatttgtctgtatgtgttactttttaatagtcccatttttcaaaatttaagtgttaatctttttattgttttgaataaaaacattatttacattaatactttcaaatcttattcattgcgaatattttacccagtttaaaaagatttatgtgtaaatattccttataggtttcgtatatgtgtatgtttcagaaattctcatttttatgaaccaatttggtgatttttttgacatcatcaagaaaacaagaagtacaaattgttttcagactagggtagactttctgtactccagaactataatgattgatactcacttgtattttcttcttgcactttgtttttatactatttgtaatctgttatttttacccaatttatgataaaagaaaacatttcccctctctgatttaaatagagagagaaaatgcacacacctgtgtgcacacatgggtttgtgtgtgtattttgaatctaatctggaaatgttttaattagagtttttagttcagttgcgtttaatatcgtcactgatcaatgtgggttgaagtctataatcttatgtttttccccctatttgtatggcttaaatacatattatatttaccctctgttaatttttcattatgcgttattttttctgtaacagttttttattaagtgaagtctagaatgcatgtataaaaatacagacgttttaagtgtaccattctatgattttttaaatgaataccctcttgtaattactactcaaatgaagatatgtaacatctctcactcagaaagcctgtctcaaacataactacttttcttactctgtcactttcttttccttgtttttgaatttcattcacatgaaatcataaactaatttatggctggctttctgcattcaacatgtttgtgatagtcatctatattgttgatgggattagtagttcattcttttttaaaattgcagtaatctattatatggctatacagcaatttatttgtccattctcctgttgatgggcttgtggatattttctagttttgtttattatgaataaagctcatatgaacatcctcatatgtattttttgggtggtcataggcactcgttttccaggagcatatagctaatagtagaattattgattcactttaggaaatagagccaagcagtgttatgaagtggttgaatctctttacatttgtatcagcagcgtatgagagttccagttgtttcacatatgcaatgcgacttagcattgacaatattttttaatgttatcctttctggtgtatggtatgtcattggtattaatttgtatttacttgatgaatgatgatattaagtacccctgagaaactcaaatggtctaaagttgggatctttattatctcctcacccataccttccacttttcagttaacaaagctataatcctactcagttgttaaaccaggaatctatattgtcttgtctgagtactatggtagaccataatgttctgtaagagtacaaattatgttttgttgttgagtgaatgaatgarcaaatgaacccttgactcctatgcatccttttcaaattgatgtgtttttataattttatataacagacattttaaaatgttttctctctgatatcactgctatcaccttaatctttgaacaatcctggattcagcagaagcgaattaaaaataatctggccaattttgttgtgaaactagagctgtctaaaatatagtctgtttttatttattacttttgaaaaagtaatctaaaactgtaattagttgtctgcttttccttcccttttgacttgtttggtctagtcaatgagaactatttttaaataaggactagaactaagaagggcctgaaacctctgtcgtttaaggatgctagtgtttatcagaaacatatttaacaaactatggcaaccttttctttgtacttctcttcaacctttctttgtactacttccctcttaagaattagtatgcaatttcttagtagtcttgttttctgagatgacaaaaagtgaggtaggaacaaggtgattttgataagaaatacaaatgaaaagaatagtatatttgaaataccaatttccccagtcctgtggtactggtattttaatttttttaggttttcgactggtagactctaggacttaaataagaaaaatgaactctgacaactgccattaagtgtttgttatcagtttattttcagttattgttggtaaagagagtaaaaacatgaataaatgaaatgtacatgcacgttaaatctttcagattttttgctaggtttcgttttctacttctcaactctgacagtagccactgggaggtaataatattgactgatgccaatttgttttctctcctttcctctttgtcctgtggagctagaaaataatgaaaagtcaagataaataataaagaaaaatatgtatgcccagaggaatgagtagtcgattataaaacatatggtctgtatacatatgtacacagggatatcaatgagtcacaataaattttaagtaattttttgctaatactaaagataacacgtttatttatttatttaatttttaattttttttttttttgtattttaagttctggggtatacatgcagaacgtgcaggtttgttacataggtatatacgtgccatggtggtttgccatactcatcaacccgtcatctacaataggtatttctcctaatgctatccctcccctagtacctcaccccctgacagaaccctgtgtgtgatgttcccctccctgtgtccatgtgttctcattgttcaactcccacttatgagtgagaacatgtggtgtttggttttctgttcctgtgttagtttgctgagaatgatggtttccagcttcatccatgtctctgcaaaggacataaactcatcattttttaaggctgcatagtattccatggtgtatatgtaccacattttctttatccagtctatcattgatggacatttgggtgggttccagcstttgctaatgtgaatagtgctgcaataaacatacgtgtgtgcatgtgtctttatagtagaatgatttataattctttggtatatacccagtaatgggattactgggtcaaatgatatttctagttctagatccttgaggaatcatcatactgtcttccacaatggttgaactcatttacactcccaccagcagtgtaaaagtattcctatttctccacatcctctccagcatctgttgtttcctgactttttactgattgccattctaactggtgtgagatgatatcttgttgtggttttgatttgcattactctaatgaccagtgttgatgagcatgttttcgtatgtttgttggctgcataaatgtcttcttttgagaagtgtctgtttatatcctttgcccactttttgatgrggttgtttgtttttttcttgtaaatttgttgaagttctttgtagattctggatattagtcatttgtcagatggatagattgtaaaaattttctcccattctgtaggctgcctgttcactctgatagtttcttttgctgtgcagaagctctttattataatttgaccccatttgccaattttggcttttgttgccattgcttttggtattttagtcatgaagtctttgcccttgcctatgtcctgaatggtattgcccaggttttcttctaagatttttatggttttaggtcttatgtttaaatctttaatccatcttgagttgatttttgtataaggtgtaaggaaggggtccagtttcagttttctgcctagggctagcctgttttccctacaccatatattaaatagggaatcttttctccatttcttgtttttgtcaggtttgtcaaagatcagatggttgtagatgtgtggtgttatttctgagggctctgttctgtttcattggtctatatatctgttttggtaacagttccatgctgttttggttactgtagccttgtggtatagtttgaagtcaggtggggtgatgcctccagctttgttctttttgcttaggattgtcttggctatgcggggtcttatttagttccatatgacgtttaaactagttttttccaattccgtgaagaaagtcagtggtagcttgatggggatagcattgaatctataaattactttggggagtatggccatttttacgatattgattcttcctattcatgagcatggaatgtttttctatttgtttgtgtcctctcttgtttccttgagcagtggtttgtatttctccttggaagaggtgcttcacttcccttctaagttgtattcctaggtattttattctcttagtagcaattgtgaatgggagttcactcaatatttggctctctgtttgtctgttattggtgtatagaagtgcttgtgatttttgcacattgattttgtatcctgagactttgctgaagttgcttatcagtttaaggagattttgggctgagatgatgggattttctaaatatacgctcatgtcatctgcaaacrgagacaacatgacttcctctctttctgtttgaataccctttgtttctttctcctgcctgattaccctggccagaacttccaatactgtgttgaataggagtggtgagagagggcatccttgtcttgtgctggttttcaaagggaatgcttacagtttttgcccattccatatgatactggctgtgggtttgttgtaaatagcttgtattattttgaggtacgtcccttagatacctagtttattgagagtttttagcatgaaaggctgttgaattttgttgaaggccttttctgcatctattgagataatcgtttggtttttgtcattggttctgtttatgtgatggattatgtttattattttacatatgttgaactagtcttgcttcccagggatgaagccgacttgatcgtggtggataagcttttcgatgtgctgctggacttggtttgccatttttttattgaggattttcgcattgaagttcatcagggatattggcctgaaattttctttttttgttgtgtctctgccaggttttggtatcaggatgatgctggcctcataaaatgagttagggaggattccctctttttcttttgtttggaatagtttcagaaggaatggtaccagcttctctttgtacctctggtagaattcagctgtgaattcgtctggttctggacttttttggttggtaggctgttaattactgcctcaatttcagaacttgttattggtctattcagggattcaacttcttcgtgttttactcttgggagggtgtgtgtgtccaggaatttatccatttcttccagattttctagtttatttgtgtaggggtatttatggtattctctgatggtagtttgtatttctgtggaatcagtggtgatatccctcatattattttttattgtgtctatttgattcttctctcttttcttctttactcgtcttgcctagcggtctatctgttttgttgatcttttcgaaaaaccagcttctggattcgttgatttttttgaagggttttttgtgtctctatctccttcagttctgctctgatcttagttatttcttgttttctgctagcttttgaaactgcttgctattgcttctctagttcttttaattgtgatgttagagtgtcaattttagatcattcctgctttctcttgtgggcatttaatgctataaatttccctctacacactgttttaaatgtgtcccagagattctggtacgttgtgttttcgttctcattggtttcaaagaacatctttatttctgccttcatttcattatttacccagtagtcattcatgagtgggttgttcagtttccatgtagttgtgcagttttgagtgagtttcttatttctgaaggataacacgtttaaatacttagtacagtacttagcttacaattatcaacaagcattatgtattactatatattgaaacattttaaaatttcaaaaattatgattgattaaagttaatgctatgttaatatatcacttaataacttgcagatatgtccatatctgttcttatgcgaaaggaaaatgttaaataataaggactagttaaaaatgaaaaataaaggatattttatattctctacagagtaggcctctaggagtatatgtgtgttgcatgaaagctatttgctattgcatgtatccaaggaaaataccagatcattgagaatggtctgatagacagttcctgagtaaaggaaatatattgaaagtttatttttaattatgagtcccacctaatccacattttacataatgtgttgaatgttaacatatataagaaaatggatattgcatttttaaaaattataaggttactgttttatatagagtctttaactgttttctaattttgaagtcaatctacagtggtcccttaaattatatataaactctgtagaaccagggatcatatcttttctatatttgtttaatataatgtatggtaaatagctgttcactgattgttttctggattaaattgaatcccattttaaataacgaaacactagaattaaaaagaaaggcagctagagtacagatttttttttaaacaatatttaatttttcattagactgttttgggttcaaatcccagccctgcttccttaaaagcttgggcaaattgcttggtcttgagccttggtttctgtgcctgtgcttataagttattgttaatatttggatagataataaaagttatcttttagaatagactaaatatatacaaatcatcttcaaaagttactagtatattataactgtcaaccaattagtagctgttgccatcaattttattagtgatagttcaggatcaacttcagtttgcggtgaaacaaaagaaatatgttgattgttctttaatccacttagaagtaaaataatggattgattatttccctttgatgcttttaggttttaaattgttttatcttgtattctaaagtcccaggccaaagcaaagtgaattattctaattctgtatgttatttatttattcacttaataaatatttttagagctttaatcatgtttcaggtcttgttcgcagccttgaagatataacagttaacatgaaaatatctatgttttcatggagtttctgatgtatttggggagatataattaatatataaataaatatataaatatacacacgtatctaatatatatacatatatttttaaaatatatgtgtgcattcatttttataaatatgtagtggaattatgagtcctgtttagcaatgttaagttttagatgcatagtagaaatccaaatagagaaatgttaaacatggtatctttgggtttggggktctaatgaacaaatgaaaggttaggccatagaaactgtttaaagctatggccaggaaagacagtaattcagggaacaaatcatccactataataaatgccatggtcaagtaagataagaactgtattttgcttaaatagaagtcattgctgattttgtaagatgtttcagggaaatgattgagtttgaaaagctgattggaatgagagaatattataagaacagcaagtatagccaacctatataatgggattttgtgtattatcaatatttgcaaaatattttagtcaacaaaaaatgattttatgtcttcagaatttttttgtatatatcttaataatctttctttacagcattatttatgatttgtttggagagttaattttatgacttagaattttatagttacaataaaagttattttactggttaaccccttgggataaaaatagtgtatttcacaaagcttacttgacttaattatagataactataaatgcctagtttttcatcatatacaaaaatatatagtactgtgttataggtgaaaatagtgaaggttaaagtgagraggaagttttaaaaacttgatcatatttagtttgataataatgctgttaatttttattaaaaaacaatatatttgtttctttaataattaccttttaattttaccagccactattgtaatataacatttttttttaaaaaagaggatgctgtgattaagtaagtttaatatatgttcataatgtatctgttaatagcaagaggattctttggtagcttagggtagtggaacctgtgaagatatgcacgaatgagttaatctctatttttatactaaatcactgtcaaacacataccttcatttccttaatcacataatataaaataactacagtgttaatatacttataaagaaacttcttaaaaatataaaagcaatgtttttcttcatgagcttgattaaactggaataaccttaaacaaatctttcctggaaacttcttagaagtaaataatagaaagcttcaaatttctgtgagatatgatagctatttaaaattaaaaattagtaaatataaaattaactaaatttatccagtaatccagaagttgttctgaacaaaagtaggtgagtttgataattatcccagtgctatggccttctctgaccaaataaataaatcacagctgagctttgagtatctttgttgttaagttgctagagatttttagaatgtttgaaaattcatcacttatgaagtgcttaaattcaatagtaagattgtacattggtataccatataacttttaaaatggatgaggtagatctcgtaggggaggtatgtgatattaataatgtataactcagggtcattaagaaggactgaaaaggggaaagcgtattggacagtacctggtacataagaacacaataaatgtttgtgcttttttttttttttttaacacggaccgatgtccatcttatattaaaataatagaaacatagtcaccacatacttgcaacactagacatatagtataattttattttgttatctttatagggaaaaatatatgtatgcataaatgaatatgtttatgtttgctcctgtatagaacaaggtatgaaaaagaagcacttctaagtttatattgggcaggctggatggaggagatgaaaattacaatgaacttttcattgttatttattatttgaaatgttgcaaatggtaacaacaaaaagtattctgtaatttcaaaagaaaatacattttatttttaagaaaataaaaattttctaataaatttcctaaaaaataaatttttaaaatgtatcttctgatatgaaaaggtctttggagattatagtgcttgagaatatattatttaaatacgcaagcattgttcttttggacatgtttcaccactagccatgtactcttagaggtttccctcacccctggctcatggccagtagatcaggttgaaattctattcattgcctttctttccactagtttttgtggcatttaaaaatatagtgaatatcacattacaaaattttatccaattagctttttaaatggaaagacattttgggacatatcatagttgaaccagcctattgctgacatttgcttcaccaaactatacatgaatcacatatattatttgaaaaaaattcaaacatatcaaacagatattttaatactctgacaaagtcttaaaccaaggcatatatagtattacatttgttgtaattattaacaatgaaaattatgaaatagctttgactttttatttggatttttaagaatgtaaaatgtcaagtcagatattattcatttactgaaattttattgctctgaatgaagagttgatgtaattaatgataatgaacaaatgttttaaaaattgactcatgtcaaaatgtttacttactagcttataatattttaatatttttaacagtaagtaattgttgaatctaagtactgaagaaacaggaaggtatgtactatcattcaaaaattgatatatatcgtatcagtttcaaagctaatgttagaactcacctgaagtaatcatctgcctagttttagagttttgctgccctgcgtacactcatttagctaaaccataccttttggaacgtctttggtagcatagtttttattattatttccccaaagccaatgtaaatggtataagtataggtgccagttcttctgttctcttcttatactggaaagtgtcattacgaactcctttatgtgtaacataataatgtttatttcctaaaggaaactgtgattattcatttaaatagtggcataaaaatatctaagcctatttttagtaatctattcatcctaggtaacttttaatgtttacatttgtaaaatatcgtttaccataatgtgttcaatgtgtgatgtaggtgtgtagcttattttgttgtttcattttctagaacacatttgaacttggaataaagcaaaaacatataatattataaactgacttaaatactttgccaataaatatgttgttgaattttcatttccttcagaagcccacaggaaatattaaatagtgttaattcacaattccatgattcatttctttctttaacatactgttttgaaatttgagcatataaaaattgctacaaagtcactactaatttgaactacaaaatgagatttttgtgtgttgaatgtaatgacattctgtcttgtgtatcttcattttttatttcccaaagaatggaacaaagcctacagaatgttataatagataaatataggattatgtctaaagtcaatatcaaatattatttttgaagaaagataccatgaaatactgccaaggattttagctaaagcactaattggaataatgtagtttttttttataaacttcttgtagcattttttcaaatacctactttgacaaatgtgaacaaatctgaatttatcagaatctcaattaaccatggagcaagtggtagtaaataacacaggccagtttaaaaaccctcttgactatgcgagtactttatcaattgaaatttacaactggtgaatagttacaagagtaagctttcatgagtgaatcatgtccatttgatgattccctgtggtgattagttagccaatacagtcaatctcacattttgtaaaatttcactaggagccatacaagagtattttataatttgttcagataacattgtaatcgaaatttcaacaaaatgaaggaagtaagttgatcacaatcagctgtgttttcattgtgatagtacttagttatgaagccattactacaaaattcattgaaacagacttcatatatatttgcaatgctattgatttataatttgtttttttcagggctcctgctagagttccatagagtgctctgtattttgagttaatgctgttgatctgcttttaagtggtgattatactttattgactactttaattttttcttgatcaatagttgttcaaaagttgatttagtgctgtttattagtaatggttttaagattactcctcataaagagaaatctttggcttctaatttctcttaatagttcttctcttgcttgtgactataacctagagaggggaaatgtatggtgtctttttgcatttagaatatagataaaattccttacaataacaaagagaatttatatttttataaataatgaatagaggtcaattattattctcagaagttgtaggcagaatcatttcaaacatttgttaagtttttgtctactctttggatgtaaattccaatttacttgtcatggtgttaagttaaatgagttatttcaagactacgtaactctattaagagtgcaaagaagatcgttcttaatttatgttcagacatgtttttatcttattttagaattattttagaattacaaattatttgaatgtgaagagattgtcgttttgaaactcctggccttatcattgagaaaattaaggtataaattttaccttcaggcaagataaagtgacttgcttgaagtcatgtggccatattattaaataaaaagcttagtatgatgcttatatatgaagtgtttaataattttctactgaattaggaatgtatcgaaacataggtaaattataatgatagatgagggagacaatgtttacttagatagaattgtaaattaatacaaattaaaatgttagcaaaattaactgatcttttaaaaaacatttgtaatcatggaataaggcaatattttatgtacttagctcgtttgctttagttataacttgttcaaccaaagtaacatgtgtaaactggcactaatgagccttatcctaggtttcacttacattatactgtataatggagttataacactgagcctactaataagtttgcttgacagcagggagatactgtgtatctcctagaaggcaaatgatacttctttcatatgattattataaggtttgtattttaaacttatcccttttttataaattgttttttagaatggaactggcatgaatgattttgcaatttcctgtagaatttcaatattgattacaatacttttatttaaaatttttatttaaaaccaaatattaactatatataaattgaagtttgtgaaagtttttttttcttataatatctttatctgatttgagtatcaaggtaatttaaattaccctttctttctccttgtttttacagctttttgtactttggatgttcctgagaatttaatagtcaactaaaataggaagatttaaaaaaatcccaaaatagaagttgaagggattaaaatagaagatctgagttttatttatgctttatataaatgtaaagaaatctaccttttaagggttgcatcttccaaaaggttttttttcagtacaacatgtagtcaataatagtatcttttcaatttaaaaaatctttatataaaactgtacatggatataaatctgttgtatattttcaggttctatggttagtaatctagtgtctaattatgaactccaagtattataagcaagtggtgatatattatggatgagttcttttggcacggaaatattttaagaagtaaccaaaacttcaagtctgaaattagataaactcctgaaaggcaaagttgatttatttttaagcctattgtgaaaactagtagtcagaaaagagcttagcattgtgttctgactgtaaaatacctaaaacaattaacataaagtgctagttgtttctgcctaattttcctcccttagcaaaggtaataagaattttcttaaactgaggttaatattttaataattattatttttcatcagcctgttcctgacctctgtttggtatactcagtgtttatatatttaaagcctttttaaaataatgattaaccagataatctcaagttatttgagttactatgttttacatcaaacataggcaactaaagtttcttttgtgtctatctgtgtgtcttctcctgatgaggttttcattctgagatcatgtctttggtatcttgtgatatctcgtcttaagattatgtcatataatacttgatagtttgcattatgaatgcagaattaatattgtctgacaataaatgataacacattctgcaatatacaacttgatgtatcaaaaagttttccaggctttaagtgaatatctacttattttggaatcatatttattgcaacaattccaaaataatagttgattttgaatgttgaaccagccttgcattcctgggattagccccacttgaccacaatgtagttattccttttatatattaatgcatttgatttgccttttttttttttgcacatttttacatctatgttctgtgaaggttattgatctgtaattttcttataatgtgtttgatttgtgtatcagagtaatgttgatcccatacaatgaattgggaaatattcactcctctactatttcttggaagatatttttgtaatagtggttatacttcttcattaagtcttagaatttatagaattcactgttgaagctatctggaactggactttcctttattaggtggtttttaaccatcaactcaattttaaaaatagatgtagagctttttagggtatctcaatagtagagaccactaatgttattaaataccctataatccacaggacagcctttgataacgaagaattatctggccccaaatgtcagtagtgccaagattgagaaatcccagattagctgtttcttctctgagtaaattttgatagtttgtgttttacaaggaatttgttcacttcagctaagttgttgactttatgtgtgtagactttttcataatattgcattattcttttattatctgtacaatcttagtactttatctttttcttatgtctgcttataattaaaatcttaggctttcagcattagtataagaagactaaacttttagactaattactaaattccactggattttaagccattctatctcaggagaatacaacactatacttctcattgaatttagaagttttccttccatgactccaaattctttaaaggatatatttatatagatgtttaccctctgtattagtcagttctcacactgctataaagaaatatctgagattgggtaatttataaagaaaagaagttcttttggctcacagttctggaggctatacaggaagcatggctggggagaactcaggaaacttacagtcatagcagtaggctaagggcaagcaggcacatcttacattgccagggcaggaggaagagagagaaggtggaggtgccagacagttttaaacaatcrgatcttgtaagaactcttatcatgagaacatcactagggggatggtactaaaccattagaaaccactcccataatccaattgcctccctccaggccccacttccaacactggggattacaattcaacatgagatttgggtggggacacagatccaaaccatatcaccttccacccccattccataattgtttatatactgttagaactgtgatctcaacaaattgacatctccaaaggtttatctgtgtgtaccgaaaatcatatcattagctattttcaggatgactctgagaaaaaagaaatccaatataaaaaattgctataactatatcccatgttcaagtttttatgtttcatttcattcaaattatatcactccccttggcacaggatctctaaagaatattggctgtaaattaaagtccagactctttagtttgacatttaaatcctacacattaactatccctaatgtattctttgtatttttctattataagattgtttcctacttgaatctttttttcttagggttatctattttgttcaaggttgcccacaataccggtttgcaatccctttatgttttatttgattccttctcccagtctccaaaatagctctgtcatttaacttactacatagtgccctctttcaaggactttacttgctttgatggttgatctttctttctttctttctttctttctttctttctttctttctttctttctttctttttctctctctctctctcctctctctctctctctctctcttaatatatggagttttgctcttgttgcccatgctgaagtgcaatggtgcgatctcagctcacagcaacctctacctcctgggttcaagcaattctcctgccacagcctcctgagtagctgggattacaggcgtctgccaccatgtctggctaattttttgtatttttagtacagatggagttttaccatgttggtcaggctggtctcgaactcctgacctcaggtgatgcacctgccttggcctccaaaagtgctgggattacaagcatgagccaccatgtctggctatttactttcattctgcggttgaaactatcaaggtaacagaactatgaccaagcatgatgacatatgtagatgagtttaacttcatagaagacaaatacattttttaataaggaaaatatatctttgttgaaaaagaaaaaaataaaagattattttatttttaaattttttgaccactgtcagaaagaaagattaaaaaaaattatttcactagctttaggggtacaagtggtttttatccacgtggatgaattgtatagtggtgaagtctcagagtttagtgtacctatcacttggtgataggtgtaccttgtgccccaataggttttttttttcaaccctcacccgcctcctaacctccgtcttctgagtttccagtgttcgttatacccctctgtctgcctttatgcacccatagcttagctccctttataagggagaacatggagtatttggttttccattccggagttactttacttagaataatgatctccaattccatccaagttgctgcaaaagacatttttttcttcattttttttggttgagtggtattccatggtatatataccacattttctttatccactctttggttgatgagcatttaggttgattccctatctttgcaattgcgaattgtactgcaataaacatatgcatgtaggtatcctttttgcgggtattgttttgatacaatgatttcttttcttttaggtagatacccagtagtaggattgctgaattgaatggtagatctacttttacttctttgagaaatctccatgctgttttccataagggttatactaatttacatttccaccagcaatgtataagttttcccttttccacacattcacactagcatctattgttttttgactttataataatgctgttctggctggggtaaggtggtatctcattgttattttaatttgcatttcccttatgattagtgatgttgagcatttttttctatgtttggccatttgtatatcatcttttgagaaataatctattcatgatatttgcctgcattttaatgggattgttttcttcttgctcattttttcgagttccgtgtggattctggatgttagtcctttgttggttgcatagtttgcacatattttctctcattctctaggttgtctgtttactctgatgattttttcttttgctgtgcagaagcattttagtttagttaggtctcatttatttatttttgcttttgttgcatttgcctttgcattctttgttataaattctttgcctaggctgatgtccagaggaatttttcttaggttttcttctagaatttttatggtttcaggtcttagatttaagtcttcagtctgtcttgagttggtctgaaatgaaatagggatccagtttcatttttctatatgtggctttccaattttcataccatttcttgaatagggtgcccctttccccagtttacatttttgtctgcttagttgaagatcagttggttgttaagtacttggcttgacatctgggttctctattctgttccagtggtctgtgtttctacttttacaccaatatcatgctgttttggttactatagccttataatataattgaaattgaagtaatgtgttgcctctagatatgttctttttgtttaggattgctttgactattcgggctctttattggttccatatgaattttaggattgttttttctaattctatgatgaataacattagtattttgatagcagttgcatttaatatatagattgctttgggcagtatggtcatgttcatgatattgattcttccaatccatgaacgtaggatgtatttccatttctttgtgtcatctatgatttcttttagcagtgttttgtagctcaccttgtagagatatttcacctccttggttaatatattaagtttctttgttttcgttttttttgcagctcttgtaaaagggattgagttcttcatttaattctcagcttattgatgtacagcagtgctgctgatgtatatacattgattttgtaacgtgagactttactgaattcatttatcaaatctaggggtcttttgaaagatagtttaggtttttctgtatataagatcatatcattggcaaacaaatagtttgattccctcttaagaaagactttttttttttaaaggagaagactgacataagaacaaacaattttactgttaaagtaattaattgatcttagtatgaatattacttcatttaagtcaactggccactttgaaagttgtataaagtctttctggtcagtaaaaaattgagatatttcaaatgcctgtttctagtaataagtcagggtaccaatatagttaaattggcctattgttcaattcatcgtccctccatggagttgtttacaaattccaaactatgattagtggtatgataaaattttaaagagcaataccaaagtcttttaaagtattagtatccgagaaagaaaagtaatatttacattttgaaactatatttttaaagagcatttaaaaaatcatctgttaagctgttttttttcaatttgggcttgaatgaaagttaattcaaagttgttttcttagttttaagaaacgcagcatagttggactaattttgccgtagttcagatatacaacggtaatttttattgaattttaagttctttgaaatttctcctgctggaagtgtattatcgagagtctcctttttaaaagaccttctgtcaaccaaaggttctattactgtttattcaaattcagaagccataaaatatcttttgtattgctaaattactttaggatttagcataaaattttttggaatttaggcctttgtgaataattatttttttgattaaaatccgttttataatattatttatttatatgacactacttttttcagattttgttcatgtgtattgtcttatttgcatatcccaatttcctggtgatgtggactaggatggtgtatttatttccatttacacacgaggaaactgaggctcagagaagttaagtaacttgcctaacaaggatttcctggtggtatagtatggccttttctacgtctgaaacttgtgctatctgaagtcacatgtttaaacattttcaggaatatgtaagtttctatttctccctgcaatatgcacatatgtgcatatatgtaattgtacatgcatgtttgcacatgcacacatagacactctgggttgtacaccaacacttgtatgtattgatctgctttgatttgtgtaaaattaatgttacttggaggccaagtcatagaaaatcttaccatcatttattttaatttaattattgcttatgagaagaatttaatattagaaccatgttgaaactgccatcactaaaatgacttgtgccaaaaaagatttttttgaaaagagcatttgctgaacacattgattaaagagctcagtatttctttgttttcacattgtttttccaaatactataaacagtctatatatttagtaattcttaaaagaaagtacctctccagcattcttagtagttagtatgttcattggtgtttgtccagtatgggttatgtgaatttcttgataatgtagataaaaactatttgtcttttaaaaaagacgctgacagattggcattgtcttggacagagacctctgtgaaattagatttttgagattagctacttgtgttaatttagccgttctatctgtaaatagattaagtgacagttctgttgtacgtgacttggactatgattaaatacatcctatgttacacataagagtgaaagctatttatcacaaagaatgataaatactccaattatttaatgtaattgaaggacatactttaaaagaagagaaaataaattttacttttatgacaagtaaagatttattttgtgaataggaaaggatttaagctacaagaggaaacatttgcagaattaggcagaatgagtcatcatagtaacaccaatacttctgataaaatgggaagagatataaatttattgcaatgcattaattgttttgtttgttgtaaaacttttatgtgcttctgagagttttttcccttttgtataagcccatataatagttaccaataaaacaaagtaagtgttagcagacagatacttgaccgagcttcacaagacaataataaatcaagggttttggtaggagaaatgtttgttaaaaaatgttagctaactataaggttggacttctgtgttcacagttacatgttctaatttatttcaggtctaacaactatatcaaatgtgacagatttctagttgtcgacatgttagacagaaaacatgcagagccttagagaagtcagtaatatagtcttgagtgattcagcacacaatggtagaacaatagcttgccttagcaattacaaacatttcaggggcattatgaactctttttagtgatttttttttttttttaatgtccaaataaacttgtcatactagctcatccctctcttaacactgaccttactaattatgtcaaaggagcatccctctgttgtcaaatatttgccaggttgaccttgtttggaggcgcaatattcccaaaggctgaaccccatgaattgtatatacagtgaaggtaatttaatttatttttttgttttttacatgaatcaatgtttttgattaggatgatcttttaaaagtatacttagaacttagtgtttttaagcactgttacaaaccaaccttcttgatcttactgtggattaatgctgctatagttagccctcttacattaagtagctatcaatttttcttatatttgtagattctcttcaaaatctgtacccagcaatcccttcacttcactgttccaagtttactataaataattattctattcccacatgaaattcttaaacctcttcaagaagtttctcttaaaatgcctgattttctctcttaaaatgcctgtattttttaacgctcttaattttttctcttctggagtaagaatttgcttcttggccagtacaacactaattgagaggtggcagctgggagggagatatggaaggtagggaaaaatgcttatttctgtgcctatctctaattgtgctatcatgttttttgaagtaaatggctccaatatactcatctgtaaaatgggattacattatccatcttgcaggctgttgtaagaattaaattaagttgacttttttttttttttgagatggagtctcgctcttgtcacccaggctggagtgcaatggcatgatctcggctcactgcaacctcctcctcccaggatcaagcgattctgctgccccagcctcccaagtagctgggattacaggcgcccgccaccatgcctgggtaattttttgtatttttagtagagacggggtttcaccatgttggtcaggctggtctcgaactcctgacctcaggtgatccacctgcctcggcctcccaaagttgactttttaaagggtttatcatagtgagtgctggtgcatagtaattgcatagtaaattgtatctgttgtcttccaagttatccaaatggcatgctttgtgattattttttatttcacttctctactcaccacatctaatttattctacttctgtgaaaaagcaaagtaggtaattgtgcaggtgggcaggagacagaattgtttttgaaatccatctctgccattcattagctgtacctcaaacaatttacctaactcttcctaaacctccctttctttgtaaaatagtgatgataataatagtgacttacctcagagtacagctttgagaattacttaattaactgaaagtgtgtatgtgtgtgtttttatgcctatgtataaaatgaatgaatggtaaaatgtttagcattgtgcttgtcataaaataagcttccataaatgtaacatacatagtcgttattattactcttcattcctgatgcccattcagcctgttgtttctacttaactgggtgctttacgctagtggaagccttcaggtcatcactattttctcacaccctaccagcggtctaatattgtgagaagtaaaatttttttttgtccttaaaaaattatttttatctgtattcctaggtattttattctctttgtagtgactgtgaatgggagttcattcatgatttggctctctgcttgtctgttgttggtgtaaaggaatgcttgtgatttttgcacattgattttgtatcctgatactttgctgaaattgcttatcagcttgagttttggtgctgggatgatggggttttctaaatataaagtcatgtcatcttcagacagagacaaattgatttcttctcttcctgcttgaatcccctttgtttctttctcttgcctgattgccctgcagaacttccaatactatgttgaataggagtggtgagagggcatccttatcttgttgtcttgtactggttttcaaagggaacacttccagcttttgcccattcaatatgatgttggctgtgggtttgtcataaatagctgttattattttgagatatattccatcaatacagtttattgagagtttttaacatgaagcgatgttgaattttatcaaaggccttttctgagtctattgagataatcatgtggtttttgtcactgattctgtttatgtgatggattatgttgaaccagccttacatcccagggatgaagccaacttratcatggtggagaagttttttggtgtgctgctggatttggtttgccagtattttattgaggattttagcatcgatgttcatcagggatattggcctgaagttttcttttctctgccctgttttgatatcaggatgatgctggcttcataaaatgagttagggaggagtcccaacttttcaattgtttataatagtttcagaaggaatggtaccagctcctatttatacctctggtagagtttgactgtgaacccatctggtcctgggcttcttttggttggtaggctattaattactgcctcaatttcagaggcagttggtctgttcagggactcgacttcttcctggtttastcttgggaggtgtgtgtgtgtgtgtgtgtgtgtgtgtgtgtgtgtgtgtccaggaatttatccatttcttctacattttctagtttatttgtgtagaggtgtttatagtattttctgatggtagtttgtatttctgggggatcactatatgagatcagagaccatatctactttggcccactgttgtatttctagtttttagaacaatgctgtggatatattagggctgtcctcattgtttgagaataaaatttgacaaagatggaacaaggcaaaaaagtgagagaagacatgagacatcttggcatgtttgacaatttcacatattctgtatggctagaaaatacgttgtaaaattcatttttgagagtagtgggagataatgttgaaaagaaatgcaaaggccagaatatgaagaatattacccattatgcctagaagtttagactctatcctgtagctttggagagccattgagggggtttaaatgcagatgtgacatgctaaagttttatgtaagatagtatagcctgttaacagtgtagtaagaaaaatcagaagtgagattagaggaattggtatcaattgtgggcctatttcaatagtaaagcatgggaatatgggggcctaaattaaagtgggggtggaaatattcaagacatggtaaaatcaacaggatttggtaaccagttgggtttggagtatatgggagagtgagaagataggatgaactctgagttctgcttagcattcaaagatcaattgaattgtaccctcctccagtttagtccatcttgccactgactggaataaatgtctggtttttgactccttatggaatgctatgtatatctttcttacattgctgattttttttttaactaggcttatagctgtttgtttgcatgtctaaagtccctcacaagactggaaggcctataatgtaatatctacctgttatcatctcttctacactgaatgctcaataaatatacagatgattaattaatgcctaacattttaaattacctcctgaaaaaaaaatctatatagttcagcatgtgcttggcacatttcagtactccaaaatgaaactagttgcaaataggtgaagtttaactaaaattttttcaaaagcacttcaattctaaaaattcaaattagcaattgccagaaaagattcataggatgaagttttaaagtgaagtcaggccatattgtttccaaactaagatgggaacttactattaaaaatattctgcagattgaaaatgactaagcaacattaggaaaatgaaattttaagatctgccctcatactgttatggctaaaaatgttttcatgttcattttcgacagtgttgttacagtgtgaaaatttcaatgattagaatgattggattaaaaaaaaaattatctagtctctgcaagatgatcttgggcaaatgccttgatttctgtcaatctccaactccagagaggagtctgagatgagtcttaaaggatatcaaatttgaaaggtatgaaagtatagagctatgtattctttagaaaggtggaacagtatgtacaataaaggaattaaatgtgcattatttccatgggtcctgattgctctaaccacctatgagtctatgattttaaaaatcatttttaaatttcaaaatcaaattggaatctataacctgtcagtaagtcagtcttcatcagtaactggtacagataataggtggacatttatactaaatcatatacaaaataattatctttcttggagacttaattagcaggtttgaattaaaagacttaaaaaattaggttggtagaacactggttgtttttaactgtattggaggaatccttgtataggaacaatgtttccatatgtatctatcttcatattaagaaagagaaaactttttgaagaaacawttgtttttatttcaatgtgattatgtaatttcagtggggaagtttacaacatgatgtggaaaggacataggatctacattttactattagctttgccccaactagcgaccaggtaacctctccaggccttggtttcctcataagtaaaaggagggattggaatagtctgttatgtccctttgacctgtgaaatgtggtgtctgtgtctgtccatatttgaagaacattggggataaaatgacatttagttgtatttgattaaaaagaactagcctaaaataagaaaagcttgttttctcatttcaaatgtaaaggagagtgattagcaaataaaaacatggtgcaaaagagttaataacagatcattatttgtgttctaggagagatctattcattaatgaatcarttggcaatattaggaatacattgatgttaaatgactctaaaaagttggacatcttgagctgaattataactactttatatggtcctgtggtaatgagtcttatattttgaagaatgtttctagactcaaatgcacaaatgaaaattgctacctttaacatagttaccttgggaggctgagctcctttattcatatcacattacttagcacctactgttttgcactgatgctgccacattaagttggaggtaaagttgggggattgtagaaatcaagaatcattttcctcaaatgctggtttgtatattttctactttaattcactttcattttgattctgaaccccaattatgtcttacattttttgttctttctatcactcttgccttttcttcctctttctctcttcagaaagagcagagaatttagtgttggcgagacctagtttagaattcacttcccctaacttactagtaataggatyttaatcaagtcacattttctctctgcacctgagttttcctttttttttttttttttttttttktgtaaaaagggatataatgccagttgtctaattccctcacggagcatttgttagaccaagtaggaaaacatcgatgcttggtaaaccataaagcaataagcagatacagacttcatgacttaataagacacagagaggtatgtgaaagaacccaggttttaagcccagattcatctctattcaattcctgcatttgccacttactagtttagtgcagtcttagtttgtaaaatgtgtatataacatctaatgacatctccttcatgattgtaatgatgatataaggtaatctttataaatctctgtaagataaatagaggtactttttattcccatttattcttagatgaaacaattgaggcttaaagaattcaagtgatttctttacgattatacaggttgtcagtgaaataaccagaataaacttagtattaaaatgtgagttttgtttatagataaattatatcaggtaatttcaaagaagttccatgtgtctttggagcacaaaatatacatttaaaatgtatgtatagatgagatccatagaagggttactttgaaacattcagatttatttgttcctgtgcatttctttgttaaccacaaaaattgaccagttgctatatttatttatttatttttatttaatttttattttattatactttaagttttagggtacatgtgcacaatgtgcaggttagttacatatgtatacatgtgccatgctggtgtgctgcacgcattaactcgtcatttagtattaggtatatctcctaatgctatccctcccccctccccctaccccacaacagtccccagagtgtgatgttccccttcctgtgtccatgtgttctccttgttcaattcccacctatgggtgagactatgcagtgtttgtttttttgttcttgcaatagtttactgagaatgataatttccaatttcatccatgtccctacaaaggacatgaactcatctttttttatggctgcatagtattccatggtgtatatgtgccacattttcttaatccagtctatcattgatggacatttgagttggttccaggtctttgctattgtgaatagtgcctcaataaacatacgtgtgcatgtgtctttatagcagcatgatttatcgtcctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgctcatgtccttcgcccactttttgatggggttgtttgtttttttcttgtaaatttgtttgagttcattgtagattctggatattagccctttgtcagatgagtaggttgcaaaaattttctgccattctgtaggttgcctgttcactctgatggtagtttcttttgctgtgcagaagctctttagtttaattagatcccatttgtcaattttggcttttgttgccattgcttttggtgttttagacatgaaatccttasccatgcctatgtcctaaatggtaatgcctaggttttcttctagggtttttatggttttagstctaacrtttaartctttaatccatcttgaattaatttttgtataagatgtaaggaagggatccagtttcagctttctgcatgtggctagccagttttcccagcaccatttattaaatggggaatcctttccccatttcttgtttttgtcaggtttgtcaaagatcagatggttgtagatgtatggtattatttctgagggctctgttctgttccattggtctatatctctgttttggtaccagtaccatgctgttttggttactgtagccttgtagtatagtttgaagtcaggtagcgtgatgcctccagttttgttcttttgccttargattgtcttggcaatgcgggctgttttctggttccatatgaactttaaagtagtcttttccaattctgtgaagaaagtcattggtagcttgatggggatggcactgaatctataaattaccttgggcagtatggccattttcatgatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcagttgtgaatgggagttcactcatgatttgtctctctgtttgtctgttattggtgtataagaatgcttgtgatttttgtatattgattttgtatcctgagactttgctgaagttgcttatcagcttaaggagattttgggctgagacgatggggttttctagatatacaatcatgtcatctgcaaacagggacaatttgacttcttcttttcctaattgaataccttttatttccttctcttgcctcattgccctggccagaacttcccacactatattgagtaggagtggtgagagagggcatccgtgtcttgtgccagttttcaaagggaatgcttccagtttttgcacattcagtatgatattggctgtggggttgtcatagatagctcttattattttgagatacgtcccatcaatacctaatttattgagagtttttagcatgaagggctgttgaattttgtcaaaggccttttctgcatgtattgagataatcatgtggtttttgtctttggttctgtttatatgctggattacatttattgatttgcatatgttgaaccagccttgcatcccagggatgaagcccacttgatcatggtggataagctttttgatgtgctgctggattgggcttgccagtattttattgaggatttttgcatcagggttcatcaaggatattggtctaaaattctctttttttgttgtgtctctgcccggctttggtgtcaggatgatgctggcctcataaaatgagttagggaggattccctctttttctatagattgaaatagtttcagaaggaatggtaccaattcctccttgtgcctctggtagaatttggctgtgaatccatctggtcctggaccctttttggatggtaagctattgactgttgccacagtttcagatcctgttattggtcttttcagagattcaacttcttcctggtttagtcttgggagggtgtatgtgtcaaggaatttatccatttcttctaggttttctagtttatttgcatagaggtgtttgtaatattctctgatggtagtttgtatttctgtgggatctgtggtgatatcccctttatcattttttattgcatctatttgattcttctctcatttcttctttattagtcttgctagcagtctatcaattttgttgatcgtttcaaaaaaccagctcctggattcattaattttttgaagggttttttatgtctctatttccttcagttctgctctgattttaattatttcttgccttctgctaacttttgaatgtgtttgctcttgcttttctagttcttttaattgtgatgttagggtgtcagtttttgatctttcctgctttctcttgtgggcatttagtgctataaatttccctctatactctgctttgaatgtgtcccagagattctggtatgttgtgtctttgttgtcgttagtttcaaagaacatctttatttctgccttcatttcgttatgtaccccatagtcattcaggggcaggttgttcagtttccatgtagttgagtggttttgagtgagtttcttaatcctgagttctagtttgattgcactgtggtccgagagacagtttgttataatttctgttcttttacatttgctgaggagagctttacttccaagtatgtggtcaattttggaataggtgtggtgtggtgctgaaaaaaatgtatattctattgatttggggtggagagttctgtagatgtctattaggtccgctttgtgcagagctgagttcaattcctgagtatccttgttaactttttgtctccttgatctgtctaatgttgactgtggggtgttaaagtctcttattattattcagttgctttttttatttgcaactcctacagattttaaactgtggtcttatgttagtgacctagaagaaggagtaaactaattggctcccttttcaattgtggtgctggttggctcatgaggcctagatgtcactattacatgtgatgaacaatgaatattagaattgtaaaaatgagagttgatggctccaatcacgtattaactcaggacatatgatgggtttcccttctagtttcataaattccatttgtctgccactttttgctttctgtgttacacttgactggtagtaatagattttttttcccctgtggaaactttcttgattgtcagtacatctacaagkgcataatcatgatacattaaaaataatcatgtaaattataatcactcacatttttcagaatattgctaatgatgatgatttttctttaaatattgattgggactttcttgtctcagaataagggtaattgtatctaaattgttttatttaatctacttttagtttaaatctatagttacagcaaggctaggtattgatcccatgacaaggaagtagtttatggttttgccttggaaaaaattctttggttaaattatgttgaacttcttaaaattttcaaattgatgtaatgcatagtggaagatttttgccaattcatcgatgtgtaaaataagtgactggcaaaggaaattatttgatcttgagatttaagtgtttctataaataaaaagatattgtttaaaatggtaaaaatatatttagccatgccttttatggtgatagtgatagaagtacaaagttaagtcacactacaacatttgtgttaaaaagcattgcttgtacattttcaccacatttacatctttttatattttatgtccatcctccaattttgatcagacgatttcctccatgttattctttcagtagcaggctaacttttatgaggacttgatcagcggatgggacttagcatggtagatacgagccaaaaaatcaaagcataattgcatgcccaatttctgaccactgtccctgaaataagtggaaacattcagagcatggaaatatattcaaatccatgacaggaatttcccttgttatgtactatgcacatgaactttaagaaaattgtatgtttagatatttttaaatctagccagtagacttatgttgtcattgtagtcaatattattagagtaattgttttattttcataacaccaatgaagtttactgaaaggtcccattaaactaagagcataactttgagggaatatgtggagaatgtcttgacttgcaaactagttacaatcaactaacttgtacacacatatgtttcttatgatccaggtctggttgcttgctcaactgtgacgtgactattctctttagagtgtggccaaataaaatagccaagaaatagattcagattcaattaaccatactgtatatctggaatgagccaagcattgagtgatttgtacttaagtacatcctatcatgttgtcctggcaaaattattactggcaaatgtttcactcttaaaaatgttttgatttacatgagaaatgatatgttaccttaacaattaggcaggtggtgatggtatcttcttttcttcttcattttttttttaaccgctgaagacactggaattttgcgactttaagtaactatcccaaagacatagatactttgtgtcaaacctagagtttaccctaggtattttgacttgaaaagcatttttttttcttctcagttcatatttgttattttattattacagatacaatctgtaagtttgtcagttttccagattttatctgatttgtcctgtgcttatttattattagggatgtttattctctctctctgtctttctgttcttgagtatcattttcatagaaagctttaagagaaattgagataaaatgagccacactaattgtaagccatctctaaatgagaaattattgaaaatgttattaccagctrgatgctgggaagtgttaaagagctgggggcacaacagtgtgaccagtttgaccttatagagagaaatataaatttgtcttgaattagccagtctgtgttagaggttattttactgatagtctgatcagttcttttagacttatcactcataattgagccaratctcacatgtaacaaattcaactataggcacaacgattgtaattattttcctatttactgtcaagtctgaaaatcattgtgtgcttctagaaattgagatagttgtcaagaataagttttgtttatgctaagttgtaattttctttttctgtgtttgctagatttttctagatatgacatttggttcgggagggcacacaaaagccattctgcagaaggagtcagatattgttctctatgccttggacagagacccaacagcttatgcattagctgaacatctttcagagttgtatccgtaagtaatacccttgcatatttatttgattttggttcttagttttacagagcttggtttaccaccttggaatttgttctgctttgcatgggctatattttactccagtaaatattttcttcttttttccccaaaaagaattaatgtaagtgatgtttttagtaccacttaaagtaatgctattttccagttatcctttctgaatccataaaaagaaatacaaaatgtcttccacctacaagattgaaagtgttttggaatccatccacaaaaaatgagttttgacaataactcatagtcaaaaaataatttttaaacatttttatgagtttatttctaagaatttagcagagtaaataagtatgtgagaattctgtagaactcatgaggacatatacatcaacataatatacttgtttcctttgaattttctgaaattcacaagtaaatctagagtgatccatccttctatcagaaaaagtgatgtataactaaagaactttttaaaaatataaaatattatatgaatgagtggtaaaaccatctgcctttaaagaaacattttgaattagggagtagacatggtatgttgtttaaagccatcattttaaaagagaaaaatatcttggagctaagatggctctctccaaatacataaagggctgttttcaggaatgggaaattgttttattctgtcattcatcagagactggagtcaagaaaatagatgggaacttgagaggtaattttgacttgatgtgaactgtagttcacatcaaaagttgaagttttgacttgatgtggactagagtttttactagttgtagctattcaacaacaaaatggtctctttggtgaagttcgaaaagtatgaccatggaaaagtttaatcagacactaagaataggaagtgtaattcgtcatctagaatagtatttacagcctctttctggtcccaaactctttgcaaatctaatgaatgtgattaactctccccataaaactataaataaatacacatargcttttgtttacaagatcataggatttatggagtccctgaaacctaccatttgaccgcagattatttcatttcttccgagaataatatgaagacgtgatttaatgacatggtactaatttttaatattttaaatctatctgtcttctgcagtgtaacttagatgcgccttctttaagaagatgttttattagagcattcatatttgcgaaacgttgtatgagttcacttggttatgatgtgaacattcatgaagtataggcctcttttatacagcagtccctttgtacctgaggagaagtggataccaaaatccatggatgctcaattcccttacataaaatggttcagtatgtgcatataacctacacacatcctcccatatagtttaaatcatctctaagtttcttacctaatacaaagtaaatgctgtttaaacagttgttatactttattgtttagggaatagtgacaagaagaaaaaagttttgtacatgtctaatacagatgcacgtgtctttttttatgatctgcagttagttgaatcaattgatgtggaatccacagataaggagggccagtcatactttactgtcatagaaaaactgaattctcgtaagatattgttgtttcttaaggcaatgattcccaatccaatgatttcagtggctcttattcctttaaacaccacactttctcaaatgtagcttaaagtttacaaattttaccatgtgtaatttttttttaacctaacaggaactatcaggctgtatattcttttcagtttatagatgtggaaactattagccagatagatgaagtgatttgctaaaaggcataaacgactttatggggacagacctgcgacatgtattccaatctctagcctcattttattaaatattactgccttggctcaaatcttgagactttttttacttcactgacaaaatgatttctttgtcaaacataataaattagataagaacaaggaaacaaatcagagtaagccaagaagaaggaattagtacagataaaagctagaatcaaggaaagtataaacaaaaaaagaagaaaaaaattgaaaggataaagagatcacaagagatcagtctttgaaaatagcaaaatcacttttgaacctgatttctagagacaaaaagtgtgattaagattcagagggaagaccaaccatagacacaagataagttcatcataagataataaaactgcaattctctggtaacttgcaaaacctagatgaaatgaatgatatcctaataaaatataaattattaaaacttgattaatagttacaaaatttgaatgtcattaccgtaatagaaattagaaggtaactgaccctgaccaaatggatttgcagttatctaattcttaaaaaaaaaaaaaaaaataggaaaaagcaatgcctttttttctttttttttttttttgagacggagtctagctctttcacccaggccggactgcagtggcgctatctcggctcactgcaaggtccgcctcccgggttcacactattctcctgcctcagcctcccgagtagctgggactataggcgcttgtcaccgtgcctggctaattttttgtatttttagtagagacggggtttcaccgtgttagccaagatggtctcgatctcctgacctcatgatccgcccgcctcggcctcccaaagtgctgggattacaggtgtgagccaccacgcccggccaaagcaatgccttttacactaatcctgaccatggtaaatttggaaagttatttcagttaacattatgaatttagcatgattttaatacccatctttttttttattggagacaagttttcactctgttgcccaggctggagtgcagtgatgccatcatagcttactgcagcctctgcttcctgggctcaagtgacccttctgcctcagcctctcaagtagctgggactacaggtatgcacctgtctaattttttatttttagtagagatgaggtctctctatgttgcccaggctggtcttgaactcctgagctcaagtgatcatcccacctcagcctcccacaggactgggattataggcatgagccaccatgcctggcctaataccaaatcttgatagagatagtataaaaaggaaaaaggtctaagtttgctgaagtatagaaatacaaaaattgaaaaggaaatactagtatatctaatttacctgttatttaattaaaacagtaatacccgtggcctaatgaagtttatttcatgaagatgagatgttccgtgtcaggtagttaatcaatgataggttgataagcatgacaataatcagctagctattcttatttaaatttctgttaaatataaggaaactacttaaatgtaaaatattctcaatcaaggacaagcagtaattattttcctaaaatgtgaagtactgtaactatttaagacaaaattaggatgtaaataggatttttctataaatagtatttctcaatattttttgaaggtctgacaaaggctaaagcaaggttagaatattctttttataatgatctactgaatagttaaaaactccaaatacttataaaattagtaagatgataagatgtttagctaaaaatttaaaactctattcagaatagaagaactctagggacaacaaggaagtaagccctttcctttccagcataagggtcacagctgatacccctataacaaagagaggttgacaagagaaaagaataacaaatttatttgacatagttttacatggcataggagccttcagaaagaagatgcaaagatatagagagaactatccattttttatgcttaaattcaataaagtatggagagcatgtagaactatgattggacaaaaaggatatatggtctaatgctaactgactgagttgggggaactcaataaggcctctctatgcaacattcctttttgctgggtgtgaaggtaggacccctgtgaatgagggtcttaatttctttatggccatttattctattacacagaaagaagtgggggaagttagattaatattttaggctttgaagctggctttggagaaaaaaggttctggtttctataggggaggttagagtaatattttaggctttaaagctggctttggaggaaaggggttctggtttctatgacccacgttggagaagagggaatctagtgtggctcgcctctgaggagaatgagagacagcagggaaagaggtggtcagaaggtaactttgcttctaagtctgcttcttaggccttcacttggggctattgttttctgagccccaacagtacctagaaagggaaatgggaaaaaatattctattcacaacagctcctaaaattgtataaaatatttagtaataaatttaacaaagagcacacttccaagttaaagaaaactataatgtttttgaagggcatacaagaagatttgaacaaaagggaagacatatttcttttgaggtagagagaattaatattataaaaagaggatggaacgaagaggatcatacctgcaacctcaccactttgtgaggccaaagcaggaggatctcttgagctcaggagttaggagaccagtcctggcaacatagtgagacaccgtttcttacagagaaatggtggtgtgcacctgtagtcccaggtactcaggaggctgtggtggtactcaggaggttgagattgcagtgagctgtagtcatgacattgtgctccaaccttggtgacagagcaagatcctgtctcaagatgggtggatggatggatgcatgcatggaaggatagacagatcagaaagaatacaaatgaaaagagttaatgctccctaaattaatatatacatgtattgtacatgtaaattactttgttttttagatttggatgatgtgatccttagtttgtatggggcaaaaagtgacaagatgttttttgaattaaaaagtaagaggaaacctgccttactagatataagattacactataaaatcactgtaatgaatcaatacaatattgatacaagaataggcaagtggattaatggaggaaataatccaaaaattgattctgctaaataaaggcatttaattgaagattaaaatattttaattcattgagaaaatggtggataattaaaaaatgatgctgttacaatgcctgtcagacttgaagaaagtaaaatagacccatttcaaaatttggattcaagaataacttctagatggtgtgaaaaaattgtgaaaatttgaatatacaagttctatgagaaaattggagagactatatacacaatctagtagtgagaaacttcttttttttattatactttaaattttagggtacatgtgcacaacatgcagatttattacatatgtatacatgtgccatgttgctgtgctgcacccattagctcatcatttacattaggtatatctccaaatgctatccctcccccctccccccaccccacaacaggccccagtgtatgctattccccttcctgtgtccaagtgttctcattgttcaactccaacctatgagtgagaacatgcggtgtttggttttctgtccttgcgatagtttgctgagaatgatggtttccagcctcatccatgtccctacaaaggacatgaactcatctttttttatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatccttagggtatatacccagtaatgggctggctgggtcaaatggtatttctaattctagatccctgaggaatcgccacactgacttccataacggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttttacatgtgtcttttggctgcataaatgtcttcttttgagaagtgtctgttcgtatcctttgcccacttgttgaaggggttgtttttttcttgtaaatttgttggagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttcccattgcttttggtgttttagatatgaaatccttacccatgcctatgtcctgaatggtattgcctaggttttcttctagggtttttatggttttaggtctaccatttaagtctttaatccatttggaattaatttttgtaggaggtgtaaggaagggwtccagtttcagctttctacatatggctagccagttttcccagcaccatttattaaatagggaatcctttctccatttcttgtttttgtcaggtttgtcaaagatcagatagttgtagatatgcggcattttttctgagggctctattcggttcctttggtctatatctctgttttggtaccagtaccatgctgttttggttactgtagccttgtagtgtagtttgaagtcaggtagcttgatgctaccagctttgttcttttggcttagcgtgacttggcgatgtgggctcttttttggttccatatgaacttcaaagtagttttttcctattccgagaagaaagtcattggtagcttgatggggatggcattgaatctataaattaccttggatagtgtggccattttcactatattgattcttcctacccatgagcatggaatgttcttccacatgtttgtatcctcttttatttccttgagccgtggtttgtagttgtcctggaagaagtgcttcacatcccttgtaagttggattcctaggtgtgttattctctttgaagcaattgtgaatgggagttcactcatgatttggctctgtgtttgtctgttgttggtgtataagaatgcttgtgatttttgtacattgattttgtatcctgagactttgctgaagttgcttatcagcttaaagagattttgggctgagacgatggggttttctagatatacaatcatgtcatctgcaaacaggaacaatttgacttcctgttttcctaattgaataccctttatttccttctcctgcctgattgccctggccagaacttccaacactgtgttgaataggagtagtgagagagggcgtccgtgtcttgtgccagttttcaaagggaatgcttccagtttttgcacattcagtatgatattggctgtggggttgtcataaatagctcttattattttgagatacgtcccatcaatacctaatttattgagagtttttagcatgcagggctgttgaattttttcaaaggccttttctgcatgtattgagataatcatgtggtttttgtcgttggttctgtttatatgctggaatacgtttattgatttgcgtatattgaagcagccttgcatcccagggatgaagcccacttgatcatggtggataagctctttgatgtgttgctggattcggtttgccagtatgttattgaggatttttgcatcgatgttcatcagggatattgttctaaaattctctttttttgttgtgtctctgcccggctttggtatcaggatgatgctggcctcataaaatgagttagggaggattccctctttttctattgattggaatagttttcgaaggaatggtaccaacttctccttgtacctctggtagaattaggctgtgagtctgtctggtcctggactttttttggttggtaagctattaattattgcctcaatttcagagcctgttattggtctattcagagattcaacttcttcctggtttagtcttgggaggctgtgtgtgatgaggaatttatccatttcttctagattttctagtttagttgtgtagaggtgtttatagtattctgtgatggtagtttgtatttctgtgggatcggtggtgatatcccctttatcattttttattgcatctatttgattcttctctcttttcttctttattagtcttgctagcagtctatcaattttgttgaccttttcacaaaaccagctccttgatttattgatttttttgaaggtttttttatgtctctaactccttcagttctgctctgatgttagttatttcttgccttctgctagcttttgaatgtgtgtgctcttgcttctctagttcttttaattgtgatgttagggtgtgaatttcagatctttcctgctttctcttgtgggcatttagtgctataaatttccctctacacactgctttaaatgtgtcccatagattctggtatgttgtttctttgttctcgttggtttcaaagaacatctttatttctgccttcatttagttatgtacccagtagtcgttcaggagcaggttgttcagtttccatgtagttgagtggttttgagtgagtttcttaatcctgatttctaggttgattgcactatggtctgagagacagttcgttataatttctgttctttaacatttgctgatgagtgctttatttccaactatgtggtcaattttggaataagtgcgatgtggtgctgagaagaatgtatattctgttgatttggggtagagagttctgtagatgtctgttaggtccgctttgtgcagagctgagttcaattcctgtatatcttttttaactttctktcttgttgatctgtctaatgttgacagtggggtgttaaagtctgccattattgttgtgtgggaatcgaagtctctttgtaggtctctgaggacttgctttatgaatctgggtgctcctgtattgggtgcatatatatttaggatagttagctcttcttgttgaattgatcactttaccattatgtaatgggcttctttgtctcttttgatctttgttggtttaaagtgtgttttatcagagacttggattgcaactcctgcctttttttgttttccatttgcttggtagatcttcctccattcctttattttgagcctatgtgtgtctctgcacatgagatgggtttcctgaatacagcacactgatgagtcttgactctttatccaatttgccagtatgtgtcttttaattggagcatttagcccattgacatttaaggttaatattgttatgtgtgaatttgatcccgtcattatgatgttagttggttatttggcccgttagttgatgaagtttcttcctagcctcgatggtctttacaatttggcatgtttttgcagtggctggtaccggttgttcgtttccatgtttagtgcttccttcaggagctcttgtagggcagggctggtggtgacagaatctctcagtatttgcttgtctgtaaagtatcttatttctccttcactcacgaagcttagtttggctggatatgaaattctggattgaaaattgttttctttaagaatgttgaatattggcccccactctcttctggcttgtagagttttgcggagagatcaactgttagtctgatgggcttccctttgtgggtaaccggacctttctctctggctgcccttaacattttttccttcatttcaactttggtgaatctgacagttatgtgtcttggagttgctattctcgtggagtatctttgtggtgttctctgtgtttcctgcatttgaatgttggcctaccttgctagattgaggaagttctcctggatagtatcctgcagastgttttccaacttggttccattctccccatcactttcaggtacaccaatcagatgtagatttggtcttttcacatagtcccatakttcttggaggctttgttcatttctttttattcttttttctctaaatttctcttctcgcttcatttcattcatttgatcttccatcactgataccctttgatccagttgatcgaatcggctactgaagcttgtgcattcgttacgcagttctcgtgccatggttttcagctccatcaggttctttaaggacttgtctgcattggttattctagttaaccattcatctaattttttttcaaggtttttaacttctttgccatgggtttgtacttcctcctttagctcggagaagtttgatcgtctgaagccttcttctctcaacttgtcaaagtcattctctgttttccgttggtggtgaggagctgtgttcccttggaggaggagaggcactcttatttttagaatttccagtttttctgctctgttttttccccatctttatggttttatctacctttcgtctttgatgatggtgatgtacagatggggttttggtgtggatgtcctttctgtttgttagttttccttctaacagtcaggaccctcagctgcacatctgctggagtttgctggaggtccactccagaccctgtttgcctgggtatcagcagaggtggctgtagaacagcaaatattggtgaacagcaaatgttgctgcctgatygttcctctggaagttttgtctcagaggggtacctggccgtgtgaggtgttagtctgcctctactgggggatgccttccagttaggctactgaggggtcagggacccacttgaggaggcagtctgtctgttctcagatctcaagctgcatgctgggagaaccactactgtcttccaagctgtcagacagggatatttaagtctgcagaggtttctgctgccttttgtttagctatgccctgcctccagaggtggagcctacagaggcaggcaggcctccttgagctgcggtgggcttcacccagtttgagcttcccagctgctttgtttacctgctgaagcctcagcaatgggcgggcgcccctcccccagcctggctgctcccttgccgtttgatctcagactgctgtgctagcaatgagtgaggctccgtgggcataggaccctcctagccatgcccaggatataatctcctggtgtgctgtttgctaagaccgtcagaaaagcgcagtattagggtgggagtaacccgattttccaggtgccgtctgtcacccttttcattggctaggaaagggaattccctgaccccttgcacttctggggtgaggcgatgcctcgccctgctttggctcacgcttggtgtgcttcatccactgtcctgcacccactgtcctacaatccccagtgagatgaacctggtacctcagttggaagtgcagaaatcatccatcttctgctttgctcatgctgggtgctgtagactggacctgttcctattcggccatcttggaaccaccctctgagaaacttctttagactagaaatcataaatctataaaataaatatgattatgtaattttaaaaaacctatggcaagactagtttggtaatttctaacagcaaatttgaaaaataaatgttagtaatatagaagataggaaaaagattgatatctactatataggataagttcttacaaaactagagagaagacaacaaaacatacagaagggtgattcatagaagattaaactgtgaaaagatgctccaattcagtagcaataatgagggcaatcaaaataataatggtataatactgaaaaacataattttgctagtgaggatgtgcagaaaaggatactttcatctattttgggtggacatcttttaatataaaacacataatcttcttagaatcttttccatctaagtaaaagaatatctaaggaaacatgtttttacatttcctacaaactttatatatacatcgcttgtgtatatataatcatggaaaacttgaaaaagacaggattaacaatggagggaggttcagggaaagataaaacaatgactaagaaaaacccagagattttatgtttacatctctgcatatttatgcaaaatagaaaattcagagttatatataatttattaatatccacatatgtagtaataaaatgaagtatgcatgagaaagaaaaacacaaatttgtgtttgggagtatttgtggcaataatggatcgatcaatggatagttggttgaaaggatgcatagatagattacatatcttcttaaaaatatttatgtaattgcaacctgtagtagggcacagaatgaaacagtttgtcattttagagtaaacaccttttgaagaaacatagtaatttttttcttttatttattttgctgttattctaaaagaggagttaagtttctcttaaaaaatcccatgtcctttactctgtcaaaactaagtcagaaatagaaactaacatttttacagaaaactgagcaattcatgggaaggctgagttttaggctaacccattttagctctttcagaaaagatgacatgtcagatcacctgttgtttgaagactgaaactttttgctgttgcctctgaagactgtataagaggaaacacatttaacttgcagcaatgaggtgttggttgactttttaacgtagtggaagatggatattggaagacaattttaaaaatcaaagttttttatcttctgaattttggaataatacatactatgtatactaagtttagagaatataggtatgtataaagaaaataaaaatcattccatcattttactataattttgtttctaaaaatataataaactgttattttcaacattttataaaagaagatatgcatactggggtaaatttataatatgaaagtataaactcacccataattttaccactttaggtaatcggggttagtgattttacgtttttcatttcatctttctaattgtcagtgtttcattatgtatactctttcctgtttgaatttttttttggacactttcactttttgtacttctaaaatgttagaatatcatggcaaagtttaaaatccattttggttaattgtattaaatgcataactgcattttaaagaattgacatctttattctgtatcccaatccagaagcctgatatatctttccacttattctggtattttgtgtttcttagtgaaattttttcttaattaaaattaaaaaatgcaggaaagtactgagaaaaaattaaaataattcatagaactaacaccaacgtaaacaggttggaatatttccttctaattactttggttatctatgcatatatgttcatatatgatacatggatgtatattttcctaagtggattctacttatatattatcagcacattcctctttcattagattgttttaaaacacacgattttattggttgtagggtatttttatcgtataattataacaatttattagaaccctaattcttatatactcttatctatattcatattgttgatgatttaataaatagcgaatatctgatgcgttttgcataaacaaatctgagtgtgttttctataaaagggtaattatatccggatacattggtgttatctttttctgtatttttaatttttgtgttttattgaacttttataatttcttatgtccattatatatatttgattttgcctcttcactatttgattttgcgtcttcactagtgatttagtgacactaatcacttttatttttttaatttattcatcactgactttagtattttttaagataaaaagtatttaaacacttttttaagtatgtttttaaaataatatttattgattaaccaccatcatgtaaggtgataaagtaatactcctttatttgtattttttcttctgctatcttacttcttggctctttaaattctatcttgggatttagatattagtgtctactcttatgataactattagcatttacagttttggctgtattatctaaaataatactttatagtttggccattttaatttatttcaatgggcctactagcctttttataatattttcaattccattttgcgttccttatgtgggttcatgtctcagtcaattgattacgtctttaagtagtttatctttaagataaatatgcagaaaggatacatctgaggttttgtttacctgagaaaacagtgtttctcatgccttcttacatttgcaataacttgatagagtatagaattcggggaattttatagatatcactcattttcttctggttgtagtattgtggagaagtctgaggtcaacccagtttttttttttcttttttatttctgtttcttggaaatctatttctcacttgttcttttcaccccctggctggatgcttattcgatacagttctttgaaaacgtttgatatttataaattgtactaaaaaatattactggttggtcacttttagttaattttctgtatactccatgaacaatttttgtcctgtggatcaggtctttcatctacaaagatgactttttgttttagtaacctctctacccttatttctattttctaccctatgagccctcattatttgttggttagatgtgtattatctgtcctgcatgtctttgatttaatctgttagtgttttcagctattttcactttactgcagtattctgcaaaatctctttgagattattctctgggttaaggattttattttctacagtgttgtttatggtttttattgtcaatattgttcaagttttaattcagctaattagaagttatcttttcttatataatattttcttatttaatttgttgactttctcctttctgccaaatcctttttatttcttcttctcttaccatttcatttctatattttatttgtgaacagagtatatacatcaagcaataggttccttctggtgctgtcttgtgtctctgaggcagtgggtgtgagtggaacattcttaacctttttcctaactcactccactgccttgaatcagggttcagatttacatttggtaagaaggggtaggttttctgtattctgccatatccttggggactatttttagtgatttatacaatttgaacttccattgttttgtttgttttcagaaaagattaaacaaacaaattatattactgtggagcaaaaagagggaagccagctaacatagtaatataattagagagttacaaaaatattttttcatatgatataatatattctgaactacccacatgatctaagttgtgtagacttattttctagcacttgaagtttatcattttccttctctttattttaagctgccatttttaatttttggccaaatttacacaggaagccagagcaatggcaagtctcgaactcatagcgtcaggtttgctgcttgtattccttctacaccactacaatattattcaagaagcaatttagtcacattgttgaacagagtcaagactgaaacccaagcattttgaccctaaggccagtgtaaaaatcttataaaagaatacatgctcttaaacagccctatctacctaaaatttagacttttaggattagatatgagacacagttgttactaatcttactaaccatgggaggtcagttctgtcatacactgtcaaagtgaaagaattgtcacaaatataaacaagcatgaaaaaagacaacttggaaaaattatctaaaccattttgaactattgatgatgatctgttacctgttcattgtttttggtaacaaaaacattacgaaaataggatattgtattttgccccatttaatattattaaatataaccttcgctcaggagatgttagccttgtaagctgaagctgtttttttgaggaggtaaaacttgactctagtctaccaaacatagttccgaggcttgaggaatatatgtttattccataaacatgtattataccaactacttttcaggcaatctactagttttgacggttccagagggattaagacctatagtctgtgacttcatagagtttacaatgtaagcagaaattagacagaaaacagataattttacaactaattatttaattaaaattgtgatcatggctatgaatgagtagcgtatgatctcaggaatatgatatcaggatctaatctagtttagaacatctaggaagacttccagagtatttgaattcaatttagaacatgaaagatcaatgatwgttagctgggtgaaggagggagggctattctggcaagagagagaattgaagtgttgaaaagagaatattcgaagatctttggcagaaatgagaatggcatattgaaagaactgtaatgtgaatggatgatagaaagggagaggaatgacagagtggtaagttagggctaggctatacaggaacttgttagggattttggacttcaccttaagaacaaagggaaagcaccaaagtttttgaaacagggaactgacatgatcatatttgcacttttaaaagaatagtcttcttgtttctgtgaagaatgagtaggaggagggcaaaattggaaaggattcagtgagatcaattagaaggctaggaattgctgctgtatctgaaagctgaggatagttgggcctagatttttgtttcctgatcattctattagaaattctactttgctttaatgatctctggcttcccgttttaatgatattctaaataattaaaacaatttattccaagataaaagtatgttttgtgtttataggtgaaactgaagttaatattgtgacactaaattttgtaagaccctcaagaattcccattcttctgacttagccagtataaggaaggagacaaggaataagttcagtcttaccgtgttctcaagtccagcagtatatttttattctcacagaagactttcggtaattacctttttctcagaatctcctcccttgtgtgtaatcagtaaggctttttcatgtctacctcaaggcttatctgctttagtatctgactgctcttttccttcttttccatataactctggaaccagactgctgagctttttcttttaacttcagctctgctatttactcactataaaactttgaataggttacttaaccactctgctactcagttttctcatctttaaaaatggaaataataacattacatacttcctagaaatgataggattaggcttagaacactgtctagcatatctttttaatgagtcatgaaatcattttgttgggtcctgatcagagtttaatggaatggaataagaatatcatagtacagcatatgaagttaaattaagtattgtttctaatgaaagaattttatgtatacatatatacatatacatatatatgtattgtaagtttctgtgtatatgtgactgcagttaaaccttattgttgatgaagtgtcttgatcaaaattttttgaaaaccaccatgctatttgactacattccacatatattgttcatgttgtatattaaatattcattgaagacaaaaactatgtctaacatgtcatatccctgcttggatatgttatttttaaatttttaattttttgccaaaaactttgcagacttacaaggtatctgaaacttctttatttctagctggttcctccctctttgaactcatctggatctggcttatttcaaatgtccatccccacaggtgagaaagtagtttagattttagaatcaaacagtcttgatttagagtcttagttctgcctctttctagctatgagatttttaggtcaatgacttaatctttctatgtctgtatttttatacctttaaaatgaggtactrttaatacctacctcatgggatgttatgaatattaaataagtttatgcaatttgtttatcataacattgtttaataaatgttagttataattgcttttagaattatcatgtaagataatacatagttatattaattattattgtcattatgctaagattttggaaactttcattggcatacaccaagatgatgattggcagttatttcctgtctttacctgcttggttccttaatatgcacagatagaactgtttaagatttgaggcctgggacactgcattcaacttccctcaccttgcaaagtgctctggcatctgccttttgttatagactttctccccttgtcagtgtaaatactgaaggctatacctgtgcaatgctctgaatattggtgtctcccctaaattcctgtgttgaaacctaatagtattaagaaatgagacctttggggaagtgattaagttatgagtgttctaccctcacaaatggaattaatgctcttataaaagattgcagggagttgctttgtccttctgccatgtgaggacacagcaagaggctcccttttaagcagagaacatgccttcaccagacactgaatctgctggcattttgatcttggacttcccagcctctagaactatgagaaataaatttccgtttcaataaattacccagtctaagatgttttgttgtagcaccctaaatggactgagacagcgtgtcacaattacagacactgctgcactgagctgtattagtgtcttcttttaaccccagacttactttttattgattgtgatttttccatcacttcttggctttagataaaaataactaatatcatacaaatgtcatcaacaaatcagaagttctttcttatctgtcttctattctttgaccctctccttctatattcatatgctgctggctttctggaagctacttttttctcagtaaagaaggtacaaggtttaatttttagccatttcttgttctgaagcctgaaaattctgcaaggctaaaatcttgagtcaccttcattacctttacatttacattcattgttgattatttatttagctcattactgacatgaggagacagaatctgtgtttattttaaataaactctttttttctcttttgacaaatacaaatataagtatagacctatatattataattaacacctctgcatccattcctaagtactattatatatttattcttagaatatttggcttaaaagtttcaaaactgattcatgaaagtcaacgtgtatatttgaaatgcaaatgatatttatattatgataactgagaaaatgaattacctcttcacaaacttgagataatccatttttattgcctacgtcatttgaacatatccatatggtacaggataagaatagcagcttgttcagtacaagaatgactatacctagaaagacttcattttatcttgggtaaataatacatatttagagacatattttattacatatgagaaaattttagtagaacccttcatgtttgggcttctgagttattaaaagagtgaaaacaatagttgtattttctctaaatcgtcaactaattaagtcaaatgagtttgctataattacatgtataatcctcctgttctcgacaccccccatttttgcctgatatttaaagtaaaactgagacaaacagctgctggattggattatctactttagtattttattccttttttcctgagagaatgcaatctaaatttaatgcacaattcaatgtacattttagtgcctgctgtgtatggggaaatagacttggcatggggaatgctcagaagctcaagataaggcctctgtaccacaagataaagctcattgtctaatagatagacaagtaaacctctatgagatcaggtaagtaaatctcctggcagggaaaataccaaacatattctaaattcaaacttaaattatttgaggaatatacattcttattttctctgttagcattgttactcatttaattcaattccagacactgttttggggcagatattaaatcatattctggtattacagctggataaaaaggtcaacataatgccttcttactttatcaggaaagacagataattaagaagtatttatttaagataagtgtcaggacccaaaaacattaaataccaaggcagtatgctttaaatagcatggaataactatgttatttaaataaaataccattacaacaaataattacaagaaggaagagtactcattacataggacacattatggacctttcataggacaaataaaataataagatatcgctgattaagatatcattgatcaagttaagttagctatttaaggaatacttctataaaacaggctttttttcttatggtaaaattcttacagttttcaatggtacaccattactttcataataaagttaaacttttctgcttaccacaggaggccattgaggatatggcctttcttttctctagattcatctcttacaattttacaacagttttttcataccctccttgaaatctaaactactttcacattagctcacaatgttgtgtcatacctctcttcatgtctatgtgctgtttatttacgtagcgttattcatcccacttatgtttcaagacttagcactattttctctgcaaaatcatccagatacttccaatttgatttaaatttttctcttctgttcctcagcacaccttgtgctacctttatccaagcttttcatcattctcttggtttacttccatatattatatgctccttgaagtattgctgtatcttaacagactttatacttttcaaaccctggcatatagtacatactcaatatcatatggatggatggctagatgaataaatgaatggatgatgattttttcattttctatatcaaatgtataaaatagaaattagatataatgggctgagttcatcttaatttgcattttacaatgtaaatagaacctttaaaaatatccagactactctttaaaatatgttataagtctagatctaagttctagagagaattgtggagtaaactgcagattcacttcctcagtaaatatttatgtaaaaatgttaagtgataaaccctgattagatataccatatcctatcttccagtgggctcaaaatccttattactagcttttactatggagaaaatagttttcactactatttccacttgcagtcctgtgccaagggaatctatatgggaattatatatattatcactagaaaaagatgcttagatactctatattataaataaactttatttttgaataatgctagtctgtgttcactgaatctaaaaaattcatgtttggcatgcgaactcctatgcataaaaattttttctttgaaagaaaaagtatactatataatagtaagttattaaataataattaaagatattataattcatgcaataatttaaaaagtactttttatatgaacacgtttatttattttgtgtcttctagcatttttcatatcagcaagtatattaaaaggaacatattgtgtgcaatgtgtaggcccagcataggattctctatactaaaattttgcaatgatactggttaattgctagatttcaggcacctttctaacctccgttttagtgggcgtgaaagggtttatttgtaagagatattgctgctgacagaattttatctttttctcctggaatctcaacagctactcccatgttataggcatccccagaaagctcgtcaaaggatttccacccacactctgaatatctaacagggcttgacccattttttttctcttattaatatagcagcatacacatcatgaagaaagatagaataaggactagtctaagcttggaatttcaaaaagttatctacctgtatgcaaggaattgaagcggacaacaaaattagcctttattttttttaaattatgcccttaacaatcttatcacattaaggaatcacatctaatttcatgaatatagttttattttgagtggcttaaaatgtacatttgtattcttaaatgcagtgactataaatgccaaaaatagagtgcactataaatcaagaattctcctttgtactcaattgttaggacataatatactgcttaataacatagataataattaaaagaagactaaagctttgtgtagtaatcctagtagaatcctttggaagtaatcaggatagttataagacagaatatgaaaatacatgtttaaagtaattttcttgtataaatgattacatttttttgtttatgtaaaccattagctttttttgttttccttatgtaacatctaaatactcatatatagactgtggctaattttttttttaacttaaaggataaaagtccctctggaatacamcactgcattcagttttccctcttaactctctattgttgggcaagttactccaagcctcagtcacctcatcttccttatrgtgagtgaggtataagtgataaaataataattattgaaataaatgctaattattgttaccataacagttgtttctcctgcttttattaatttggagtcagtcactcagctaacatccaagtataaatacatgagtggtgaggaatacttctcctttgtagttatgccatcagttgtctatattcactgttttgaattcctctgactccattctttctttttttttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccctaccccacaacagtccccagagtgtgatgttccccttactgtgtccatgtgttctcattgttcagttcccacctatgagtgagaatatatggtgtttggttttttgtccttgcgatagtttactgagaatgataatttccaatttcatgcatgtccctacaaaggacatgaactcatcatttttaatggcagcgtagtattccatggtgtatatgtgccacattttcttaatccactctatcattgttggacatttgggttggttccaggtctttgctattgtgaatagtgctgcaataaacatacatgtgcatgtgtctttatagcagcatgatttatagtcctttgggtatatacccagtaatgggatggctggctcaaatggtatttctagttctagatccctgaggaatcgccacactgacttccaaaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttttctgatggccagtgatgatgagcattttttcatgtgtcttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaaatctttaatccatcttgaattaatttttgtataagatgtaaggaagggatccagtttcagctttctacatgtggctagccagttttcccagcaccatttattaaatagggactcctttctccatttcttgtttttgtcaggtttgtcaaatatcagatagttgtagatatgaggcgttatttctgaggggtctgttctgttccattgatctatatctctgttttggtaccagtaccatgctgttttggttactgtagccttgtagtatagtttgaagtcaggtagcgtgatgcctccagctttgttcttgtggcttaggattgacttggcgatgcgggctcttttttgattccatatgcactttaaagtagttttttccaattctgtgaagaaagtcattggtagcttgatggggatggcattgaatctataaattaccttgggcagtgtggccattttcacgatattgattcttcctacccatgagcatggaatgytcttccatttgtttgtatcctcttttatttccttgagcagtggtttgtagttccccttgaagaggtccttcacgtcccttgtaagttggattcctaagtattttattctctttgaagcaattgtgattgggagttcactcatgatttggctctctgtttgtctgttattagtgtgtaagaatgcttgtgatttttgtacattgattttgtatcctgagactttgctgaagttgcttatcagcttaaggagattttgggctgagacratggggttttctagatatacaatcatgtcatctgcaaacagggacaatttgacttcctgttttcccaattgaataccctttatttccttctcctgcctcattgccctggccagaacttcccacactatgttgaataggagtggtgagagagggcatccgtgtcttgtgccagttttcaaagggaatgcttccagtttttgcccattcagtatgatattggctgtgggtttgtcatagatagctcttattattttgagatacgtcccatcaatacctaatttattgagagtttttagcatgaagggytgttgaattttktcaaaggccttttctgcatgtattgagataatcatgtggtttttgtctttggttctgtgtatatgctggattacatttattgatttgcgtatattgaaccagccttgcatcccagggatgaagcccacttgatcatggtggataagctttttgatgtgcygctgtattcggtttgccagtattttattgaggatttttgcatcaatgttcatcaaggatattggtctaaaattctcttttttggttgtgtctctgcctggctttggtgtcaggatgatgctggcctcataaaatgagttagggaggattccctctttttctattgattggaatagtttcagaaggaatggtaccagttcctccttgtacctctggtagaattcggctatgaatccatctggtcctggactctttttggttggtaagctattgtttattgccacaatttcagattctgttattggtctattcagagattcaacttcttcctggtttagtcttgggagagtgtatgtgtcgaggaatttgccagtctctgtctcataattggagcatttagtccatttacatttaaagttaatattgttatgtgtgaatttgatcctgccattatgatgttagctggttattttgctcattagttgatgcagtttcttcctaatctcgatgttctttacattttggcatgattttgtagyggctggtaccagttgtgcctttccatgtttagtgcttccttcaggagctcttttagggcaggcctggtgttgacaaaatctctcagcatttgcttgtctgtatagtattttatttctccttcaattatgaagcttcgtttggctggatatgaaattctgggttgaaaattcttttctttaagaatgttgaatattggcccccactctattctagcttgtagagtttctgctgagagatcagctgttagtctgatgggtttccctttgtgggtaacccgatctttctctgtggctgcccttataattttttccttcatttcaactttggtgaatctgataattatgtgtcttggagttgctcttctcgaggagtatctttgtggcattctctgtatttcctgaatctgaatgttggcctgccttgctagtttggggaagttctcctggataatatcctgcagagtgttttccaacttggttccattctccccatcactttcaggtacaccaatcagatgcagatttggtcttttcacatagtcccatatttcttggaggctttgtttgtttctttttattcttttttctctaaacttcccttctcgcttcatttcattcatttcatcttccatcactgataccctttcttccaattgatcgcattggctcttgaggcttctgcattcttcacgtagttctcgagccttggctttcagctccatcagctcctttaagcacttctctgtattggttattctagttatacattcgtctaaatttttttcaacgttttcagctcctttgcctttggtttgaatttcctcytgtagctcggaatagtttgatcgtctgaagccttcttctctcaactcgtcaaagtcattctccgtccagctttgttccgttgctggtgaggaactgcgttcctttggaggaggagaggcgctctgttttttagagtttccactttttctgctctgttttttccccatctttggtggttttatctacttttggtctttgatgatggtgatgtacagatgggtttttggtgtggatgtcctttctgtttgttagtttcccttctaacagacaggaccctcagctgcaggtctgttggagtttgctagaggtccactccagaccctgtttgcctgggtatcagcagcggtggctgcagaaccgcggattttcgtgatccgcaaatgctgctgtctgatcattcctctggaagttttttctcagaggagtacccggccgtgtgaggtgtcagtctgcccctgctggagggtgcctcccagttaggctgctcgggggtcaggggtcagggacccacttgaggaggcagtctgcccgttctcaaatctctagctgtgtgctgggagaaccactgctctcttcaaagctgtcagacagggacatttaaatctgcagaggttactgctgtctttttgtttgtctgtgccctgcccccagaggtggagcctacagaggcaggcaggcctccttgagctgtggtgggctccacccagtgcgagcttcccggctgctttgtttacctaagggagcctgggcaatggtgggcgcccctcccccagcctggctgccgccttgcagtttgatctcagactgccgtgctagcaatcagcgagactccgtgggcttaggaccctcygagccaggtgtgggttataatctcctggtgcgccgtttcctaagcccgtcggaaaagcgcagtattcgggtgggaatgccccgattttccaggtgccatctgtcacccctttccttgaccaggaaagggaactccctgaccccttgcacttcccgagtgaggcagtgcctcgccctgctttggctggcacagggtgcgctgcacccactgtcctgcgcccactgtctggcactccctagtgagatgaacccggtacctcagatggaaatgcagaaatcacccgtctcctgcgtcgctcacgctgggagctatagaccggagctgttcctatttgggcatcttggctcctccattctttcttagactcccccagataaagctttcaactgccccaccccacggctctaccaawactccttttgtcaaagactccagtgatatccacaatgccaaattcagtggttagttctgatttttcttagataaacacayaagccatcagcatcgtgtgtcatagttgactatttcctattccttcaaatgattttatttggattttttttttcctatctgtactgttccttgtcaaactcttcatgtgtgccttcttttgccctaatatttgttcttcttcagggctcattctacaggcctcttttctatttacactcattccctcaataatcttgccttgtttcagagctgtaaaaactatctacacattgwtgactccagatttttatcttcagccttatcccatccaactgcttagctggcatttccacttagctggctaatagaaatctcagatctaacatgtttaaacaaaacttttgatcttctccttaaaacatgctttgccctgattccagcccatctgttaagggcaattctatttttctatttgctcaggcaaaataaaattcttttaataataaaaaagcatactaatccttttgatatggcagtacaattctgttggaaatcccattaactctaccttcaaggtgtatatgaaatttgacccctacttatcaccttagcattaccaccctggtccaggccaccatcatctcctaattggagttttgtgttttgacttgtcttccagcttctgccattaaaatccttctatagtgtattatcagccccaggacaagttatccttcttaaaagcaaattagatcatgtttttcctctgctatgttgacccctgtttttttactctgttcttgccccaccagcttcccagctaccttgctgttctttaagtacacctagcatgtttgcacctccaagccatttcctcttcccagatgttctgtggcacattccttcatttctttcaagtctctgctcaaatgtcttctgtcagacttttctatataaagtatcaaatttacaagtcaactgtagtattttataattccttacccttgctttatattttgttatacaacatcaccctttgacatagtacatatttattttaaataataattactagtttattgtctgtttaccccaactagaatataactaccatgacagtaggagtatttttcccttactgttatagatctaatacctataacagttgctggccataatagggtatcaataaatatttgctgaaagagtaaagggatcaatcaagcaacaaacatagcaagtaaaatagaatagatgcccatgatctattgcaytataaatgatgcagttgcaaatattctttaaataaagctgccctgtaatacttgacttttcatgagctacttcagtttcattaaaactaagtaaatatatataacacattcattcgttcattcagctgttaagtatcatgtaaagatcagctatactttgttcgtaaatatttgttaaacgagaagaatgtgctttaagtaacaaagttatataatctagaaagatttctgaataatcaaggattttaacataggtatcttttaaatggattagactatgaaactatagttgtaaaaataacaatagctaacaaaatttcatcaaaacttaaactctaatgtgtattcgcattcatttatttcatttgatcatcacattgactgtgtagaatattaggattaaatgtacgattaagatttctataccagtttttgaggtgtagtaacagagatccagtcatatagcaaatagcttgttctactaggattaaaatcttaaatatatgcgtaagagcttagtgcttgttcctttaaaatatgcctaatcttttaaatgattgatctgcattgatgtattggcaatcttttaatttgtcctaggtttcccaaaatttaacttgaatcggtcttaaccaatttcttatcagatgttaagaaaatttaaaaagawgggaaacatagatgatagaggaaaagcataggggatagccaagtttttttaataaagattaaaaaattgaataatggataacccttttaatcttttagttgtctgatgtgtttcaaactttttttaaaaagccaagtgacttatttaagaagatttgattgtcagaaaataaaagctgtacttttaaagagcttatatgtttctgaaaataatgatatactcagtattttcttgaagtactgttttattctaggaaaaaggtcatttgctcatttatttagcatatatttattgaacacctacaatgtgccaggtacttttctcagtgcttgggataaatcagtgaataaatcaaagaacactgccaccatgggagttaacttctagcaaggcagatcctataataagcagaataggtaagttttctagtatgttaacaaagtgatacttatgatgaaaaacaaccagagggccaggtgcagtggctcatgactgtaatctcagcactttgggaggctgaggcaggcggatcgcaaggtcaggagatcaagaccatcctggctaataaggtgaagccccatctctactaaaaatacaaaaaaattagctgggcatggtggcgggcgcctgtagccccagctactcgggaggctgaggcaggagaatggcgtgaacccgggaggcggagcttgcagtgagcagagattgtgccactgcactccagcctgggcgacagagggagaccccgtctcaaaaaaagaaaaaaaaaaaaaagaaaaccagagaaaagcaaaggggattgggaacatggggattgtagataaagctttttacagttttccaaaggataaatagggtctcaagaataagacatattgagaaagacttggaagaggtacggagttagaatggaatgaatctgagaagatagcattcaggcaaaggaaaagccagagcaaggtaaaggcctgaaagttataccacatgtgcctggtttcaaggaaaagcaaagatgcccatatggggagcacataaggagcaagaagagtagtaagaaaaagagatgatgtcagaaggctaatgggtgtgctcagatgacagatcatgcaagagctttttagaccattgaatgaacattggcttttattctaagtgaaatgggaaatcattgcagagttttcagtgagtgacattgtctgacatgttttaaaagcattattctgactgctatgttgagtacactctcaaggagcctagggcaaaagcagggaagctagaaacagggatccattaaaatataaataaaagtctctgtttaagattagaatattgactaaaattttgagaatgtcagaatcaggtatttggtatttgtatagaagaagtatacatatgtttgcatcttattagcatatacttatttgtcaatcattattaagtattcattcatgttaaaattcttctgttactatatttaggtttattggtttcctctcatgctccatctctactctggaatatgagctcaaagacagaaatgatgtcttattttccactgtattctcagtgctcaaagtttgtttcttgaattaaatttaaaaagcccaaatgcatggttagtatgcaaaaattattgagcatgaactaaagggcaaattctaaatagtaaaattcagtcaatgataatttagagaacatcattcctagaatataaaaatgctcatttttctaaaagtaagaaaatgattgtatccaattataaagtcatatggtagtttcctttattctgagtttattatattattgcttttcactttcatcagtgtctttcctttgttttatggacacaactcttgtttttccttacttgggtttctatatctattttaattttaaatgataacaacagtttgaagcattaggaaagatgaccttaaagccgatctgactagtgattttcaaagcattctccatgaaccctggtggaatgtttttctggttgtactaagaggraagggtgtgctaagtggtcagataactaaatctctcagatctagccagccttcttcaagagttggttagtggcagagaccaaattttttacattgtcttctagacattatatcgctttaataattttgatgatataagtgtccgtcattgagcgagtgttcttttgaaaggtgctaatagagattaaactttctagccagaactgaccctatgtatttttataatctccttaataatgagagaccttattgagggaaaaatataattctgcctgatgattggagtgtaaaaaaaaaaaaacagtgtggaagtaaaaatagtatgtttaaaaactggcattctagagggacttttagatgattttaaagataaatgccaaagaggagcttaaaataatatggaaacttgttgccgtcattgatgtaagtttaacagtctcccagcagcactattccaagcagagtatgaagtcagctgtggaaatattggtaaaattagaattagtcttgtgacttcttttggccgtacctttttccttagcaatagaagttcatgcagtgtaatatttggtgaaattaaagtagtcaaatggatagaatactaaaacaaacaaacaaaaaactatgtttttacttccctggatttcttgtggctgaaggcccttttatcttcctacctgatttaataaaaatagtatgtatcataactataggcatttcagctacttttttgagaggaaaactgttctgttttatttttctttctttgccaatgttgcggcattcaaatacctaagcaagatgttagtgttaaagtttatttcaaattaagagtagcattccaggatctccaagtacattatgatagcactgtataaagtatatgacaaatcatcaattttactgatcgttgaaaactcatcttaactatgcaaatcctaaaataattcagtacatatgtttgagggaacattgtttcctcatgagtcttcccccggagaatgtcatattgaaagaaaaaaataagaacttttcaataaatctttgttttagttatctttggccacataactactacaaaacactggcataaaacaaccattttgttatattagtgattttgtgggtcagaaatttgggcaggacacaatgagggatatttcatttttgctctataatgactgatgccttagctgattgggtcaattggctagaattgctgggacagctagctcaaaacagatgttttttaaagttmaaaaataggcaacctaataatattatttgaagatttattcatagattgtttaaaaacaaaaacaaaaaaccaagaacatacaactaaaaagcaagggaattatttgtgcagaattctagatcttggtttcatcttgatgttaggcaaggaaatcagattgcagaaggtaaggtcattttctttttctttgcctggtaagtgtatgcaagagtatccatttaattgttattctttaatctcaaaagaaacatttattgtaattttttgtcctgacttttaaaaattctgcttgaattttaacatgatattatgtagataagagttaatttaacattcattttgtatattctgtggtatttaagtagttccaatttcagctacataagattgggtttttttgtttgtttgcttgttttcttttttaatttgtgtttgttgcccccagtctctcaggtcaatataaattcctaggctgtaactcctgattttccagttcagtttgtttttggtatggctcaggaatctgcattttaaaaactcctacaggttattctgacatatgtccaggtttgagaactactgtatctattatccaaaccttatacttgttaggaaaagtattagcaagtgtcaggaatattctgggacaaaggtatacacttttaatgagaggattatatgcagtgattgaatagttgagaagccaaacagggaggcacagtcagaagccactacatttctgggctgggggtactagagctcaaggacctgggtcacctggctggggccgaagctatggaaaagaaactgagaggaattagtagagatatcctgtcttttctctttttcctttcttctgatattttggtaatatcttctattggctgaccttgataaaaatctttgtgcagcctgcaaggtttaatccccggaaatacaaagcrgagcaggaaaaggatagatctgaagataggcaggtctaggacctgaactgatgttcagctagacaggcaatgtcttaattcttaattgatttgcttctcatactttgggctgtatccgttgggaatcaaaaatgcaaaatgttaaaaattacagacartggagctgtacaacttgtattcaaaatccagctctacccttactcactgtgtgactctgggataattacttaatctccatgcttgtgtcctcatttgtaaaatgatgagaataattatctgcctcgtcacttaaaaactgtgcaccaggaagactaagcaaattcctgtggccataaaaggatatttgaaattttcaagagaaacagtgatacccaaaacctgctgtacacagccaaactactatttcaaggtggttagtggtttcagcattagatcatgtattatttccttcagtggtgtcatatctttacaaagcttgatttttttagtgatcatgaaaaaaaaagtatcacatgaaaatcaacgtagaacagtaaataagatgatagtattcaacctgattttcaaaattggaaaagttgtgcagtgtctaacaggcatatatatacctttggtaagtatattggtccattctcacattgctattaatataacaaatacctgagacttggtaatttatgaagaaaagaggtttcattgactatcagttccataggctgtataggtagcatggctggggatgcctcaggaaacttacagtcatggcgaaaggtgaaggggaagcaagcgtgtcttcacgtggctggcaggaagaggagagagtgaagagggaagtgctacacagtttcagacaacaaaatctcatgagaactcactatcatgagaacagtaagggggaaatccatacccctgatccaatcacctcccactagaccactccccttacacatgggaattacaatttgacatgagatttgggtggggacatagagccaaaccaaatcagtaagtaagtatgattatttgagaataaaataaaaatattatttctggcgaggcggcgatgaaaagaggttgattaatggatacaaatatacaactatatagaagaaataaagcaatgtttggagcaatattgtgactatagttaatagtaatatattgtacatttcaaaatagctagaagaaaataatttgaatgttcctagcataaagaaaatatatttaaggaaattgataattaccctaatttcatcttatgcattatatgaatgtattaaaatatcatatgtgtttgaaaatatgtgtattatgtgtcaataaaaaattatttatccttttatttagtatgtatttcaagtgactgctcaaaattgttaagacatatgtacttattaggccctaactacataataaatggaactcttagatatttattttggcttgggggtcatgtgaaaatattactgagacattaggagtgcagtaagcgagcaacttttgtacatcataacattgtcaggagaattaactgagctaataaatgttaaataattagaaaagtgcctagcaggtaataagtgctatgtaagtgttacctattatgggccaaagtaaatgatcaatagaattgcagttctagctactatattgctattaccatgacaacaagggaaaactgtcctggggcttttatgggattggtatgggataccaaacagtacttcatgctcacatctcctactaaggtatattagtgatacacatgggtaatgtctgtgagcaagggttaccatatttgagaactgcaytgtccaatatagtagccactagccacatgtggcagctagttaatcacttgacatgtggctcatatgactgaggaactaaattctaaattttaatttaaatataaaaacaatacttgatttagttattggaaaacttttaagcatttttgaacaactttagcatataaattgcctctttcactgtgtattttatgaactataaatgctatacttagtatttctaaatactgtattagtatgatgtgtactagaatactgtatttctatatgctatatactaactagaatattataatatttctaaataccgtatcaagtatttctgatgaaatgttggtgtttgaattgagatgtgctgtgaatgcacactgatttcaaatacttagtataaataaagaatgtaaacaaatttgcatgtataaatatgtccatcgtggtatatctgaatataaaaattattaatgagacataaatttgttgatttctataatttttcagggggcaaaattattgaaaattgaataaatgaattgaaaagttctacatatttgaaattgtagatattgccacagttagacaatttataataacagttttaattttgttttgtgactgattttcataattccttaggacacagattttgttcatgaaaaggaatctttctgaaaaatggaggcatttatgcctttcactggtttatgaaatgaattcatactttaatgtcataaatgtcagtcaatttgcatcttttgtaatttgacccaaaaatgaagctttatgtaagttcaaaacctaagaacacttaagattgatcggtaatttaaactgagcttcttgtggggaatgaaagtaccatttacaaatacggaactaaaaactcattctctcgttattgggttgctgatgtctttgtcccataatcaacttttagtggtacagtagatggcttacaggcaaaatgagttaacaaggcgttacgagattttttgcattatgttttattttcaaatcatttactaacaagtcaaccaagggtttaggatcaaccatacaaataatcaaaggaaagttgttgagtagcttattttaaccaacaattgctggttaaaataatcaaaatagggcagctataatattgattttaaagtttttaagttgtcaaaatatgtctttgggctttcaaattcttggtaatttgtatttagttgaagatagcaataagagtatttgggggaataaacactatttggtttattctataaatcttatcatccactggtttaaaaaccttcagtcacttctcatacttttcaggatgaaattcaaaatcctttgtaatcggttgaaagccattaatgatatggtccctgtctttcttctctttgcatagttgcctcttatgcagtattcctgccccatgaacaatgagacctcctcatatttccacttaatactgacctcagggagacaaggaagctccatcagaatttcccctacttgcatttctgcctgtatacttcctagcaargaaagttggggtaatttttggctgacctaattggtttcccatctgtctacgatcaccattctgccttgcttgtcatccagtatctgaaatcccttgttcatagattttgtctgggtttttagttgattcaggccagtggataactctgccctctgtttctccattttgcctgaagtgaaagatccacctccctttaattttattccattgtattagccttgtaagtaaaaatataacatccatgcacattttaaaccacttattctaaactataatttttttagagaatgtacatttatctttattttggcattttatgggtagataactaatattagagaaagtccctatttactttgcttcttttatattccacaaaatgaaagttatttttaatggtgttttacaatttattttagttaatctttacaataaacttttgtgataggtatttttatttatcccattttattattagaaaaaaaaagcatcactaaggttaagtaacttatcttccaacatgccactctcccacaaaactcaatacctctaagttaatcttgaacacaaataatattttgataatctttttttcagactgctctgtcttcaccctttctttgttatttctctcttttactttcttcatttaaactgtattaaactcaccattctgtgaagctatctcctaccagaaaagggaccatcctttcctagaaatcttataatgctttattatttgactagataagtgagacaatatgaggtactagtcaagaattaagcatggactcaggatttagactgactccctcacaagctcacatgaggaaaccttaggtaattttttttaatgttttcaaacttgagcttttgcatctaaaaatgaggataacagtggtacctatcttcataagcatcttccgagatttgacagagatacttataaagtacttagctaagaattttacatgttacacatagtacacattcaacaaattaggataattaatataagataatgaagatgattattgctacttttatttcattatgtacttagctaaaaattgaaatacccttatgtttactccagtgactcaacccgatactatattataatatgtaaatatattaattgctaaattaggttttagtttctgtgatgggaaggtttatgcttcttaaatattgtattttcttgttgccttgtgttttaaaggaagggtcagtaagtrttcatgaatggataagtcgtgtctttacatcactaaagagttaatgcttctcagtatgtatatcgtgttatataatttagttctgtcaccctattacacagataatgctattgtgtgatcttgtactaatttgctactacactaaggagatttttttttttacttttaagttcagaaatacacatgcaggtttgttatataggtaaattgcatgtcatggaggtttggcgtatagattatttcatcccccaggtaataagcacaatacctgataggtagtttttctatccacaccttcctcctaccctccaccctcaagtaggctgcagtgtctgtttttcccctatgtccatgtgtattcagtgtttagytcccacttgaaagtaagaacatgttgtatttggttttctatccctgagttagtttgcttaggataatgacctccagctccatccatgttgctgcaaaagacacgatcttattcttttttatggctgcatagtattccatggtctatatgtaccgcattgtctttattcagtgtactattgatgggcatttaggttgattctatgtctttgctattgtgaatagtgctgtgatgaacatagtgtacatgtatctttatggtagaatgatgtattttcctttgggtatatacccaataatgagattgctgtgttgaatgataattctgttttaagttctttaagaaatcaccaaactcctttccacaatggctaaactaatttacattaccaccagcagtgtataagcatttccttttctctccaaccttactagcatctgctatttttggacttttaaaaaatgccctggtttgagatggtaccacattatggttttgatttgcatttctctaatatttagtgatggtgagcattttttcatatgcctttggccacatgtatctcttcttttgaaaaatgtctgttcatgtagatgttttagaagttactctccttttttttaaaaaaaaatgatgtttttcctacatcatttgcttctttctcagaaaagtagcacagagtagcctatgtaacagtccagaggcagtgtgcatggctgattcagcaaaattaattattgattcaaaagccaaatcaaccttctcttagttggttctctttgtccagaaaatcatcttcaattctgttttttacctgccagaaaaagcatcttctctcttgttatcagtgacctttgacttgtcagtaacattcaaaactttgctatttctgcatcactaataaaatatatcaggtcaaccaccttgtcaatttgagccctttttttcccctattttccttgcattatttgtggctgggggtgtaagagaagaatttcagggatttctgcagatattttggtgaaaggataattcttaaatcaacactatcagatctggatttttcttcatccttttaaacaaagctttccttcaatcacctttgaaatatatcttgtttttctaaggttctgtgactttctaacctcccatttgtttctcagtagagcagatctctggtatttctattaactagaggaatatttgaagcaaatttgaagagatggcaaaattactcccttttcatattattcttccaccctaccaaatcttatattctcaagcaaaggaatgaatgagaattatccttttttggtcctgcctccttttgctaaacaagaaacatgctattttgactagagttttgcttcaaagtttacaaataaccctctcagcagtaaattttgtaagtaagaaagctgctaactttaggttgaacattcctttttactaactccaaattcctaaacatttctatccagaaattgttacaggctaattttatatttggctaggtcatcaattttctcatataaattagtcgttactgcagggctctgagattttcatgccatccggaatgaataagacttttttcataataactcacaaagccccatttgtcacatatactaggtagtatcaagtgctccaggaatcaacattagcattatgttgctagccaatctattcaacacagtagtctcttggttccttggcttccataactctctgaatttttcttccattctaccttagccatctactcacatgattataatctagatctctaacatttcacactctggtcatcatttcctgtaccacttgatcccttaaaaaaataagtgcactattcttcagcccatggggacctcccacctctagtcactgcccaatgactataattgtttttcactccatcatggtgagacactttgtaagtacccttaacttccttcctttttcttcctctgctatattactgggcaaaactgtcacattttgctaaacccacctaactccataatgtatatgttcaactgaacattattagagaaaaccctgtaattgtactggctggcctaacttcaaatttgcttctacaaattcatttgctcaactgatatttatttggcaccaacgatgtgcaaggcatgctctcaatgtgaaggtatattagtgaacaacaacaaaaatgtctttgccctcataggggatatactcaagtgggaggcagacaatgaatgaaatataaaatgtatgtgaagttatcaacaagtgctaaggaaaatataaagaagggaaagggaataggaaatgttggtgggaggagtggggaggaattgcaattttagctaatagggaaggcatcacagatttcaaagaacatttagtactgccagtaaattgccattcccgttctcttaaacttgactttctttaaatctgtaactcccttaccttatttttatttctcagctacctacctagttcacagataaaagagatacaatgaaacattaactgtctcacatttttgccattagctccaccatcctacctgtatctgtatgagtttattatgtcttccctttagttgtaatgaagtatctcttttttaaagaaaatttcttcacttaagcactgaatcctatagtctttttcctttctagtgaactttgcttctagaatttttccctgcctgggttatcagtctctccccgtctatgggagcatcctcatcaataaactaacatttttaatatcacaacttcaaaaatgctctcaggatcccatattcctttgcagcttggctttacattttcttccactttataaaaaaaactccttaataaagttgtccacgtccactccctccagttcttcactttctttccactcctgcaatcactccaattgagttttcatcctcactactttactgaaataactacattttccttctagctacaatgttttctctggtcttctgtaacttcagagtcactggtttccctcattcactctgcctcttggtctcctcctcctctaacagacttctaattttggagtgcctccagccttggtccttggcctttttcactgtctacacttttgcaaaatatgatcccatggcttctgaggtcatctcttgactgatacctttgtaatttatatccccagccctaacctttcccctaagctccactgaagtttagtctaattagctacttgaaattgctactcagtaggctgaaaaccgaaagatattttccttttcacctccatcctccatttcctatctcagtaattggcacccagttgcttaggccaagaaagcaacaagtcattcttttgtttgtttgtttaatttttgtagatacatagtaggtgtatatatttatgaagcacatgagatgttttaatacaagtgtgcaatgtgaaataagtacatcgtggagaatggggtatgcgtcccctcaagcatttattctttgagtgaaaatcaatctaattgtactctttacgttattttaaaatatacaattaagttattgactatagtcaccctattttactgtcaaattctaggtcttattaactctttctattttttttcttttgcatctattaaacatcccctcatggccccaacccccacccccatctcctaccctccctccccccgccaactacccttctcagtctctggtaaccatccttctactctatatctacatgagttcaattgttttgatttttaggttccacaataagtgagaacatgtgatgttcctggcttatttcagttaacataatgacctccagttccattcatggtattgcaaatgacacaatctcatccattcttttttatggctaaatagtactccattgtgtataagtaccacattttctttatccatttatttgttgatggacacttggttgcttccaaatcttggctattctgaacagtgctacaacaaacatgggagtgcagatatctcttcaatatactgatttcctttcttttgggtatatacccagcagtgagattgctggattatatggtagctctatttttagttttttgaggaacctccaaactgttctctatagggttgtgctactttacattcccaccaacagtgtataagagttcccttttctctacattctaccagcatttgttattacctgtctttggatataaaccatttcaactggagtgagatgacatctcattgtagttttgatttgcacttctctgatgatcactgatgttgagcatctttttatatacctgtttgctatttgtatgtcttcttttgtgaaatgactagtcagatcttttgctgactttttatatcggattattagatttttttcccccatgagttatttgagctccttatatattctggttgttaatcccttgtcaggtgggtagttcataaagtattttcttccattctttaggtgtctcttcactttattgattgtatactttgctgtgcagaagctttttaacttgatatgatctcatttgtccatttttgctttggttgcctttgcttgtgaggtattacttaagaaatctttgtccagttcagtgtcttggagagtcactcaaatgttttcttttattagcttcatagtttgaggtcttaggtttaagtctttaattcattttgatttgatttttgtatatggcaagagataggggtcttcattattccgcaaatggatatacagttttctagcgccatttattgaagactctcctttccccagtatatttcttggaaactttgtgtaaaatgaattcactgttgatgtatagatttttttctggattctctattctcttccattggcttgtgtgtctgtttaggctgttttggttactattatctctgtagtgtaatttgaagtgaggtaagagtgattgctttagttttgttctttttgctcaggatagccttggctattctaggacatttgtggttccatataaatcttaggattgtttttttctatttctgtgaagaatgtctttgatatttcggcaaggattgcatcgaatctgtagatcgctttgggtactgtaggcattttaacaatattcttccattccatgaacatggaatatctttccattttttgtgtgtcctctacartttctttcatcagtgttttataattttctttatagagatctttcactactttggttaaattaattgctaggtatttaattttatttatagctgttataaattggattactttcttgatttctttttcagatagttttctrttgacatatagaaatgctactgatttttgtatgttgattttgtagaatgtgtttatcagtactaatagttttgttgggtggaatctttaggattttctaaatataagatcatatcatctgcaaacaaggataatttgacttctttctaatttggatgctctttgtttctttcttttgtctcactactctatctaggacttccagtactgtgtttaataactgtggtgaaagtagtcatccttgttgtgttccagatcttagagaaaaggctttcagtttttccccattcagtatgatattagctgtgggtctatcatatatggtttttattatgttgagatgttttccttcagtacccagttttttaaagagtttttattataaaggtatattgaattgtatcaaatgcttttcagcatcgattgaaatcatcatatggcttttctttgagacggagtttcgctcttgttgcccaggctggagtgtaatggcacgaccttggctcaccgcaacctccacctcccaggttcaagcgattctcctgccttagcctcccaagtgtctgggattacaggcatgtgccaccactcccagataattttgtatttttggtagagatgggttttctccatgttggtcaggctggtctcgaactcccaacctcaggtgatccgcctgcctcggactcccaaagtgctgggattacaggcatgagccaccgtgcctggccaattgattttcatatgttgaatcattcctaaatcccagggataaatcccacttggtcatgatgaatgatctttttaatgtattgttgaattcagtttgctagtgttttattgagggtttttgcattaatatttattggacataytggcctgtagtcggttttgatgtgtctttctcttgttttggtatcagggtaatactagcctcacacagtgagtttgaaaatattcccttatcctctttcttagaatagtttgagtagaatttgcattagttcttccttaaattatgtttggcggaattcagcagtgaagccattgatagggtcttaggctttttgtttattgggagacttctttattatggcttcaatctcattacttgtcatttgtctttttgggttttggatttattcctggttcaatcttggtaggttatatgcatctaagaatttatccatttcttctagatttttcaatttattggcatatagtcattcatagtagtcactaatgatgctttggatttctgttgtatcagttatagtgtctcctttttcatctctgattttatttacttgaatcttctctctttttttggttaatctggctgaagatttgtctatttatgtaacttttcaaaaaaccaactttttatttcattgttcttttatattgttttctttatttcaatttcatttattcctagtctaatctttattatttattttcttccactaattttgggtttgctttgtccatgcttttctagttctctaagattcatcattgggttatttatttgaagtttctcctcttctttgatgtaggcatttacagctgtaaaattccctcttagtacgcttttgttttatcctacaggttttgttatgttgtgtttccattataatttgtttcaagaatttttcagtttccttaatttcttcattgtcccactggccatttaggagtatattttgtactttgcatgtatttgtatagtttccaaaattccactagttttattctttttctttccgattgaagtactcccttgggcatttcttgtcggatgggtctggtgttcatggaatcctttggcttttgtttatctgagaaagtcttttcatgtatgaaggatatttttactggatatactattctaggataaaatatttttttctttcagcacttgaaatcttcatgccactcttgcctggcttgtaagattttgactgaaaagtctgctgctagttctattggagctccattgtatgttttttgcttcttttcctttgtggcttttagcatcctttttaaaatctttgtcctttgggagtctgatgattaaatgccttgaggtagtcttctttgggttaaatctgtttggtgttctataactttctcgtacttgaaaattgatatcttcctcgagatttgggaagttatcagttattatccctctgaataaactttctatccttatctgtctctctagaccttctctttaaggccagtaactcttagatttgccctttggggctattwtctacatcctgtaggcatgcttcatgttttttaattcttttttttgtctcttctgtgtattatcaaatagcctgtcttcaagctcactaattctttcttctgcttgatccattctgctattaacagattccgatgcattcttcagtatgccaattgcatttttcagctccagaatttctgcttctttttaattatttcaatctctgtaaaatttatttcataaaattcagaattccttctgtgtgttatcttgaatttctttgagtttcctcaacatagctattttgaattctctgtctgaaaggtcacatatttctaattcttcaggattgttccctggtgctttacttcatttggtgaggtcatgttttcctggatcatcttgatacttgtagatgttcttctgtgtttggtcatggaagagttatgtatttattatagttttcatagtctgggcttgtttgtacccatctttcttgggaaggctttccagagatttgaacagacttggaagttgtgatctaagctatatctgcttaatgggacaccccatgcccagtaaaactggtttttgcaggcttgaagaggtactgccttgatggtcatggacaagattcagaagaattctctggattattaggcagagactttcactcccttcccttactttcttctaaacaatggggtatctctctctgttctgagctacctggagctgaggttggtgtgatataagcatcactgttgccaccaccactgtgactatgctgggtcagacctgaagccagcacagcactggatgttgcccaaggcctcctataactactccctgtctactgcctatgttcacttcaggccctgaggctcaacagtcagcaggtagcaaagccacccaggcttgtgtccttctctgcaggaaaatgaattccctctgggttgatccagaggtgctatctaggagccagggactatagtcaaaaatctttgaagtttgtctggtgttttagtgtaccgtagctgagctggcactcaaaccacaagacacagtcgttcctactattttctcccctttccaaaggcagaggagcctcactccatggccaccacaaccatgggcccatggggaatactgccagactactgctgatattcccttaaggtacgagggctcttttgtcagcttgtggtaaatgctgcctggcttaggactcacccttgagggcagtggactcccctttggcccagagcagatccaggaatgctgtccaagagccaaatcctaaaatgtgggaccttaagagcctacttgctactctgccctcctgtggctaagcttgtacctaaggtgcaagacaaagtccattttacttttatgtctatttttctcaagcagcaggagtctggccccatagccagtacagctgggaatttgctgagtctcagctgaagccagcaagtctcacagttttatccagggccctctacatagtacctgggtatcactgcttgttattcagggaccagtggctctccagttaacaggtatgatgagtcctgccatgactgggtccttgcctaaggcagcgggttcccttctggcttacaccgtgtctagaaatgtcatccaagagctagagcctgggagggtggccttatgattgaccagtaccctgtcttgctatggctacgctggtttccaagatgcaagacaacgtctttcccatttgtcctgccctctcctcaagcagaagggacaggtctcctttagagtcatgaggtgtgtagcctagcgttaggggagggatgatgccagcagtcccttagccgccccggcctgtgtctgagtacatcatgtaccccccaagtccagtgattctgggcccagttcaacactaggacatgcctgggagttgcagtccttgtggcacagactgcctttcaagttcatgtaggggcccagagctctttatccgttggtggtgagacttgtgcataggtacttaagttctgacctggctatagctggtttaaatgttctctccattgcacatgtcagctgaatttggtctggtttcactttctgctgtaaaagggcagcactgacttcagtgcctcataaatgctgcactttctttctcccctgagcatagaaacactctccataccacgcctctactgcaggtgattcaaggctgtttttcctacctcttcagtgcctctttcagtgatatgaagttaaaaccaggtactgtgagtactcacctgacttttggttcttatgcaggtgcttttcttgtgtagatagttaaattggtgtccttgcagtaggggaacatcagtagagccttctattctgccatcttgttccacttccccaacaagtccttcttgactcctcttcctcaccaatacttctgattactttaaaatatactccttatacagccacttctcaccatccctactgctgtaaatttagtaaaactgccatcatctgtagcctggcttactgcaaaagtcttctaatttttctgtctgcctcagttgggctttggtaatctattcaacctcatctttctctaagcttcttcttgttcacagtgttccaaacatactgtcctttctgtactaagaacatatcagtttcatttccatatcaggcacttagctcttgttattccttttgcatagaacgttcttccctgtttcatagatgtcactttctggtcattcaggctcaaacatttcagcctttagctaagggctttttcttcatactgctgctgaaatgacccctttttatcactacctccgctatcactctcctccatttaccatattttatgttctctatactagttatcattacctggaactatcctatttatttatgtctttcaatacttattacctctttcctcccactagaattgcagctgtcagggagaataagtctgctgtcttatttacttcttccctctgttttctgggatatggtaagtgatcaacaactatttgttgactgattcgttcccagagcaaactaaagacagaaaagagctactacccccagtctctctacagttgagcagataaatgcatttgaagaggaaactaaaagtattatagacacagaaaaccttttctaagcaaaatagcaagatttttgttaaaatagggaagaatatgggggctctaggattatgagaacacatattatgcaactggagccttgaggaatcatagatgttgtgctggcaggctcacttcttacccaggtattaccaaaagaatctgaaatttactttgattgagccataaccataggctgtagggtaggaatggcaagtagactatagtttgagttaaggcctgttggttggtagttactgtacctgggtcatttttatttatttattttttatggtttatgggcttcaaaggaagacctgctgtagatatgggaaccaggggtggtaatataaaagtcacgtgtttgtcttttatcatctggaatccataaacaaaatggcatatttcacacagtttcttgatcagaatataatatctgaagattccgtgaactttgaatctctggcattttaatttactttctggtaaagcagactatagtaaatcccaattaaccaagacctgtgttttctctggctcaaagaaataaagaaaaacaccaaccaaaacaaaacacaattacattagaagctacctactttgagagcttctttggagattttagtggggaagcacagctactcataaacccttgactggagaatggtcctcttctttcagggaaaattgtcgtctttgactaagtatacagatctaggtgggacacacatggagcagtgagggaggaaggggacacccaccttgtcagccagatcagctgaatcaactctggtgatcartgggttgacatgttgcagccagatcatcctcatgtttcctattttgtatattgtagttctttaaaataattaaagtagtattttagtagtagtagcaaagtatttttctttagtgtcactctctgtgctcatgatgtaagagataaatattttatattttataccacccgtaactgaagataacttttgaaaggagcacatcgactacagttcttaatacttcttttacgttttctagagtcaggagtaaaaatagttggctattataattacatccatttctctgatacactgaagacattgacatctgatgtgttaataataataatagctactatttactgactgcatactatgtgctaatcaatgttcttaacactttgcaagtgttatttaatcttcattataaactaaccacatagaccactattgctgtctatgtttttgtagatgaagaaactaagacataaagaggttcagtagcttattcagatcacagagaactaatcattggcagagccagaatctaaaccaaggcagtctggctctaaagtctactcttaaaccactgtaatgtcttgcctattagaagaacacttaaggcaggccataagagagcagatttaatacaaatcactaaaccagtggatttgttaatttttgtaaaaaataagtcttgactgtttactatattgtaggaatgacctagtgctagaaagttttctgattttgaatggctcacagtctaccaagggaagattaacatgtgaactgactatgcaataactataattatacacatagatatatatgtatatatacatatatatgactactatgtaataactatgcatacagatatatacactatataactacagagatatatatgtgtatagtataactgtatagtatatatattatatatatgctatatacacagatatgtactttcatagtcatagttactacatagtcttatatatatgtgtatgcataaacattcgcttcactgtgaagtaatgaaagatggcataattacttctgctagggtgaaaaaatattgtgtttgaattcacagagatgacattttcaggactgagatgtaatagaaattcaagactaaaaatttctcttctcactttctaggttaatcagagatactggatcctacttgccatattctttagggagaaatagcttttcattaggcaagtatttttatatgatatgccatctttcctgagccaaaacagtgtgtctgtatagtagcccacaccttctcattcagattaagcaccttcatatttctggatccttttcttgctattgtggcttttcattggtcgtagagaagaaaggcagagtcatccaaatgtccaggtcttcttggtctcacatacatgaagcttcaaaactacatccacaaagaggaaactaatgtacaatgtttttatagatcttgagattttaatatttttaatgtttatgagtagagtacttcaatccatgtctgttttcttttttttaattgggttatttccactttcttccattttaatctcttaaaaaatgatttccaaacgctttacttcactgacctcttggtcagtatatttttttaaaatgtggtgctccgaactgaacagtatgttcattagagtatatacagtatggtgacattctgtcttcctgtcctctggaattgagcctcctattagtaagaaatggagaaatgtcattgattcattttacataggatgtaacatcttattagctatagccacttctctcaagttagatgtaataatataaaatgagactctctatcgttcacatattattggcataccttttaccttttggtgttataggcatagataacattgatgaagtgtaatttagttttgtagtcaaggtgataaagacaaaaactaaatcagagagaaaatcggttaaatgtatatgtctttttaaacttcagttttattgaaacctgaatatatgatttatttttgtagacaatagaataagaagttaggtgtctgtgaattttgaaacattattatataattaatcattctctattgtaattgcatttctttccattaraaagatgtttttcgtctttccatccataatgtcttgctcagtttctggaacttaatagatgtgcaacatttttcatggacctttttcgaattgagtaattgttcaaaagcatatttttgaaggtgctctgtcagatttaatgaaaacaataatttttaatatagtctttttatatatgtgaatatctctgatacttggcttcgtttttatctttctttttccttcattctttctgttttatttacatattaaaagtatggttgtattctgtcatatattgccctttgctatgaacgtaacttattatcctcccaagatgatggtaagtgttttgagggcaaggatcatgtaatatgtcttctatatatcttccatagggctcagcccaatgctacacatgtagcatttaactttgtacacctgaattgtattctcagctgtttaaccacatagaaccttaaaatttaggcctacacagttttatgcctgtcacacagcttgttgattctctgccaccataatccccgttcaaatcttgtgattcacattgtggaaagaaaactcttttaaaaacatgaaagcatttcgtttgtcttaattctccagtataatattttggatagaatcaccatagactattttgtatttatgttactatttatattgcaattcacttttactccttacctgaattagtactttacatttgataatccttattgatattttattatttcccctattgattatgagaaatttctgtgctttgataattaaagcaatataattagtagttgtctgtttttttaaaatgtaataattactcaaaaatcaaagtagaatgagaaccctaccttaaaatatgtttgtttgtttgtttgttttgtaaagagcctcactacactgtcttcccagattctatagttacatgtcacctgattatcaatcaatttaaggatcagttgtgatacaggaatcctgtgatgcagaagccaagaaaaatcattatgtatcaagattttcccctgggtattagaggataaacatgtaaaacattatagtgccctagaatgcaatttccttactatattcctttttgtaccctcttcacagccctttctaatagtactgcagacctcatttctgaatagagttggttcttccacaaattaacaatttgagcttggacaaattaccattcctttctgaatttctctccttatctatacaatgaagagttactttggccatatgatcagagatcttttgtaatatttaagttgtaaatgctgactgtagaaagatatgatcatgcataagtgatatgtatgggaggaaatattttttttattaatctaagaatttatagtattgcttcatatcaataatagctataatttattcatcacttatatacaattctatgtgattgacggtggccaaggcaattataaaatatggaattagccaatcagaggctttgtgaaatgattctgtggtgtgataagagtgtgtaaatgcaaattatgaaagatggctgctaccacagaatacaaggacaaaacaacacataaacttttaaatctataaatataagtgtagaaacaaatcctgtttagtggatcatagggagacttgatcctcattcccatcacacttctcccgccctttctgcttgtctctttccctaaattcacaaggtctcagctactcaattaaactggtaatctatagaatatgatgatgaaggctatgccttgctgaaagtagatgctcactggcatcatcatagaaaggatagaaagaactttgagaaaagcatgaaagagttggtgagaaaacgaaattgtcagtccttaggccttctctttattatcttttacatggagtgtagatacacgtgcatgaaagccccaaatacagtagtatctggatgagcatcttaatgaatattattatttttataattaataaatattaaaacatacttatatcatgtcaatcaatttcatcagcatttcttcctcagtattaattttgaaatttcttggctttcttttctttcctatctagattcacactcttagtgaagtcatcaagttgaatgatttcgtgcactgtcttcatacaaatcttttctcttgaactccacacctatatacccaaatatcttcttgacatctccacatttgatagatactggatgtctatagagatcttaatttcttttttattacgctttaaatgttagggtacatgtgcacaacgtgcaggttagttacatatgtatacatgtgccatgttggtgtgctgcacccatcaactcatcatttaacattaggtatatctcctaatgctatcccttccccccaccagcccacaacaggccacagtgtgtgatgttccccttcctgtgtccatgtgttctcattgttcaattcccacctatgagtgagtcaggaaacaacaggtgctggagaggatgtggagaaataggaacacttttacactgttggtgggactgtaaactagttcaaccrttgtggaagtcagtgtggcgattcctcagggatctagaactagaaataccatttgacccagcaatcccattactggatatatacccaaaggattataaatcatgctgctataaagacacatgcacatgtatgtttattgcggcgctattcacaatagcaaagacttggaaacaacccaaatgtccatcaatgatagactggattaagaaaatgtggcacatatacaccatggaatactatgcagccataaaaaatgatgagttcatgtcctttgtagggacacagatgaagctggaaaccgtcattctcagcaaactatcacaaggacaagagatcttaattttaatgtgactaaaactgaacacctgattttcacctgaaacctgctatacttatctaccgcttttctcacattttcagttgctctgcccaaaatccttatagtcatccttgatttctctttttttctctcactctacatccagtccatcagaaatcttattgcctctaacttcaaaatatattattaggacatagactgcaccacctctactggtaccacccttgtgccatctactttctcttacctggatcagtgcaacagtctctttcccagataattatgtctccgtaaactattctcaacatggcagccattaatgatcctttcaaaacgtgtcagatttatgccactcctttattcaaaactctgtagtggtaactgttttacaaagaaggaagaattggctgggcgtggtggctcatgcctataatcccagcactttgggaggccaaggtgggtggatcacttgaggtcaagagttcgagaccagcctggccaacatggtgaaaccccatctctactaaaaatacaaaaattacctgagcgtggtggtggacacttgtaatcccagctactcaggaggctgacacaggaaaatcgcttgaacccaggaggcagaggttgcagtgagccaagatcgcatcattgcactccagcctgggcaactagaatgaaactccatctcaaaaaaaaaaaaaaaaaaaaaaagagtgaagaatktacagtggcttctagggccctccagtgtctagtctcttcctacttctttgccccttgttcactttggtcgctctggcttccttgttcatctcctcaaaattgccaggcatgcctctgaattaaagtcagtgcattagctgtttttctctacctgggatgttcttctctcactttttctccccttccagtatttgctgagacattacctgctcrataaggcataccttaccaccttattaaaatcataattccagcactactgatctcactcttctctactttatgttactttgtatcttttgatattacttgtcacttattaaactctatgatttacttatttgtagtgtttactatctcccactcccattagaatatcagctccatgagggtagaactctgttttgtagcctggtacagtgcccagaatattgcatgttataagttctgttccacagacttcaaatattatttcatttcattgtcttctctacgtataccaatgaaacaatatgactcacagaggttacctaacttggctgaagtcaatatctggtaaaagtggaactgagatttacacatatacatctcctgctccttgccttccttatacaaagtatgtgaaaacaagggaaaagaataatgcatgtatatggatgaatttatatgatattttataaacacttttatataaatgtctacatataagaataaaatattggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgagaggcggagcttgcagtgagccgagatcccgccactgcactccagcctgggcgacagagcgagactccgtctcaaaaaaaaaaaaaaaaaaaaaaaagactaaaatattttctattttagtatagaaataataattgtataatactagaatttaaatatttttacacagaaattgctatattcatcagtaacttaaatataattaccttttttgatattaagtaagtattgataatgaaatgattaggagttttttcctgcttcacctacacaaatataagctctttgtagttcatagcaagacactggtatagagaatccattatcattctgattgtacattgtgtttgatggaattgttcaagctgtgtaagatctaatttgtactctctttaagataacactgactgtttcagttagcatcttttcattattatatatactatataaatggggtacatccttcagggctttttcaacttaacagtttcaagtctagttttaggataaggtagtacaattgctgtgttttgattgtaaatttatatgtttatttgagaaatatcctttctgaaaaatgatggatattcttatatgaaataacataaaccattttttgcattctgtagactttcttattgtcccatgtccctgattaggatattattattacatctatcagggaagatttagcagtgtaagaatcactttgtcttggggtatgtaaatattcctaatttcacatttgtactaacagtggataactcagttgtatactgctttagaacaagagagagtaaaatatggtatttttcatttgaaatttagaaagctaggcatcttaaaccaccaggtactattttggtataatctatcacttctgttacattttattggatataaatcatattgtatcaggttgcatagcgacaatatgtttcaccaggcattctatttttataactttatttaaaactgacatgtaacttgctgtacctgaaaccccaagtgatccagttattggagtgtaacaaagttttgacgtcagagtagctatttattctactggaaaccattagcgatgcattaccctttggcactgctgttttttgcagaaacatggttaaaattttatgactgattttgaccaattagatttctctccctcttagaactaagcaattatatatatatawaaaacatgaatatatatgcatgtrcatgtatgtaacttgcacatgctttatatccttaaaatgtgtaatatatttaaatataggtttatatattcatatttattttaacattatacatatcaagcttttttaaaagtttcttctcaaaaactgagtgtcatagttttatttttcttattttcacacctgattattattttatggaaacgaattaactgcatgttgttgttattactatggatatggatgttgattagctgcatagtactaccatgtttgttggtattagtgcttttgttattattttaaaagggcctcttaacatttgtttactatcagcactagattctttgggaattcataggggcaataccattttgtacacatttagtataatcagttaaagacaggattttctcctgcttagctttgactgtttttcccctgaaaatattaaaatatgtgctgtgcatccatgcatggagttaaagtcccttgactcctgagccggcctagtgccagcttacatgctgatctctgccagtgtattttaaattggatctgatgggaccaccatttggaattaagcagaggaaaatattttagatttttatttagtaaactagttgttcttcaaaccctgtataaaaacattgctaaacttgtgtttatggaataactaacttcartcagtttaggagatgcctgtgtataaggagagaatgttaattctctcaaattcctgagtgacaccttaaattcaataattattactactgttattgttatgaattatctgcttagtaatcctcacatattgttgaattatttttctttggaaaattcaaatttttatataatttttaaaatatggcatctgatcattatttcccgtgttggcatttttttgtattttgacatatttatttttaactgacaaatattgcatatagttatcatggacaacatgttgttttgaaatatgtatacgttgtggaatagctaaatcatctaattaacattacacatgaatttgataggagaactccatattggtaactccttcggcatgttataaccttttccagctccatctttttctcctgaaacctatcaagagtcttttgaggtacaaaatatgtaggatgagttccaactctaaaagtagtattccagaacattgtaatattatgcggtgatcaagaatagagrcattgaaacagaacaaccagggttagaatctcagcctgccactacccgtaacaatagacagattatttcaacattctgagtcagttatctgatgtataaaataggtgtagttggaactacctcaacgatttttgtttttataaggattcaatgaaataagcagaaagcccttaactcaatgtctggcacatagtaataactcaaatggtagctatcagtcatttgttatattagacctggtaattctccttgtctgcaggggtagtatggcatagtgcttaatagtacaggctttagaatcataatacctgggttagaatcccagctgtactatttactagctgtgtaaccttcaagaagtctcttaacttcactgcctcagtttcttcatctgtagaataggggaatataatatcacatatttaatacatgtatctgaagattatatgcatcaatacaaggaaagtgcttaaaacaatgcatgtcacatagtaagggttcaataaatgttagctattatatcaaaaatcactgaatgtgagcttcctgttattttagaaatctattaagtctagccctggcattttgtcattattaaacaggccggactgcagaaaagatttctctggtcacacagcatttctggacattttcacaccccacctagcaatcccacaaatacccttacaataaatatttattataaggctcattttaacacaaattaacccaaataattgaccctaaatctgaatgaattcatttaaatacttgtgtaaaatcatgtggtttcagattttgtcgttgctcttttttaagttaagatatgtggtccctccaggaaacctacttaggttggcatgaggctagtctggttaattctaatttaagattgacattggttgatactaatattctcaaccacacaataaagtttgttatcaggtagatgattgctgtcttataatacctgctagtggcctaacgatccacactggtgacaaaaatgcaagatctctataatttctttttatttcccactgtcttctgcccaccccacccaccgcaagattggatgctaaaactaaatcaatcaatagactttttctcctggcatgccattctatccttttaaaagaataaatatataggtcaagaattactatactaaaagccaaaattgaaaattgggatctaattaaactaaagagctctgcacagcgaaagaaactatcatcagagtgaacaggcaacctacagaatgaaagaaaatttttgcaatctatccatctgacaaagggctaatatccataatctacaaagaacttaaacaaatttacagaaaaaaacaacaccgtcaaaaagtgggcaaaggatatgaacagacacttctcaaaagaagacatttacgtggtcaacaaacatgaaaaaaaggttatcatcactggttggtcattagagaaatgcaaatcaaaaccacaatgagataccatttcacgccagttagaatgscgatcattaaaaagtcaggaaataacatatgctggagaggatgtggaaaaataggaacgctcttacactgttggtgggaatgtaaattagttgaaccattgtggaagacaatgtggcgattcctcaaggatctagaactagaaataccatttgacccagcaatcccattactgggtatatacccaaaggattataaataattctactataaagacacatgcacacatatgtttactgcagcactgttcacaacagcaaatacttggaaccaactcaaaagcccatcagtgatagactggataaagaaaatgtggcacatatacaccatggaatactatgcagccataaaaaaggacgagttcatgtcctttgcagggacatggatgaagctggaaaccatcattctcagcaaactaacacaggaacagaaaaccaaatgccacatgctctcactcataagtgggagttgaacagtgagaacacatggacacagggcagggaacatcacacactggtgcctgccagggggtgtgcgttcaggacagggatagcatcaggagaaatgcctaatgtagatgactggttgttgggtgcagcaaaccaccatggcacgtgtatacctatgtaacaaacctgcacattctgcacatgtatcccagaacttaaagtttattaataaaagaaaaaagaattactatatcaagcagttgctgaatcaggttcatcacagaggggagtgcaaacccatgccctgaatcaacctcttaaagctatctacaggaatactttgacttcatggtcttagaatttactttacctgagtttaattcttagctttaccactactagctgtgtgaccttgagcaactgttttactccatcattatcaaatatttattgagcacttattctataccctattactaagtaaactaatagaaaattctctaagccaacgtttctataatgataaaaatgtttacattatataatttataggattgtgatacaggtcaaaatatgatcatctctgttaaaatattctgtgaatcataaagtagtatactagtattatttgctgtgagctttatgagaatagggactatgtcttcctttgttaccttattatctaacatagtacctgacacatagaagtattcagaaaatgtctgcagcagaccgattttcttaaagatctcaaaagcatccatttgtatttaggatattatttccgaagttaagcttaaaatacacatratttattcttttgattatgtaatggtattcatatatagtttgaattatgtggaacattcctaagggacttactgcaagaaaatgtgttactagataaaatcatttttatatgtgccctattatcagcaggccctattttctacaaggtaatgtagggtttgaattaaaagaaattgttaaaagtttattaaatctactatggccaacaactgttgctatttttgtgcacctagagctgtagttaatcttcagatttttgaataatttatttcaggtgtcacatatatatattgagtggctgaaaatatattttgtacctaaaattaataataattgaattataaaacctacctaattgtcacagtagtcaactacctaaaatgtttctaattattgggacactgtatatatgtattaatgttagtaaatggactaaagatatgaatttcagtacactggaccacatctaaaaatatttcatgatgtatattttattagtataggaagtgaaatctcacagaccaaaaaggaatgctgtattaggtaatattaactcaacaaaaattagattctaaggcttattcttgcaatgcacttgcagatttccgtctaatcaccaatcacccttttgcaaaacaatggcaattaagatctacataaactaagctaatgcctggttggggagattatttcgtactaatatacacttgcatattcttttaaaatgagaaataatacacagtattcacaggaataaaactcagcaaatggaaggcacagaaaaaccctttcagagagcagtcacttcaatagagtgtggctaaaagaaattttcttctgaaacacacccagctaattaatttgtgtttacagaaggaattaatttttcttactcttactgaacttaaaaaaagaaatgaaaatccactaaaactcatactaccaattttaagttttaatgaacttttttcagagatgtaaaagggtatattttcttttccttagactaaaaccattagctatttgccataatattcttcttatgtaataactacagagttttgaagctaatgacaacagccaacaggaaaaaaggtttgtcatagtttctgttccttctctggatgcatcatttcagtattctagtacttttcagcagcattgtcagtgagtattcaaggctaaggaaagacatagtatgtcttcctggagcatcaatttgacttgccaacaagtaaattaaacttattttatattaaaatgaatacatatatagagtagaataaaaaatgttcattaattttaaaattcaaaccccagactacatgagttgtaattttgaactaatgtatggtttccttatttgaatagcactgctgacttccattatacatcttcctttcatttttagatacttggttgtatgtagttttgctttttctttatttaaattgaatttaaagtgccattttaaagtccatccatcaatggatactaggataagagggatagcattaggagatatacctaatgtaaatgacgagttaatgggtgcagcacaccaacatgacacatgtatatatatgtaacaaacctgcacgttgtgcacatgtaccctagaacttaaagtataatacaaaatatatatatataattaaagaatgctaaaagactcaaaaaargggaagtttatagtaatatatggcttacatcaattagaaagattacaaactgacaatctagtaatgcacctcaaggaactagaaaaacaagaacatacaaaatccctaaatagtggaagaaaatatataaaaagatcaaagggaagctaaataagagactaaagaaacaatataaaggatcaatgaaacaaaaagttggttcctcaaaaatataaacaaaattgataagccactagttcgactaaccaagaaaaaaagacccaaataaacaaaaccagaaatgaaaaaggagacattacagcttataacacagaaataaaaaaagatcattagagacttatgaacaactttatgcttgcaaattagaaaacctagaagaaatggataaattctgagaaacatacaacctgagattgaacaaggaagaaatagatatcctgaacagaccagtaatgtgtagcaaggttgagtcagtaataaaaagtttctcaacaaagaaaagcccaggactatatggattcatagctgaattctgccaatgcaaagaagtactagtacaaatttccctgaaactatcccaaaaaatcagaggacataattctccctaactaatcctacaagatcagaatcaccctgacgtcaaaaccagacaaagataccaaaaaaaaaaaaaagtctacaggccagtagycctgattagcatagatgcaaaaatccttaacaaaatactagcaaataatgcaaaacacatcaaaaagattcaccatgattaagtgagatttatgcttgggatgcaagaatgattccacatacactaatcaataaacataatacatcacatcaacagaatgatgtacaaaagccatatattaatctcagtatacacagaaacaacatttaataaaattcaacctcccttcatgataaaaactcttaaaaatctaggcatagaaggaacattccttaaaatactaagtgccatatattacacacctatagctaacatcatactgaataaagagaagttgaaagtcttttctctaggaactgttacaagacaaagatgctcacattcaccactgcctttcaacatagtactggaagtcttacccagagtaagcaggcaagagaaagaaataagtcatccaaatgggaaaaaaggaagtcaaattattcctctttgttgatcatataattttatatctggaacaagctaaagactctgccagaaaccttttagatttaataaatgaattcagtagagtttcaggatacaaaattagcatacaaaagtcagtaacacttttatacaccagtaatgatctaactgaaaaagaaatcaagaaggcaattccacttacaatagctataaaaatataaatacttaggaataaatttaaccaaggagcggaaagatctctataagaaaaactacaaaacactcatgaagtaaattgaagatgacacaaattgataaacatcccatgctcatggatctgaagaactaatatcattacagtgaccatattgcccaaagcaatctacagatttcactacaatctgtatcaaacaccaatgtcattctgcacaaattagaaaaaacaattctaaaactcatgtggaaccaaaaagagcttgaatagccaaagcagtcttgagcaaaaggaacaaagttagaggcatcacattacctgacttgaaaatatgttacaaaaccaaaacagcctggtattggtataaaaatagacacatagatcaatggaacagaatagagaactcagaaataaagccatatatttacagccagctgatctttgacaaagctgtaggagaaagtataccctgttcagtaaatggtgatgggaaaattggatagccacatgcagaagaatgaaactggacctctatctctcttcatatataaaaatcaactcaacatgaattaagttaaacgtgagagcggaaactattaaaaaggctagaagaaaactctcctgtaccttggtttaggcaaataatttataacaaacacctcaaaagtacaggcaacaaacccaaacataaataaatgggaattaaattgaaaagcttctgcatagcaaaagaaataatcaatagagtgaagagacaacctattgaatgggagaaaatatttaacaactattcagccattatggaaaacagtaaggagatttcttcaaaaactacaaatagaattaccactcaatccagcaatacccctgctgggtatctacctaatgaaaagaaattagtgtatcaaagggatacatgtactagcatatttatcacagtgctattcacaatagcaaagatatggaatcaatctaagtgttcatcaacaaataaatggataaggaaaatgtatgtgtatgcataatgaaatactatttgaccttaagaaagaatgaaattggccagtcatggtggcttacacctgtaatcccagcactttgggaggccgaagtgggcagattacctgaggtcaggatttcgagaccagcctggccaacactgtgaaaccccgtctctactaaacatacaaaaattagcagggcacggtagcacacacctgtaatcccagctatttgggaggctgaggcaggagaattgcttgagcctgggagatggaggttgcagtgagccaccactgcactccagcctggctgacagagcaagactcggtttaaaaaaacaaaaagcaaaaaaaacagcaacaaaaaaaatggaatcacgtcatttgaagtaacatggatggaactagaggtccttatcttatttgaaataagctgggcacataaagacaaatattgtatgttctcacttatatgtaggaattaaacattttgatcatatggaggttgagtggaaagataacagagactaggaaaggtgactgcgttggggaggagagaggatgaagagaagtgggttaaacggtacaaacatatagttggaaggaataaattcagtgtttgattgcagaataaaatgattatagttttaaaaaatgtactctggtgctggacaccctaaatgccctgacttgaggatatgcattatatacttgtaacaaaatttcacatctgccccataaacttgtacaaaaacaacaacccagaaaagccctatgggtgtctagaaggagaaattatcaccaagcattgtataggccttatatgagagagagaattcgtgtgggtgtcagaagcaggcacacactggggcattggaatttaagcacagaggaagtagacatttttatgtgacaattatgtggaatataggattcagcatttgaacatcatgtaaaaagaataaaattaaatgttaagaaaatcaagggataaagcagttctcaccaaggaagttttcttttaaaaattctttcttattcattttctaatctgttttataatattaaagtaaataaacttccctgtgagggcccaagattaatgaaacctctaggccttgtatttgagaaaatcacatttttatttgatatttcttttagtatcagatatctatctcctgagggtcttggcgtaaatctaagaagaattcttccattttaaaatttgttatatattcatttattaaacctttactaagtcttactattctaaggcaattacaaaagctctcttcagtccttacctctctcttgtcttcagtactgcatacttgactgcctcatggatcttgccatctggatgtcaacgtgataatatcatcttttgtataggtagttgaatttggtttgtacatattttgttaatattcattactttgttgttttatccatgagagagattggcctttaagtttgttgttgttgtttgagatagagtcttgctctgtcacccaggcttgagtgcagtgatacaatcttggctcactgcaacctccgctccccagacccaagcgatcctcacacctcagcctcttgagtagctgggaccacaggcacacaccaccatgcctggctattttttgtatttttgaaagagacagggtcttgccatgttgcccaggatggtttcaaactcttgggctcaaacaatgcttctgcctcggcctcccaaagtgctggcattgcaggcatgagccgctgtgcccagctggccttagtttgtcatgtaatgtcttttttgaattttgtatcagggttatatgatgacctggtgaattgtattttgataatagtgtaactctaccatctttccttttttaatatttgcatgacatctatttctgtcttcttactttcacctttttttgatactaacattcgaattgtgtcatttacaagcagcctaaaatttgnnnnnnnnnnnnnnnnnnnnttgtgtcatttccaagcagcctaaaatttgattgttaaaattcaatctggcactcctttttcttttaattagagtatttacttcagtaatacttggtgtaattactgatgtatttgggtttaaatctacccaccatgtttctgtttgttctctatttgttcaacctattctatgttcctttttctctcctttattgccttttaaaaattagtccatttcttcatctgctctcttatttgttatacattattttattattcattttgaggttactttggtgatcacaacctacatgattgtcttaggaaagactaacatggccgggtgcggtggctcacgcctgtaatcccagcactttgggaggccgaggcaggtggatcacaaggtcaggagttcaagaccagcctggccaacatggtgaaaccccgtctctaccaaagatgcaaaaaattagacgggcatcatggcttgtgcctgtaatcccagctactyggaggctgaggcaggagaatcgcttgaacccgggaggcggaggttgcagtgagctgacatcacgccattgcactccagcctgggtgacagggcaagactctgtctcaaaaacaaaacaaaacaaaaaaaaaaaaaaaaaggaaggctaacataaattagtaattttacctcttccaggacattgtaattgcaaggaccttggatcatgttaactacattaattctattctttccttttgtgccactaccatatattttaattccacatatatattgaactcccccaaaattattattttgtacagtctgtattaatctgtaattaccatatacttacactttccattgctttttttcccattttttcccatttttcccattcattgcttcggttgtatttgtgattattttattctgcctgaagaaaactgtttttaatagttcttttaatataggtctcctgcaggtgaactaactcaattttctttatcttagaatatctctatctgcctttaatttttgatggaaatttgattgttagcaatttttgtcttctggcttcccttattttagttctgactgttgctctcttgagtgtaatttatcttttttcttttggctgttcttagtaattttatttcctgttgtcttttcacattttactatgatggtcctagttttgcatttttgcttttgtatctatgtttatcttctttgtagtttattgtgtttctttaatctgtggtttgcaatcttgaatcattttggaagcttggccattgtttttgaatattgcttttactccattctttctttcctcttttttggaattctggtcatatgtatgttaggttttctcaccatgtctcttatgctttttttttttttttgtatmttccaaattatttccaatctcttcctcaatctgaatagtttctaatgaactgcgtttcatgtccctaattctctctttggctatttgtgagctgcttttaagcccatctatagaattcttaattttaattattataattttctgttttccatttggtctgatttttattttatttractgttttctatagagccatttctgggataaagttatctagtttgtcctctgtttycttgagtatattaaccagttatcttatagtccattctgataactctattctgtattctgtatgtctgtttctataacatattccttaagcttggtatgtgttcttatccttgtgtctgtctagtaatttttattttatttcacacattgttttttaaaaaattattgtgataatttgagagtcttgaaggtgccttcctccagataccacttaatgttgcttttggcaggcaattcatctaagactatgttaccctaatgcaataaagcttgagttgattggaaactgaatttcagtacttgtgtaataatctattttttgttgacctttctactagtttaatcccagttttagccctttagagccccatctgaaattctggggctatttcctggtcatatccacctggatgggtcctgaactctaatatttatctcctgtatccaatgaagctgccgaaagttctcctcagtttcttcagctctcagcatccgcttgcaaataagtaggccattagtggaatacctgctccaatgttgggctcacctgttttcacttttctttgttccctcaagtcttagccgtttttatagctctctgattccttcaaatgggtaattataattgtcttatctagcttttctagttttgctctctggaagagttggtctgatcaagttaaactgctgtaaacagaaatagatgtttccaaatgtattgatttttattgtttcctgggatacaagctctacagtcattggtactttattttctttgtatctcaggtgactagaaaagtgcctgacatttagtagaagctcagtaaatatttatttgttgtttgtttttatagttgagcactggacagtcttaactcctgagatgaatatgtctgcaactcagtgatcatgggactgcctattacatattagtgagtggtaaaggtttgggacctgctrgattgttattccagagtggggaaagattactccactgaataaattttaaaagggttactgagtgagagaaatataattgtgttttattatttctaaaatatattttgttaaagtcaatgtgtgagctacaaatgaatgactaaatcagtttttaaaaagtatttcttgaagggaaggaaggacaatggttagtaaagataatgctttcaaagtattacttgatgctaacatgactaggtctatatacacattatcttcttacagaacccttactgctaacatgctactctctcccagattatcatgtattcacctttgacagacccctgtgccacagactcctatttggtctctacccagatttgtatttctggcacgggaaccttgccctttagtctacttaggagttgtactgtcaatcaccaaccgacactgcatgtttctcttagtgcttttaaaaagaaactaccttgtaacaataaaaattctcaatcagcagcagggaatctagattagaggaaaaaaagtacagtttctccttcctaattacaaattaactcctaaatataaaaagagtatgatatattgtttataaaaatgcttcctacaatttttctcttttctgtatgcattccttgcataatgtctatcaacactttccatcaagaggtgaagtctgttactatagcccttgaatctgaactgagctatttgacttgccttggctaataggatattagaaaacagggcacagtcagaaactttaaaagttctggtgcactgggattgccctacattgttactttgaaacaagaccactcttcctttggaaaaacttgggctaacctgctaaatgctggagacatayggtccattcatcatctttaccccaaccagcttcccaatgtgtaagtgaggccatgtggaaccaactaggcctcagtcaacccactatcaaaagaatcaccaagctgagcccaacttagattgctgacccatagaatcataagaagctactacattttatggtagtttgttacatagcaaaaattaagtgatccagagagaatcatgaccatcattattaatcattttcatggaccatttttatgtttttctcagttgtgtatgtctgcattctacatttgtttgcatattatggtagtattcattactgtgcttgagattaaagatgtataattacttaaagcctttatttaatactattggttaggctggaagagtgttacatcctaggaggataaacgaatagatgtttttcttcctgtgctgtctcagaaagttagttccaaattcaaagtttttcttgaaaatttgtgaacagattttatatttttaaattgctttatccagcagccctgattctacataaataagtcttctgtctgtgaaataaaattatttattcctggacagcaaaagtacccttttatatcaagcaccttagaaaccatgggaattttagatttctgtagccaagatggatgagcacttattaactacaggatgcccaaccttgtgagtggactgatttttataatttgtgaagcaatttgttcttaactcctcttattagattgtatgccgttagaagaatgatgaaggtccatgttccatgttcaattctaataagtacacagtgaatggtagctattcttgtatcactcagtctcagatatatactagagcaccttagtcgtttatagcaaaatagatttataacttgtactacaagtgcagatgacttgccagtatcaggattaacaatacttattacagtcagagaacctcagaaatggctgcctacaaccaaggtattgtttgcattctactgctgcgtccgttgacttttagtggggttggattgagaaagtgttctcatttaaaaagtgttctggatcacaagcaacattctacttacatcctggagaacacaggatgttacttttctgttacttttaacacttgtaaaatgcacatgcaaaaatactgaaaattaaagtgaaaggaaaaaggaagaatggaggaaaagaagaagtaaaggaaagaagagagcaatggaaggggagtgggtgagggaaaagtgggcatgtaatctgcctatctaggaaaattagcctaacgtaattgcatatatgagataatgagcagagtctaaagttgtggctgagttttcaacagttggtaagcaaacttcaatgatgtttcctttattcagagaacaattcatttctagaaacacataactgatgtagcatcagaaaactctgtcttaaacacatttattttgtggtggtgcatcatttttttatatactttcatacttgtacattataatgttgagctttgtaccacaatgattattacatctttgttatttactcatagtgagttatgaaactatatgaatattttctgttaaacagctaagcttgaggacatccaagaatgcaaacatcctctataagatcttatgtttatttttacaagtacattagctgtaagcaggataataactataatatctaaggaattaagactggacagtagcgatttgttataggcttttgctgcagtatgaagaagatttctgtagttgaagataatccctgaatcctaaaaggactgtagaaaatgcataagacaaaaattgtacttacatttaaaaaaatagcaaaactgcccaagtacagtatggaggaaataggcttagcagcagtgtacatgaaaaagactaaagggatttaggcaatgtaagtcaacagtgtgaaataaattctaaaactaatttcatcttgagcttgagctctattaatataactagaacaaggggagcaaggatttactttattcttgctgatcgttatggaattcagatctagggacataggcagactggaacacatttagaaaagagcagccagcatggagaatatttttttatatggggtgtggctaaagaaacaaaatatacatggtgatatggtttggctctatgtccccatccaaatctcacctcaaattgtaatctccataatctccatttggcaagggcaggaccaggtgaaggaatccagtcttgtaggcggtttcccccatgctgttctggtgatagtgagtgagctctcacaagatctgatggttttatatgcatctggcatctcccaggcttgcacttactccgtcctccctcccgccctgtgaagaaggtgcctgcttcccctttgccttccaccatgattataaatttccttacaatcatgagaactgtgagtcaactaaatctctttcctttacaaattacccagactcaagcagttctttatagcagtatgagaatgaactaacatacatggtttaaagcaagcttgtccaacccacggcccaaagaccacatgcagcccaggacagctttgaatgtggcccaacacaaatttataaactttcttaaaacatcatgagatttttttttttttttagctcattagttatccttagtgttagtgtattgtatatgtgacccaagacaatttttcgtcttccagtggcccagggaagccaaaagattggacacccctgctttggagtaaagaagacttaaagaacatgatagctatagtagttagcatgttttcaattacaagtaaaatcataacccatcaaagtgttttaagtaacaaagataatttatgggttcttataacttaaaacttcaggagtacattgtattttaggtgaggctcaattcagtggcctggttaatctttctctctactttgctttctatagtgttggccaaaattggctggcactgtctccttccttgggacaatttaactgctggtttgctagcaataatcagagctgtgtgctgcttctttcatatcaagcaagtgttagaaaaaccttctttccccagtagctcgatggaaaaaagaagaatcttctttcccctgaccccaggaagtatctcttgtatctcactggccagagttgtgacttgtgccaatttctkaaccaattatagtgggccattgggataatgtacacaaagtagtgtagctaatcaaaaatctacctcttgagcagagatattatatctatcaggctactaggagaaacagaatcaataagaagtagataaatatatatatatgatatcttattatatgaagaaatttatttcaaggagttaactcacctgattgtggggtctgacatatgtgaaatctgtaggacaggccagcaggctggaaactatctggtagaagctgatgtcgtggtcttgaggcagaatttcttcttcctctgggaaacttcaggcctttcaactgattggatgaggcacatctacattattaaggataatagcttttaattaaagtcagttgattgtagatattacacatatttacaaaataccttcatagcaacacataagttagggtttgattaaataactgggcactgtagcttagccaagttgacatataaactaccatggatgtgatcaatctttcccaaaatatgtaactgaaattatgagttccttttagaattgacagattggaaactaaggtagccaacaaatatcctttacagtagctaacagtacatgtatgaaaggctgctctggggaataggttttcaacttgcttgacataggggagtactagggacaaaagttatagaaatagtgataaaatagctatcaagtaaaaaagaactgtttaacaaaacagtagtgagttcctattactgagaatgttcaaacgtgagctgaggactgtggtgtaagaccccagattaaggcctagttattatgtgttccttaacttctggggaaagtagtgttttgcttaagtggagttcactagaaaacaggtataattttattttactcatattaatatcaaatagtacctgagatattatgtctgtcaggattctccagagaaacagaaccagtagtatgtacacacgcacacacagactatatatatatgtgtgtgtgtacatatatatgtactctccgcactatatatacatgtattctccacactatatatatatgtactctccacactatatatatatgtattctccacactatatatatatatatgtactctccgcactatatatatgtacatatatatgagtgcatatatatgtacatgcacacacacacacacgtctcactatatatataacccatatatataccatatgtatatatatagagagagagagacaatgtgtgtgtgtgtgtgtgtgtgtgtgtgtgtgtgtgtgtgtgtgtgttcatgaggcattttatttgtaaatttgtattacatctctagaaaaagaattgcagcattttccctctgtgtgttttcttcttgcatcttcgtggtccatgaggccggctgaggttgtcattacaatgaaaccaaactggcaggatggaaacagattattctgccatttttctagatctttgagttgtacatcaaatctgggggctgatcactccacacttgtttagcctgcctgtgaggttcacaacaattttcctagcaatgtgatcatcagtgatttcagattcgcccatgtaatcatgctgcatcatcacattgagaaaccggacaataacttcggagctcggcctaataagaacctcatttgcctctctttctggcattgttgatgctcttgagagcatcagccaggacatccatgtgcaccattgtggtggcgtggaaggagctataatttatatttttaatatacatatataaataaattaattttttctcaaatagcctagccacaagtttctctccccactgtattcttgcagataaggttacctagccaaacaaccctttttatcaaggggatcaggcataatttttgcttatccctcattagcaggttcaattcctgccagctcaagggattatccaaacaagccaatcacattcttctggggaccagggggcaacccaacctcttaaaatctccttctcacagcccctggttttgcagtctcttcctgagtgcaacccctatgtgaccctgcatggcaagtaatgtcttcttcccttcggctgggaggggaatatatgtgattaataaacttttgactcagaagacttgcatgcagccaataaacatatgaaaaaagctcaacatcactgatcattagagaaatgcaaatcagaaccacaatgagatatcgcctcacaccatccagaatggctgttattaaaaagtcaaagaataatagatgctggcgaggttgcagagaaaaaggaatgcttatacactgtagtggaagtgtaaattagctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcagcactattcacaatagcaaaaacatggaatcaacctaaatgcccattaatggtagactggataaagaaatgtggtacatatacaccatgcaatactaagcagccataaaacagaatgagaacatggcctttgcaggaacatggatggagctgtaggccattatccttagcaaactaatgcaggaacagaaaaccaaataccacatgctcgtggttataagtgagaactaaatgatgaccacacatggacacatagaggggaacaacacacactggggtctaccagagtggggagggtgggaggaaggagaggatcaggaaaaataactaatggatactaggcttaatacctgggtgatgaaataacctgtacaataaacccccatgatacaagtttgcctatataacaaacctgcacatgtacccctgaacttaaaagttaaataaaataaataaaataaaacaaacttctgtttcatctggccagtgttgggccagatgaaatcctgtgtttggccatattcacaacttagaattggaatccctctctcaccaatggtatatacaggaggtagttaaaacaatgactctcctttctgtccacttacacagcagtgatgttgtattggggaaaaattcaaatatcagttatgtgatagtaacaattgacttgtgagttgcctttcaatagcaagattctgttatttctgtgtttccaatgctagtattagcattttaattttcccaataagaacagggcaatttgttgattattctgttagtggcacccatcagattattttgtaaactgtttatacatcttttcctctcagctcaaagtacagaaagtcatgctttattaatctttatgtacactccaaataacataatgcctgacccatagcaaatattcatttactttctccattggaattgtatttaaaaattactaatgagctgttgaagttcaccttaaacaacataccatgtaagtaaatatcattaacgtaaattatccaacactgttgaaatccaaactcactctacccacctttagacagagggaatgacatcttgagagcattgcccaattttctcttctcattcaccttccaaaatgcatgctagttgccttaaggcttctgaagaaccataaaggcagcatctcactttgtgtaggaagaagaattagtatagctgcaaggtgatcccaattcctgcctgtctgttggttctgaatgctccattcacttcagaatccctgctgagagataatacattgcttcagcaagaaggcatttattttagtcatagtttcattcctcaagtttatagctgcatagcaccctattctaatttataggaaaaacatggagaaagctaaaatgattggtttgaacatatttgacatcttttttatgatttatattatagtgttgtatttaaattggcttactcgttattcttttgatagaatgacatatgcttttttctctacccagagatttaagaaatttttaagaaaatatgaaagacctggtttgacataggaatttttctaacttatgaatatattgtatcccttcacaaagatatacaataaattgtgtttatcagcagtaataaaattacattaaaccagctctggtgtttgaaacccaagatgtatagtttccatatccatgtctttatacaacactaagcactcaataaatatatatcggttaaatcatgtaataatagaatgtgctcccttccattgatcatagactttagaaagacttcaatctaacagaagtgttttctctatctcctgggtttactcacagtaaacaaatccgagctatgctgggccagttcagccagrcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtgagtattcataaagcatttcatctcacaacaagaaatcaatttgtcaaaaacactctgaatttaatttttttaagactacagaatttccattacatgcctacacctaacactaccaatacataataaatcagtttgtttcatactcattatacacatcagtatttctctggatttgggatttttaaagaaaaacaatgattgcctttacacaaaatagtgaagaggataactttcatactgattatcttttttacttacacaatatgggttttagagtgttaaccaatgtcagtaaatatcatgatactgcaacaacgatttcatttttttgcatgcccaactatgcctcttgtgagaagcaaaaagaactacatatatttaatgcatcctcttttagcatacagaaaaaaaaaaaaggcaagatcctagaagtcagtaagtgtgttttgtcctgtcttatgcagtcactttgtttgaaccttctccagagaaactgtaatttatgatatgatatcaaacacagtactataataagatatcttttacacctcctcttcctggaaatactagcatttattctccattattcaaatagattagataacacaaaaacaatcatattctaggaaagtgtagaaataattcttttctttttttttttttttttgagacagagtctcgttctgtcacccaagctggcatgcagtggcatgatctcgcactgcaacctccacctcccaagtttaagcaattctcatgcctcagcctcctgagtagctgggattgcagacgtgtaccagcatgcccggctaattatttttgtattagtagagacggagtttcacatgttgtccaggctgatctggatctcctgacctcaagtgatccacttgcctcagcctcccaaaatgctgggattataggcgtgagccaccattaccggccaacaatttctttatattaattgtctaaattaatgttaaaagcttagattaggacctgtgtctattctcagtactgacctagggaatggacagcctatacctgtaaaacttaactgtggttttttctctcataccatgccccaccacaaactgctttgttttgtggtaattattcacatatagcctttttccctatgttgtgataygacctgttaacttggcttgtgacctgtagttgttgggactctgttgttcctaagtgttataccttcttttgcacatgttgttggtattcacagaatgaagaatgtaattataaaagaaaataataaaaatcctttaaaaacaagtaactaatagtaaaggtgaaatacagtctcatgtgtggagatggaggtggttgtgtagaggtaataaaacatcaagccaatttctgaaatgcaatgaacaaaacttctagttactagtagtaaatcccatattgttagtttaaagacttatcagcaaattgtagtttgtgaatcagggtccctgtggttttcccaagagcttgaaaataacactgacactgagaatttaaaattaatacctaatggatgaaattagagttaagtaaatatatcttaaaatgttgaatggctttcaggtagatggtatagactataacttaatcaaaagatttttttttaggagaatacatttatttattatttatttttattttttattatactttaagttttagggtacatgtgcacaacatgcaggttagttacatatgtatacatgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatgatgtatatgtgccacattttcttaatccagtctatcattgttggacatttgggtcagttcccaagatctttgctattgtgaatagtgcctcaataaacatacgtgtgcgtgtgtctttatagcagcatgatttatagtcctttgggtatatacccagtaatgagatggctgggtcaaatggtatttgtagttctagatgcctgaggaatcgccacactgacttctaaaatggttgaactagtttacagtcccaccaacagtgtaaaagtgttcctatttctccacatcctctccagcgcctgttgtttcctgactttttaatgattgccattctaactggtgtgagatggtatctcattgtggttttgatttgcatttctctgatggctagtgatgatgagcattttttcatgtgtcttttggctgcataactgtcttcttttgagaagtgtctgttcgtatcctttgcccacttgttgaaggggttgtttttttcttgtaaatttgttggagttcattgtagattctggatattagccctttgtcagatgagtaggttgcaaaaattttctgccattctgtaggttgcctgttcactactgatggtagtttcttttgctgtgcagaagctctttagtttaattagatcccatttgtcaattttggctttgttgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtcatagattcaaacatgtgcaatgctaatccaagtggtatatgtttgccttggctaatccaggccaaaaaatgtggcctgtcaattcctgaaaggagatgtatccctgtgatgaagacggatgcaagagacttccttaaccagtcgccatttaacactaaagtcttaaaacatagtttattctctgctgattccaatttcaacagcagctttcagattatagtaaggtttctcatgtagaagcaatagaaagaaattcatagcttcaagaatttgagagtctagttctgttggcagttatagtcttcactggaaggtaattaattgtgtctgtattttctaagtttagtcactgtaagtcagtgaactctggaggactgacaagatcaaatctattagttggggggcagctcttggatcttgactccttgaccacatgaatgcctattctgaagctgtctagcagcctgccaaaccttccagtgttgcaccttttgcactgtagcactatggaaacttctatcattgttaatatagagtaaaataaaattatatgtattgtccaattatttatttagagtaaaattatgtgttgaacaaaatactttttaattttcttattttaacatagaaaagtataattaaaaactgctaagtacatccatactcgtcataatattatcttggtaaagctggactgtatcccatgggataaatttctaaatttcacatcattaacacagttcattcaaatgctcagtggtttgagcagctgaattcacaaataggtcagttttagcagggatttttgtcatttaagccacgaattatgccttgcaaatttatgaatggggaagatctaaaggacagtggcatgcattgagcatcttttatgttccaggcattgtatttctgttttacaattgtgtgcaccaataattatccaaaccattctgtgagttaagaattgttactttcatttcacaggttaaaaattgaggttctaataggttaaaagtcttactcagtatgagtagcaggaccaggattctaatccagatcaattgaactccaaggaccagatcttcatcctgaaagctgaaagaggtgctggcagcctactgagatagaaatagggctaccttacaagacattcattgttctgtgagtttaacggcagtccgacataaaaacaattattgtaagctactcgggaggctgaggcaggagaatcacttgaaccctggaggtggaggttgcaatgagctgagatttgcctttgtactccagcctgggcaacaagagcgaaacttcgtctcaaaaaaaaaaaaataataatctgaaaagcgaggtttggacaaaaaagagagacaaagagacatcaagagagatgaaagtcatgacaaatcgggggataagccaaagacagcaaaaagattttctcctagaggcactaggcttaacagtgtatattttagtatttttaaggagagtttcaggtgtttgttggcaaccccactctggttggaccctcagttcttaaagctaccatacccttgttacttacagatcctcacagtctgttaccaacaatcaatccagcatattaactgtaagagcagtaactgcaccattagcaaagctatttttctaatacgtaaagtcataattaactcatcacttagaattctttggcccatttccctaaggtaaacagggaatggtctgacagagtaaatgctgtttctgactatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagaagaatgaccaaatattgttaaacatttgaataatatgtatcattgccattaaagttgtatgagtttttgtgagggaaactgatcagcagtatgttttttatagatttgctaagttcaatttgtgtctccacaagtaatcagttattttacagcctcagatttagtcaagttcttgagttagactttttaaaatatcatcagcaaaccttgtatcttccatactgcaaaaaacattcaagcagtaatttaaattttgaacaacttaaatctaaccatttttcattgttttagtttgagaaaaatacacaggaaataaaaatttctttgtgaattaaagtttaaggttagtatattttgacttcctgctgccttgaccttgatgaatgttataaaccatcaccacttgccataatgatgggtagttgaaatagaaagtctatttcatttgtttaaggtttcagtttctgactttaaaacctcacttctcctrgagtatgtgtgtgtgtctgactttatgtctcagtactctgaagtttcacgtcttgtcaatgagaactgatgtcagtgaactaattggctcttcttgtgcgtaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggtagcctcattaattctcaacagtgtctaagagaaaaaattatatttacatgtgtgcatgtgtttgtgtgcatgcacgcatgcacatgtgtgtgtgcattaatcccccagactccctgagggattcatttgtacttgaaatccaggatagaatcttgcctatccttctctaatgtcagctttcttttgcttttgcatgcttctcccccaaaaaacctctcccccaaatacaatttttaaaaaaatatactgtagtttgctaatttgtataatagtagatttttattttacacaggataatttatcatttgtgtctaccaaggtgaaacatggaatgatgagcaaaaggatttcttgatccatcgcagtggttgataagcacctgtataagatctgacattacttctcttagtttcacatttctgcattttaatattttgggcaaaaggagaattgcattgcccaaatgctaaaataaaatacagtgactcatatatctgttctaaacaaccaactaacaaagggtatatgatgtataggttattccactttgtgaatgctaactaaatcagccttaggggcttattgaaacatttcatcttttctgctatttcgctattcaccaccataaacctcttgaacctaactctagctaggaggcgctttattatagcctctctgtttgaagccaaagttgtttcacagctgtgttccgtgatgaaagttttccaaggcaaaaatataactcttgcagttatttaacagaattccaatggtaaaattttcatcttgttgaaccatctgaaaccctgtatcatttttatttaccaaatgtattaagattttttttcagtggttcctattaaattacttaagtaaattttaagaagtttttaaaaaaggaatatttgtgtaacttataaatagaacctgatattggctgtctctttcttaatattatccatagtttaagaagtaaaacttaattataaattcatttagatcattactatttagagatcacatagcaattgttttatgatataattaaataagactatattctacttagttattataatgaaatataaagagctgactagcctttaattttttaagccacatatctcagggccctttgaacttaccattgagatttctttaggcaagtttaagagcagaattcttgtggttatatgaacataaaatatttcatattttcccccctaaaaaagtgtgtataccagcatgccgacattaaagtcatcccctgtctggtgttcctttaaccactccgtactcactaacatgtctccaccgtatcctttctgtaattatttagctatgtgttattatctgtctcccatattggaaagaaaagcagtgagaagtgatatttttttatttataagcaaatctaaaattggtgctgaaaatgaggtgttggggctagagagcatcctaaaaattgtctagtcagcaaacctcatctgattactaaggaaactgaggctcagggagggtcaatagcttgcaatagtaatctagaattcagaagctcatgaatttaaggcataattgggaatctgcctttaagctaccttttctgtctgtgcatcctactttgtaaacttgcggaaataacactttggcattaagtagaaattatgtgaaggtgtacaataggaacaatttaagtaccttcagaaagattatgatatgaaaagtacattagagctatgagaaatgatacagtaaaagtgaaaatattcatatatggtaaataaaacctcaatttagtaaatgccattgaaacattgagttatctggaattagtccatttttatgtcttaaatatcagtctataataatacaactttattaatgataatatgaatttttagaaaagggaaaaacaaaaatgtgttttcattttgtgctcatttattcaaaaaatattttgagagaggctgctttatactagctacttcctaaatactaaaggtaaaataggagctaatcagatacaacctctgtgtttacaaagtttatagactaatagattaaacagtcagggaactgagtgaaaacatcatataataacctctacttacagtgaaaattctctttcctatttattgtgatcaagagttatgatagtatggtcaatagaaaatttgataaaagcagataactatagaacctataaaaatatacatatatttgtatgcttgcattttaattgcagttccgtgaagttgattcttaacaaaccacacccatgacatatgtcctataagttctggttatagttttagtaaaatgaagtaagcctttaaaggcatttgcaaagccatctgaatgagaagtttttctagattttcatgattttagtcttttataattgcctcattcatacctaatttgattgaattttttttaagtgattcacctttaacaagagtttccaaagtttccaacttagttttcagggaaactgcagctgtctttccttttgcattcatatttcatcagtttatgtaatatgtaattaaattatgtaataacaacagtgaacattctgggctgtaagtgcacagctctcttgatgggactagaactgtatagaaataccagagaatccaaagaatagaatcctaccctcacacaatttgtttaacagagaaaagggttaaatctgtccagtccaataaatcaakaggtactacataaagaaaatatgagacacaattggaagggcacaagttcctgtatgggtttcctcgggctgctgctactaagtactacaaactttgtgccttaaaacaacagaaatttattattttacagttttggagacttgaagtctgaaatcaagatgttagaagggagctagaggagaatccttccttactattcctagcatctggcggttgccagcaatccttggtgttccttggcttgtcgatatatcactgtttctgcctccatagtcacttggcattctccctgggcatctgtctttgtgcccagatttccctcttcttataaggacaccagtcatgttggatttagggcccacacttaatccagtatatcctaatcttaacttgattatatctgcaaagaccttatttctaggtcagatcacatttataggttctgggtagacatgaattgtgctacgtagacatgaattgtgggggactctataaacccagtacaattcctaagcaatatctttgtttgacaaacatgtattttggcaagctataatatgcaatgactatatttaaatgtgttttctgattctgataaattcatactaaatatgttcaaaactatcaagcactctaggaaatatgcagcacagttccagacacatattaaaatccatattgatggaaatataaatcactttctttgctttccaaaaactaataattcagtaggacaaggaagaacaacacacttggaatcacacgctcagtaggatcctgtaagtcacgtgattaagctgttaattgtaaaatctaaagtttggtgcgttttgctagtataaataactacagttccagtactcttccatatcatgggaattccaaaagacaggttcaagactccaagttggaacagagcacttacaagcattgtgaattactttgcaaattatcaaagcagtaatttataagcaacttacaagagaattccaaaaacaacctgtaggatttcactgttcttactaccacacatgttcatacatatgctattcagaactactggccgtgaatcttaatataaatatttaacacatatgcagtgttatatacagtgttccctccaaaaatgattcataaataacaagtccacattttgttaaacaatgtttattctaatgttctagctaaagagttggagttgtaaaatctaagagatgaaaatggcctaagggactcatctaatctagaactagattcttcatcacctctaataaatggtcatctagctttagcctcttcatcttcatctctcctactccccattgtattccggtgaagacgagcacatttcagcctgaagttgccagttscataaatataatacaggcgtagagactttagaaaggatagatttcttagaataaaagcaaaactcctttacatggtttgcaacttcctccatgaactggctcctacctgtcttttcatcttcccctttccacataatagtctttgttccagccatattgaagttcttatagtctttccrgcacaccatagtcattcacctgcaggccttggatgtccttctgcctggaatattgaccttcctcttctctcatctccctgccctacccctacccttttctctggctaatttcagctcatcctttagagctcagttgaaatgccacttcctcacaaagttttttccaactttactcacattagttgagatggtctcctatgtgctaccattgcactgcattcccttgtctggcacttattatgctgtatcttattgcttgcttactatttaaatattcccttagatttatattgtgcaacaccattgtcaacagccacatgtggctataaagcacttgaaatgtagttactccgcattaagaggtgccatgaatctaaaatatgcaccagattttgaagacttagtttgaaaaaaattataatattacaaaaataattttatcttcattacatgttgaaatggtaatattttagatatattaggtcaaataaggtattaaaattaatattttgctttttaaatgtggctatagaaaaatgttaaataacatgtttcacattacatcttttttggacagtattgttctagactataaacatcaagattataagccctgctgtgacttttgtactaattactgtgtcatagcatttagcctaatgtttgacacctgaaaggtatttagtaaatacattttttagaattttttattaaaaagctttttttaagtgacagggtctccttctgtcacccaggctggagtgcagtggtgcaatcatagttgaaggctgcagtgagctgtgaggatcaagctgtcctcctgactcaacctcctgagtagctgggactacgggtgcccaacatcacagcaggataatttttttaatttttatttttagaaataaggtctcactatattgaccgtgcttgtctcgaactcttggcttcaagcgatccccaacctcctggctcagcttcctgagtagctgggattacaggtgtaagcaactgctcctggcaatactttttcaatgttaatttatacagttaacaaagtgcacattcaatcagaaaagctctgcttttagaatgtttggattcagtaaaataacttcaacgttaattttaaaaattgatgttcagtcttgtaggtcataaaaagcaaatgtcctcttaaatggtttggctctgtgtcttcatccaaacctcatcttgtagctcgcataattcccatgtgttgtgggagggacccactgggagatgattgaatcatgggaacaggtctttcccgtgctgttctcatgataatgaatgggtctcatgagacctgagaccctaacacaagctctctttgcttgctgccatccacataagagatgacttgctcctccttgccttctgccatgattgtgaggcctctccagccatttggaactgtaagtccaattaaacctctttcttttgtaaattggtcagtcttgggtatgtctttatcagcagcatgaaaatgaccaatacgtcccccacaacattaacactaacatatgcaggtaagttaggaaaactacattgccctctagtactttattcatctttgtaagttgaaatgatattaattcccatcttattctttaagaatgctgtgaagaataataatgctttgatagaatatttttattaattaaaaatccttcattatgatgaatgacacatataaaaattctcaagctcttcagaagaaagaaaatttatgcacttaattttgaaaaaatggccatggtctggattttgcagaattgatrtatttgatgtattgatgttttgcatagtcttaaaaatgagatagattctagacatccctttgaataaagaaatctgggtattttcctcaagaggctggctgcccatattttatatttgagctttttcgtattctagcgctcttttcattctccggttacatcaaggaaattaccagttaaatgctaactagtttaatgaaaacatctttgttcaagtcctggttcttcaacttgctgtttgtgtaaacttgaataattctagacctcatctttctcatcttaaactggaggcaaataatagttatgataataatcattaattttctttagtaaacataaccatgccaattatgttttgcttaaaccaatgttgaaattcacttgtagtctcagagctcatgttaaaaatcaaagaagtataccagtcacttttcagatcattgagatttaggttaaataaaaataaaataattgataaaatagataattgatctctaaacaatcaaaaggtgacagaaggcttataattatttgaatgagaggagggggagaaacttcttagatatttgtgattcatgttgattaaatgtatagatttattcctttcctgaaacttttgtgtaacctttattctgactcataaactgggtacataaccagagattaatgaatgcttgttgaacaaataaatcaataaaaggatacgtacattcccagccaaagtaaaaatgaaaattcaaggggaaaaaatatataagttcttaggtgttactgaggataaactgtactttttccgtcatgttgaagagggagacaacctgagcatcaaagtcttcagtataaattaaagcagcttgaggaataagtgagaccctccaggacatggaatcaaaaattctcaagttttgtttctgtttgtgccacttatttgttctgtgaacttgagtaagttcacttatcttctctgaccctcatttcctcatctggaaaataggaataacaaatcttgctatgactaataaatgacatttattatctgtgaaatttaaagtgcaaatattcttgtaagcatttttttttctcctctgtattcagagctaaggtaattcagacagtaaaggaatgcagtagttggaactcttgagtgtggacttccatttccaattctattttcctgtccataaccaaacagtgtgatttgtgatagattgatcacttcattccaagatgttcttcccttaggagttatgtgacttgtaggaaggagaagaataattgtctttttctgcactgggacatgttaaggtatatctttccacagtggcatcaatggctcatgcctcaacctgtatctgaaaccatcatcttttttcagcatcattttgttaatccagagagaaccttcaaaataaaagataatgataagataaaatttatgccaggcgcagtggctcactctatactgcaagcactttgggaggccaaagcaagctgatcttgagtccaggagttcgaaactggcctgttcaacatggtgaaaccctgactctactaaaactacaaaaattagccgggtgtggtggtgcattcctgcagtcccagctactcaggaggctgaggcatgagaatcacttgaacccgggagctggagattacagtgagctgagattgtgccactgcactccagcctgggtgasagagtaaaactctgtctcaaaaataataaaataaaataataaaatttattaagaaatagtcattatcttttagttggaacataaacttattcctgatcaagataatttgacatccttttattgtttaataacttacatgttgcttccttcatttttctcaaaaaatactctttatactaacattgctgtgattaagaaatggaaggaaaagtgttagagtgttcagttttcactctgatggaaaatggtatggtcaaacctacagttgaatttggatggctccccaatatatcatagttgtcattgccactgctatgaaaattacacttattcttttgtcatttcaaatttctcgaactcaatctattacacactgtatgtatagtgacatgccaactaaattagcaaatgacattttttaagtaaacttatgttttatttcttattttaataagtaatcctttcaaaagacattctgtacatgaactccaactcagaagggaatggaatgtggaaaaaaagaaagaaaacctgagtaacttttcctaaaaaagtctagctgttctcagtttgtggcaccaaatggggagcagggaatgttccagtcgcaactgactaattagcccaaccctaatttattgataataataatgataaataataatgctagctaacacttactgagcaaatactaggtattatgtgaaatcattttcttgtattaactcacttaatcttcacagcaacccatgaggctggtactggttttatccccatgttatggatgaggtaactgaagtataaaaagattaggttactttcctcttgtcaactagagctgggattagaagctagtaatctcattttacactctgtgctcctgattataacactgttctagatccctttcttatgattaaggtacagcagtgttgctggagaatgctgacagctcagtcttcaaggatgtcccatactcccagcactttgtatcttgtgataaatgctataaataatggagtcatgaacaaaaaggtatgagaacccagaaaaaagagaaatttatttttgtatagtgagaggttagacttaatgaagagaagggtcaagtagaagttatagacaaggagacctttgagttaggccttttaggggcagaagtgatgcctatttatggaagagttcctggcaactaatagaaattcatgaattacagacatgaaaagatgaatgaacaaataaatgaagaaataggtgggatttcagggggctgaggagagtagaagacaggcaattcagagtccgattctaggacctaatataattccaaattcctggaattcctcattatcttagaatcccctttcctaaatgtgaccttgagctgggtcagatttttgggacagtaatttagtgtaaccacgtactctagatcttcctgattctggatgaattttagactgcttctagggaaaaagagaaaagaaaatgcatcctgttacctcattgctccatttcttgttattttatacttttagtacttctgcaagtgaaaattagagtgacctgctggcattgtatgtttgatatagtagcagttttcacattgatattaattttgtgaagatatatatgactaaccaggccatcttttcctcctttttacttgttaaaagtgaagaaagattatttgttcctataactagttattcagaagccttaagaatttggtggcagatatttatctgaacgatccatttcagaatttagatcaggcagtcttacatattatttgtactgtcttgtttttgatatttacatggattcagatcttgtctaggtggcagatacaataacatgttctctttacttcacccaaaaatattgagagaatcaacagtatgcacctccactccttaaagtagtagtgtcacacatcagctattatatttgtatgtttcaggatgttctttgaagacaagcatatgctttcatttttaaagtttaaaatgttcaagttattttaaagaatgtcaaagagagagaattcccaattttaatggattgacaaagatcaaagattatatttttgggactgagagggtaataatggaagaaagagtagttttgatgtttgatgtttaagctttgttactaaaaatgaagaataatacttccaaatttttatatattgtatcttttgctttgtggctgaatttgaaaaattatggaatatctaggaaatgtgtttgttagaatttttaaaataggaatttgttaacttttaatatattttatatttcttataactcttcagttttgtcagaaatattaagtttcatcatttcccaaacattttaatttattgtatcactgtaatcttcagatgactgtatattgcctcaaatatttctaatcacttagaatcacttctactgtattataaactatagaatagatcacctctgtttacattttttgtgtgtgtgatagcatataacacacagtaaacaacaagaaatatttgctgacttcttacctctcctaatacataattatttatttaatgactttcttatcaattggactacaagactatatgaggggaaggattagatgtgtcttcttcattggtgcatcatcaaaacttgatatattatgtcttaaaatagatgctcaatcaatatttctttaatgaataaatgaatggccattttgttcatagttttgatgtttatacaatgagcttgactaggtacaactagtaaagaaggccttttaatcaactagtttctttagcatataggcacttgctattaggtagactcagacctacaaaaataagagaaaatgtaataattgtctttgcacttgtagtacctttcctattcttttaaatggtaaatcaggctaaatatgccataaaatacagggtcagtcttctgtaatttcagttttctcattagcaaagtagtgaatttgacctagaaacacctatttcatacacatattatgtatcgacttaaccatcaggtatttattctaagtctactttgtgctgggcactgatgaagatgaagacaaaggttttactttctaagaattaacaaaaaatgatctttcctagttacatagcagatgtcatagtatttatttggctacatatatatttttactgatttcttataatattttcatgaatcccattaatttctgggattaattttcctcctacccaagtacatattttaagatatcttcgatgaagataaagacacagacaaattatgagagtatgttgctacatttgtctaactgtatttttgttttgttctcgcttttgaatgatgcttagttgggtgtagaattgataggtttatgattattttcacttagtactttgcagatatcatttcattatcttttgacatctattatggctaatgaaaagtctgcttgtctttattttatagttattctttctgtttctctgattacctttaagatttttctgtcattcatatttaattgtgatgtgcttggttgtgactttgtttttatttgtccttcgtgaaacagaatgagcttctttaatatttctatattcctgaaaatatcagactttatttctagccatacttttttcctcccattctctctactcctttgcaacacttagtttcttgtatttcccacgtctttctatctctgtgttataatctaggtaagatactgtactggttcactcttaaggtatatctaatctgctgtgtaacccatttgttaatttttttaattgacacagttccactcatagaatagactcctcccaggattgtaattgtttatgtagtgcttcaaagaacagatagttcttgaaattagctataactgattataagtttcttattctcctttaaaatcattcagttatcttatatgagccggatgcaccctataatttgtcttttttagtaattttttgttgacagggcttttttaatgacagttattatggtatatcaccaaagcatgataacgtttagtttccccaaatctccaggggcaagaaaccactctctttccccactgtttaccatatgtgaggctgcattgaaacttcttcatcactaaagtgtctccccttagcaggttcatcagatagaaagaaagattagatagataggtaggtaggtagatagatagatagatagatagatagatagatagatagatagataggcaggcaggcatggatggcaagatggatagccattctatcaatcaaccaatagatagattgatcgtaggtagatcaatagatacatagatagatggctctggctcagacttatgtttccaagctgtactccctcatttgtagtggcctgctctgtatgtctgccgaaatttcatgtcaatactttaatctcaaaatgtataatgttgaaattttcattatcttctccaccaaaatcgtcttctcttcctggcgttgttgtccttacagtaatatctggcttccatttggttgctgccaactacctggctgatcacacaaatctcgcttttgactcgtcacaaatctcacttttgacaccccaccactgttgactgacaaacctcctctttaaactgttcttggttcccagctaacttgttttttctcttggtctatacctgcccaactgtgactaactctagtcctaaccaacttctacttcatctcttactatttagtgcctaatcctattacctttcatctttactaacatgggtacctttcactttgcatttttaattattaccattgagtagtattcttttgcattgctttggggatcttggagcataccccgcaacccatggtccagatttttatcaccatcctctagccaagtccagtttccctaagtctgatttctcttttgccaataattgactgttactcaagacaaataactttttctctctggttctcgtttattttctttcttgtaaggggtaagtgtattattagaccattcaatctcctgcgttttatgatgctacaacagcattttcctagtctctgggatggaaacttcagagatatccctgggtcatttttttctgtgccccccacacacaatttttcatttgatcacttaaattctgtcctgatggtggctcttaattcagtcatctcttgtaaatatccaccattaccattgttcatctgttatttagactattacaatagacttcttagaggcctacccacgtctactttttccactcagatccatctgcattacacatattttggagtttctacccaacccatatcttcttcccattgaatttaatagacccccccatcaactactgacacctggtaaagaaacctaggcacctatgtttataccactttactccagaagcaactaattggagagtcatgtaaattaaatacttctctcaaaatgtgagccaggaaacttagaaactataagtagatggtactggaaatatagatttggggacagaattgcctcattgtcaatccaaagcaaggggaaagtcagagttaggaaaactgggaaccaagagcagaatgaaggcaattagtttgaggaaagaatgaatgtctagaaaatggaggaaatgttcagaggtacacacacacacacacacacacacacgcacgcacccatgaatatataaccaaacccaggcgtgcaaagaatgcttgtctgattgcttctcaattccctaaaggcctagtaatatttcctgcagttggctttctgtgattcctatacctccttttaataattttttagaatcttaatgaatgggctttattccattccttaatatccaaccaattccctaagatatcacagctttactaattacatcatttacttgctcaaaacatgcagtgactccagttacggatacatttgatcccagactcctgagcttgatttttgaaggcctattttctagtctgagctattcttttttcatattttctgatattattctacattctggcttaactgttctgtccgtttcccctaaacatgtcttacattgtatttcatgtatctttgattgtgatatatcttccacctggaaaaaaatctctttccgtctccaccagttgaaatattttcatctttaagacctagcttaaatgctgctgctgctgctgctgctgctgctgctgctgctgctgctggtgstggtggtggtggtggtggtggtggtggtggtggtggtgkgtgtgtgtgtgtgtgtgtgtgtgtgtgtgtgtgtgtgtgagagagagagagagagagaggaagagagattccatccattatttcccaagttgggcatggtctttgatttaaactagcacagcagtttgttcatcttttatcttcctcttggcaatgtggcatggcaggctttatacagtcagaaagagcagcaattaaatcattgttttgctacttaatggttatgtgactttggaaagttatttaatcctttctctttctcagtgagagaatcaggcaataaatattcaaatcattcaaataaatgtgtaattatcaattttggaaatgtcatgaacaagtagtacagggagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcattcatgaggacagtctcatgacctgatcatctcttaaaggtttcatctctcaatactgttaacattgggcattaagtttcaacacatgaactttggggaacacattcccaccataggacttgttttttttttttctttccttttaagccctgtcactctcgtattattagtcagagttcatgtctctgttttctrttgtatcactgagtaatagaaaaataagttagttttggagttatacaaaaacctaggttcagattccatctctaccatttactagctttgtgaacttgaacaaatgacatgactattctaagcctctctaaaataggataatggtttctaatttataagattattgtaatgattagaaattaccttttaaaactacctatgctagttctgggcacatgataggtacttgacaaaagaaaaacaatataagaatttaccttgtctaattgttgataaaatctacatcacaaacacatgcaaaaataattaaaactcatgatcattgagatcatgaattcataatcataaagatcatgaattcataaatatgaattcattattaataatcaatgattaatgaatttatgattcagtaattaaaattcaagtttataaagtacaggatttttatttttctattataaaagtatctttgtttatatgtcatggaaaattgttaggaaattaaaaaaaacttaaaaacctgtaataccattgtacaactataacataaatatgctatcgcatgttaattttatctctttatttattctcacatttgttgtgttggagtgattggatgtatatagttttggatttttttacttactattttattatattacttaaattttatgccaatatactagatatcagtagagataccataatttattaacttacttatcattagatagttggcctccaagtgggagctattattaaaagctatataataaataatttgggcatatttaagggattttttttggaaggtggatattttctaagctaaagtctcaaagtgagattaatagcacatayatgcctttagcccttgaaacatgcttttcaaaatgtatacatgtccttctagaaaccaaaagcctttactgggcactatttctacagcaatttagtggtatagagcaggtaggaaaataaaagttggaggaggaagttcagtattgaatttggatgtgagtgaaaaaagatatctataatttatgatttaattaaaatccatttgctattggacatcagagaattgtatatgtaatctttaattcagtcagtctgttggtctttcaacaagcctgttttgagaaaaatgatgaaaacacatgacctctaccttctggaagcttatatgtcagtaggaaagataaatattttttgaagaacatttgtaatacagttgagaagtgttctattgcaggtaagtatgctacaggaaggcatgcmactttatcttcgagtgcaaggattgattatgagtatgtgctgatctcaagaaaaaggcagcactgttaatcatctgtgtgttaccatcttccaactctgggaagtgcatatggcccaattctgggatcaataatgcatgccctgtagaatattcataaagggttcaaataaagtattttgtaatgggtctcaaatatgctagaacctcctgcttagacttctgtatgtggcaaatgggcctcaatcactcgtgaaatatccagtaattaaatataaaggtgaccacctaaataggtaatgggaatcatgattcaatttcaggtatcccatctatgctgagcaaatgaagacataggtagttggtatggtttggctctgtgtccccactcaaatctcatcttgtaggtcccataattcccatgtattgtgggagggaacccagtgggagatgattgaattatgggggcaggtcttttccatgctgttctcctgatagtgaatgggtctcacaagatctgatggttttaaaaaacgggagatgccctgcacaagctctcattttgcctgctgcaatccatgtaaaatgtgacttgctcctcattgccttctactatgattgtgaggcttccgcagccatgtggaactgtaagtccaattaaacctctttcttctgtaattggcccagtctcaggtatgcctttatctgcagcatgaaaatggactaatacaataaattggtactgggattggggcattgctgaaaagatacccaaaaatgtggaagcaactttggaactaggtaaacaggcagaggttggaacagtttggagagctcagaagaagacaggaaaatgtgggaaagtttggaacttcctagagccttgctgaatggctttgcccaaaacgctgattgagatatggataataaagtccaggccaatgtggtctcagttggaaatgaggaacttgttgggaactggagcaaaggtgactctgttatgatttagcaaagagactggcagcgttttgcccctgtcctagagatttgtggaacttcaaacttgagagagatgatttagcgtacctgggggaagaaatttctaagcagcaaagcattcaagaggtggcttgggtgctgttaaaggcattcagttttataagagaagcagagcataaaagtttggataatttgcagcctgacaatgtgatagaaaagaaatcccattttctgaggagaaatccaagctgactgcagaaatttgcataagtaaggagaagccaatccccaagacaatggggaaaatgtctccagggcatgtcagaggtcttcacagcagccccttccatcactggcctagaagcctaggaggaaaagatggattcatgggccaggcccaaggcccccctgttctgtgcagcctagggacttggtaccctgcgttccagccactctagccatggctgaaagaggccaagttacagctcaggctgttgcttcagggggtggaagtcccaagctttggcagcttctatgtggtgttgagcctgtgggtgcacagaagtcaagaattggggtttgggaacctctgcctagatttcagaagatgtatggaaacacctgcatgcccaggcagatgtttgctgcagggcttgggccctcatggagaacgtctgctagagcagtgtggcagagaaatgtgggacccccacacagagttcccactgaggcaccacttagttcagctttgagaagagggccaccatcctccagaccgcagaatggtagatccacccaacagcttgcatcatgcaccttgaaaagccacagatgctcagcagtagcctgtgaaagcagccaggagcagggctataccctgcaaagccacaggagtggagctgccaaagaccatgagaacccacctcttgcatcagtgtgacctggatgtgagacgtggattcaaaggagatcattttggagctttaacatttgactgccctactggatttcggattttcatggggcctgtagcccgtttgtttaggccaatttcttccatttggaattgctgtatttacctattgcctatactcccattgcaactaggaaataactaacttgcttttgattttacagtctcataaacagaagggacttaacttgccttgtctcagatgagacattggactgcagacttttgagttactgctgaaataagttaagagtttgggggactgttgggaaggcatgattggttttgaaatgtgaagataggatatttgggaggggccagggtggaatgacatggtttggctctgtgtccccacccaaatctcatttaataactcacataattcaatgtgttgtgggaaggacctggtggaagatgactgaattatgggggtgggtctttcccgtttgttctcctgatagtgagtggatctcatgagatctgatggttttataaaacaagaattgccctgcacgagytctcattttgcctgctgcaatgcatgtaagacgtgacttactccttcttgccttccaccatgattgtgaagcttcctcagccaagtggaactgtaagtccaattaaaccttttgcttttgtaaattgtgcagactcgggtacgtctttatcagcagcgtgaaaatggactaatacagtagtatagaattagttttattgaaaaatagttatgaaaaatttcagttctttcctttaattctgggccatgtttcttatttcatttcagcagttaatgttcctcattacctttttgttcaaacttataactttattttttttccctattgtatgaggatttgtaaatctcaaccacccatagtgagatcgtgttgtcatcagacttaacctggtaggagttggggattaaatgagactctgaagaagtttaaaaagaacctcactgagtaaagccaattttctccagaaccattcaagttcacagattttaattaacagtttgaaatttgtaatattacttgaatttcagatgggtgagaatttaacactatattaaaggagcccaggcaaaaggacatgggttgcgtcaccgagacttattaaatgtgatggaaattcaacagccgaatgctggcaaacaggtgcaagagctgaattaatatttaaaccctaccactcagggggaattgcagtgcatcacgttgacagccacagcacgatgctaatttcattcacaagcttaaaaatctcaatacatttaaacacgtgaatgtattaaattttaaaaagtgtaagtagcataagggtatcccagaactaaaaattgcaatttctctctgggacttcaaatcatttatctagccagaagcatggtgctttttatgaatgaagtatatcttactactttcacatacaaattgtgttctattattatatgtagtgcagactgttactaagcaagattttctcttactttatgtgaaattctttgtgagtcataagaaaaccaaggattcactgatagagtttccagcttctgatatcatacatgaaacagggttctcaatcaatgcttccagtgatgctaagtggtagaatatttctggaggtaaagaaaaacaaaactaaatacatacagaagtttttttggggtgatatcattagaagtggtaagttgtaagctaaaaactcagccaactcccaatttgcgtttaccagaaatttacctactgtgggtcacttgttcatttaagaatttgatggaagcagcagagcatctccgcataaaattgcatgtacatgcaaaatcctatgaagatttcagggagttcatgaatttccacattccaaatattgtttatgatacgtcttgatctttgtctgggactggaagggtatcccttattgagaggacttttttctttgccacctgctgtgtaccaggccttaaaatggattggggaagtaaaggaaagtaagaaaagatctctggaccctttacagcctagtggaggttggtagacaagtagtacagaggggtaaataatttgattttatatatatatatataaaattgcagaactgcctggagaagacagcacattagtgagtattaattgatgtaaagtacaagaagagggaggcattctaggccgaaggaacggtatgtgcagaagcacagaaatgagaacaagaagcactattctttcattgctaaaatactgtgtaagaaatgtataacaacaagtgtattttaaaagttagttttctctatcaacatttcttaagctttaaataaaacaaaaattattgttttagctgggcctaatttcctaaggttttagccatctcagccttttattacatttgtatacaagcttgttctcctcatcttgcttaactggagaatattaagcactcatttttcaaatacaaaaacaactgtaaaaggctcccttcctagtaagtgagtcaagaaaagcccatatatactgcattggatgagtctagattcttaatcaaacacatgtaatcagtacctgcccaaaaatcttgacaatggcagcagtagcaactgattcttttttaaacccactatcaagaaagcagatgaaaaagagacaaatgtacagtcaataacctgagctaacaataagttattttcaatagaacaaaaaggacaaaagccaaaggtattcattaccattcccaggataagagaccacagcagttgctgccttcaccagatgtgctgtctttaggcctgacaatgcacatctccccaagggaaatgtagggagaaagccaaactcttgcaactcgatgcatagtgatttggcttccattaaaacatctctcagtaaaagcctattcaggtttaaagattccacactcattttctcccagaaaatgagatcgttgtataaaatagcagacgtggaattagagcttctggaaatcactctaagccatgtgatctcatcttgacttccttaaattctgatcaggaaaaagatgagatggcttggtgaacatatcatcttaaaattgttgctttgttttgagcacccagaaacggaaagaagctcaacaacattcttaggacactgaaaaaatacacacatatatataataaaataaggtgttgttttttttttgagaaaactcatactgatctagacttcctagaatgtatctgagatgaactagtcaaataagactacttacaatccctgtgaacttgagaagagacatttaacccctcagtttggtacctttgaacgaaaattagaacatctatttcatacttctcagaatttttgtaagaattaaatatgtggaacatgattaaaacaaaatctacctctggtattttcccaagtgtgttatccagaaaataaatactgtggaatggttattaaaattaaaacagtttcttatcaaaaagttgggaaattgtgggtaaacaaagttatacagttatcttaagagctttaccatgttaatgggcattgtgaatcctggaaaaaggagtgtagcatgttgcatttcccagacttacttgacaacagatacattggtgtttggttgtggactgaagtttggaaaatgctgtgcgatacagagtcaatgttcttctgtctttcttcttcactctcatatgagcatgtataattcttctttatagcacttaatcacaatatttaagtatcattcttttcattaggtttgaatttcatgagagcaaggactatgtattcagaaatgttttaatccccagtgtttagtacattgtgggtaataaatttttttagtctatacaatttctggtaacctcagatgcaattcagttgatagactaaataaatagtttttttttttttttttttgagctgtgaaaacaaagggggtggtttaaaatcactccaatatattttagccttgtagagccgtgcttaaaaagtaaggcatggtggttaacggctataatcacagcactttgggcagccaaggtaggaggaatagcgcttgagttcaggagttcaagaccagcctaggcaacgtagcgagaccctatctctacacaaaaatttaaaaattagctgggtgtggtggtgctcacctatagtcccagctattcagggggctaagatgggaggatcacttgatcccagggttcaaggctgcagtgtgagctatgtcatgccattgcacttcagcttgggtgatagtgagaccctgtgcccccgaccccccaaaaaaaatacctgtgcagaaaggtgctccatgaaaactaggcacaggagtaagaaaagaatagagaaaaaacaaaaatgcattcttaaaatgcccaaatacaagttgtatatctcaggtggcaagagaaatctagaagtttaattatggaaaataaacttctagctagatggtttaaatacaacctggaaggtttaggctgatgaaatttggtctcttaaaatccttagcatcaattaccaaatagggtaaaactaacatttttttttaaagacaatttttttcatacttaagtcattgtaagtctctatacttttaaaacataagtactactttgtaaatttgagaatgttccattaatttatacattaggaaaattttatacttcatttcggatgctgaaatcttttagtccaatacctaacttgaataagcattagtcagatgcttcaggggttttcaatagccctttatcttacccgctctccattagtccaggctgaaagtagaataagcttggcagaacctttaaattaacatatcaaatccccttcctacctactccattttacaactgagaagaataagtaactgtgttatgccattcataaaatgagtactttatgcccagtatgcactaaatgcttctgaacattttttaacgtgattttcacaataatcctgtgagaagtgttatgatttcatcctagaatggagaaactcagaagtgttttaccccacatcaaatagccataaaaaaagtgaatgatctgaaaattgaacttagagccctttctctgaaggtcagtgacatttccattacacaatgttttgttaatagaagtattataattttttatgctttttcataggagtgattaaaatgtatatgcataaacatagtgcttgcatgtaacataaccaagacttaagtgaagacaactattaaactttaataacagacatataaaatattaatggaaatactatgtttcctggatgcattgcttcaacattatgataaattttacacaaataaatttacacatttactataattccaatcaaaatttttatttttatatactttgattctaaatttaatttggagcaattaatacattggaatacgcaagataattttgaaaagaatgttgaaaagaaagatgattgtgggctggtggaggagaagatgatggggagaaggttgccccacctgatagcaaaacttactggaaaagatatttaataataattaaaataatgtggtatttgcagaaaaataggagaaacgcatcaatggaacacaattgagaatccagaagcagatccatctgtatatagaaatgtagtatatgatcaagagggtacttcaaatgggtacgaaaagaatgtactgtttaataaataagttgactatgtcattttgaaaaaaaattagatttgaacctcatatactaaaaaacaaattttgtgtggattaaatattcaaatataagaaataaaaccagaaatatatcaaaaaatagagttgattatatctataatcttagagtgggaaaaaccttcctaaatttaataaaacctaaaactacttggaaatctgtataaaaatgtttaatttttgaatggcagaaactctacaaaattaaaagacatttacaaatgttcaggaaaaaatatttttaactatgtaaatagttgacaaaaggttaatatccttattttataaatagctcttccaaatcaataaagcagagaccaacatcacatcaggaaaatggataaaggatttgttcaagcaatttctagctggaatcaactggctattagatttraaaagatgtccaaccttactaattgccaaagaaatgaaaattaaaacagcggtaagctaagatttacctactatcagactagtcagggttaaagagtgatagcttctagtactggtaaggatgtgaggagatggactctcatatactattgatggaagtaaattggtataatctatttagagagtatatttagaaatattgatccaaatttaagtggacataactaccctttgacctaacaactccaagtgacatacaagattcacatacagttgcaaatatttttcccagactgtgactgtcattttactttgtagagtttttctgctatgtaggattatamaatgtacagttcacatgtttattgcatcattttattgtgatggaaaaaataaaaaccatcctaaatgttcctgctgcggtgacaatgtgagctccacaagagaccacttctatcttatttactattgtgtttccagttggctggtacttgacactacaaacatttgttaaatggacaaacaaaatgaattataatgcatttatacaactgaarttagtttttaaagataagtaaactaagttgtagattattttacagatgattcgtttcttataagtatatgtatatatatgcacatatacacctatatgtatttttgtcatacatgtgtatgaagaaaaaaggaagtatacctcttggttgcctcttgaatttaaagaatttaaagagtagtgacattaactattgacttcatatacaaatgataatatttcctttggctttttttttcttttcttttttttaacaatgactgtgtttataacttggaagtacaaatgtagtcattctttcaatccaccaactgttcttggtgcaaaggttttatagcagtgaatacagtctctattttacctgagtctgtattctagtggaggaagacagatggtaaacaaataaatatttgtttctgataaggtgttatgaagaaaattaaaccaaggtaaggggactagtgacatggtgctgtttttcataagcatagttagagactgccttttgtattatgtgatatttgaaaagagacttgaatgaagtagggagtaagccactcagggctatgaaggtagatcttctaagtacaggtcaaaggacttaggcaggaccatgccaaggttcagttaagagcaaggtcaggggatgttggaggtgtttgcatgattaatttttgtatttaaaaggatcagtctggtggatgtgtggaaaagatgatggcttggacaagagtcatagtggtagagctggtaagaagtggtggggttctggatatatcccagatgcagagccatcagaatttgctgatgtgagacaaagaaaacagaaaggatataaaactgtcaagagtcttaaaatacaccaccatcaacaaacctgatctggaatgtgagaatggagtgcctctaataaggcagaacttgttaacaattttctttcacagctagggtcaatcccttatgccatgaattttcccagcattactgtgagagaagtaagtgccaaataatgtctcaaaattgtattgaaattagaacttgttcccatactgggtttagtgcacgcttacttttaaaagtttatttaacatgaaaacatcttcccattaaatgtacattagcctttaatttccttttgtagtcagttttactaacaaatttttctattttaaagtataaggaagaaacagttctgctattttgaagaattgagaaaatttgtggtttaggattttatagttgttaagtgaaaaaagtttacatgaaatcttaacaatattgtgcattaatctttggggaaaaacttgaacttaaatcactgaagatattgaggatttttaaaacttaaatttccaagttttaccattatattatcatgtctcatttttttctgcaaaagaaatatgcaaaaccaaagttcaccttgcacatttcccctatgtcaggtaataaaggcttccaagcttggattttctgaggttaaaattatttgcaggtgctccattgcatgtacaaataattgattaattaaggatgttctcaatcattatcaggtataattaagtgcatgcaatcagttgtattgagacagggaaattgctggcaaatttgagagttcacttgctccaacaaaaatcatactttggttcccatgatcacatttagccaaaaagtagcatagaggactggacccatatcatgacatttaaaaagtattttcataatgctttttgtgactaaaattgtgatgctgctcatttagtcacttattgatatgaccgaatattgtgctctttatagacccacgctgtcaggttcatgattacaacaaatgccatgccgaggtctgaagggagtgggtggataagtagaaagaacaatcggggccgtaggcaggtgaaagatgattttatttagcagcagctctcatcgacagctttcttatactagctctctacactgttcgcctttatttcagctgtttgctcctgccctgtggctcctgctgcccccatgcctgcagctgcatggctgacattcccttggcttcagggtcagcagcttaactctttctctgggcatgagcgagccaagctttgtcctggctcccctctctctgtctgcaaagatggacagctctgactctctctctctttctctgggtggctgcacctgcacagtgtcagcagggcaattataccttttacagacaatattggcatagaaccaagtgatggccttcccatgttacggctacatggctgtgataacaagtgaagttatatgcctttgctctgaactcactgagtcatgcaagatgtaaacatcctacctcggcctatccttgaccaaagcacagccatgttccttaaactccacccgctaggctgagcaagacataggtcttggatacacaggttatacatagaagctttgggtacataggtgcaatagacacacacaggctttatacataagttttgggcacataggtttgatatacaggcttggcacacaggccgtacacacccgatgatgtgaatgaaactgtactaatgatcctggatttttatccattcattcatccattttttttcatttatctattcattatcttttcaacaaacatttattgagtgttttctaaagtagtttttaatcttggctgcatgtcaaaatcctctgtgaagctttkcaaaagtagtgattcctgagtaataaacccctgaaactaattcagtagatctggagtggagccaggcatttttgtcaaaagcaccacaggtgactgtgatgtacagtcagaattaagaatcacaagcttctctgtcaagtactagggatataagagtgaacgcgaaatagttcttattcacaaggagatcagagtcaaatgagtgagataaataagtaaacaagtaattacagaagagtatgataagtgctatactaggggtaagcacacctcttctcatgtatattggtactaggttaacaaagtccattgatggactataacacacaaaaaggagattttctctcatcaaacctaatgacacaaattgtgattttccatcttacctactctattccttaatcaaatgaattagccatattagactctgtggtgaaactcaggagatgaaaaagcagaacaataagtttctatttctgataacagtatatgggagatgagaaggaggtgaagaagaattgcaaaacagtgagctcctcaagggcggggaccatttttctgtcttattaatatttttctccctgtggcctcattcagagtccagcataagagtaggcattgaatctgttagttttttttttttatcttgtgttcttgattaaatcaggagccagctgttcttacctagtttgtgcattcctaagataactctgttccttgttctctgatcagtgactttcaggagaaaaccatttttccttcctcagaggcacagaacttttattgtctttaagcttaataattcatagaaccttgctaatcctttgtggttggattattttttcttatccatgtgtcccattgccagtcgatgttttgttcttactactttaatttccattatcgcgtgccattttattttaatttttatatattttgagacagagtctcactctgtcgcccaggctggagtgcagtggtgcaatcatggctcactgcagtctcaacctccccagactcagatgatcctcctgcctcagcctctggagtagctgggactacaggcatgcaccaccgtgcctggctaaattgtaggatttttttgtttttgtttttgtttttgttttttggtttttgtttttttgtagagacagggtttcaccatgttgcccaggttggtcttgaactcctgggctcaagccacttgcctgccttagcctcccaaagtgctcccaaatccttccctcctaaaggaattacaagcatgagccatcgtgcccagcatcacatgctattttatattcttttgtttctttttaatttcattttacacgatctgctttgacagcctttcttcctaaaaattacagacatgaggtaccagtataaaggaaggatagccctggaagtttaacctatctaaaataagggaagatatgtgcctttgatcccccagagaagtaccaaaaaagctccacaaaacacattgctcattgcagacctcttgtcatctcttggtccctaaagatgggacttagtgaggttgacaggacgacatctagaaatgtcttccaggaaatccatcagacataatgcaggtcaaaattccccaaacaaaagtgagaaggccccagaaggaaagcttcatagattaaagttcccctattatctttaagaccatctattcccaaatatagctgaaagctcttatatccattctgcatgactttatgacattggcaaggccaaagtagatcttataaagaaaagcttgtctgattgcagtggttttaatttgtcagctgcagattcatatatactaggggatatacttaatgtgaacatgatttatataaacttgaaattctataatataaaatactaataaattatcactttgggtgaatgctttgaaaattgatttcatcaaatgaaaggaattaggaatctcatcgtttgacagctagctaactaaatgaattataaattatgtccatccttctgccacaggaaggtgctattttagctagtaagccaaaatgtctaacaaactttaatgtcaaataaaccaatgctgttgtttatattagaactacatggttatttcagatactattttgttatttttttggttttgttatgaaacattccattttcattaattttacaaaacacatttactgaaaatagtatgcaaacatttattgagctttctgcctttctattttatgaattaagagattctgcattaaaatgtcaataaagttaagcagttatgttgaaccatcattttaatttctgcaaaatatcaaagataatgctaagaaatttttaaaaaaattatagcaaaaatatcctgcagttcttattgatttatgtgctccatgaatgtttacttcctattttacatgaaaatatatgtttgttcatattcttagaatactctgaaacatatttcccagtggcccaaactctttattaggaaaatggacgaattgaatagcaaatggtaagaagctggccttccttttcagttttgatatggacatcatgttcctgagagacctggttgttggaagataaatcccctagtgtctaacattctccagacttttggcaaagtaatttttatagaggaaagaaccatcacactgatttggtttactttaaaccaccaggttctcaattctgtgattcatgtaagatattatttctttccgtctctgatctagtttccaaagaatattaatctgctatgcctgatctttactactaggtgtttagattactgaaatgtgaactaaggtgccagccttgtataattaacttttctttaagaaacatgctaaggagattaaaatgccaagattgcagttattttctgagatcttcattaagaacaaatctgtactagaaacactacttctctatgggataatactcttcaggagcatggtacaaaatcaaggaaaaaattttgtataaatctattgaacattatacattaatatcttgtttgtatgccagtggttataagcttaaggaaaattatatttattagtttatttagaaattagtaatttttgcctatctcaattattgaagtagatgggacatacctgttttgatgtgcatgttttaaaatatgatataaataatatacatgtattctgcagtttacttcttttatatattctagatacatgtcccttattagatgtatgatttgcaaattttttcccattctctgacttgtctttcatttcttgatggtgttgtttgaatgagaaaggtttttaattttgatgaagtccagtttatctaattttttcttttgttgttcacaattttggtgtcatatctaagaatcttttgcaacattcgaagtcattaagatttagccttatgttttgttctgagagttttatagtttgtacttttacagttaggtctttgatccattttgagtttgtttttgtatatgatgtaagagtctaattacattcttttacatgtggctatccaattgcctccgcatcatttgttcaaaaggcttttcccaattgaatggtcttggcactcttgtcaataattagttgactgtataggtatgggtttatttcttgactctcaattacattctatttttctctatgtctgttgctatgccagtaccacactgtcttatcattgctttgtagtaagctttgaaattcataaatgtaagtcctgctactttattcttttttttctttcaagattatttgggctgttctaggtgccttgcaattccatatgaattttaaaatcagcttgttaatttgtacaaagaagtcagctggaattctgatagggattatattaaatcttagatcagtttgggtagtattcccatcttccagtctttgaacatacaktaattaagtcttccaatctgtgaacattcagtaatttcccatttatataggtctttaatttatttcaaaaatgttttatagctatggccttatcacttcattcctatctgtatatccaaatgatcacatggcctcattttatttcagctaaaagtatttcctttcaatttcttgaatgcagacctattcacagtggattgtctcactttttatttattttaaaatgtctttgaacctttatttttgaataaatatcttagtagacttagccttcttcgtaaacagagtgttcttctcaacactgtttatgttattccactatcttctggcctccagtgtgctcataaaaaattagctgttaataatatttttgttcttctttatgtaatgaattttcttttctgttggcattttttttgttgttatctttggctgtagtagttttatgatatgcctatgtgcagccattttgtttattatatttgtgcttcattgagcatctttgagttaacgtttttcaccaaatttgagaaggattttgttattatttctttaaatatatgtccaccatttctctttctgtgctccttgttaaactccaattatccttatgagttatgaaaggtttttttgccacatagttttaaaccttggaagaatgtttgrgaataagagggggaagkatgaatgaagtgccaccacaattttctaagaaaacttagttcactaaatatgcacacaactacacaattcattagatttacagtgaaaaatattaatgttaccggtcttcttttcctatctttacaacatttgttttaggagcatttcctccctctgctwtttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatgtgttaatctttgcatcatattggactcttgaaggcaatccttcctctggccaggaaattttttaaaaaataatactgtgttgtgtttatctaaatacgtaaactcaagctaccaaagagaaagatgttgtaatcacatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaagttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagaatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctctgtcttgactgccttctatgaatcattttaacatagtatcaatgtcattgtgtagtacatcagttcttaacagtttttagttcattacttaaataaaatttaataactacaatttttagataatatccctatttttattttatttttaaaattgtatattaattactatgttctttgaagtttctaggggtgttcttgaaagacactatatctatatgtcttttctatttcatgtagtatatgatatattatttgtgcttaaattcattgtagtaaactatttgttgtgctacaagcagtagtttataagagaatacagtatgcctaattagattttttaaatgaactaatatttcttaaaattcacttgcaaatatttgaaaatcatattttcttaagtctttgcagagtattacatacctaaggtttttaaaatttttgtttctaatttttgtttttaagaagtagagataatgaatctgtactgcagacttttaaaaaataattttactttcatttgaaatctgtcattcaaaaagtatgagacagttcttaatgggacttaatggctaaaaaaagagaaaaatatatgtatatatgtactcaagcgtatattagaagctaactgtttaggaagaaataaaaaaatacctttttcaccactctccctctttttatataccatcccttcttctctgttcacattggtatgtaaatttgaggtgacattaattatgtttcaatttatctctggaaaaagaaatattaggtaattttggcacataccatgacaaactaagccttacatattagaatctttttaatagattaaaaactaaattaaaaattgcttctggttaaaattttgtaaaatttattttactgcaattatttttctatttagttttcataattgcttcagtatcctaattgatatttttgtgtagcagcattctataatagacagggataagcatttaaacataaagagaattttgtgaggtgcttgataaatataaatttgaaactctgatcaaagatatatttttctcataaccacaatgccatatgtttgatgttgattgaagtatggtttgtaaaaatcaaccctatattctaaagaggctgggttgtataacaaacacagctatttttatattattttctcaaatcttatctgtttatagctactatatccaactaatgtttggtaacacaggatgatctgcaggaatgctaagagaaagtttacatataaattatttttttaaagtctagttgcagcataaaattttaaaaacatttaaaatgaagaattgtacaacatacaatggtcataatttataatgcttgtcactgactttttggccacctcacttccttctcataatctgcccaaattattaggcaacaaagtaaagaaaatttaatatttcaatatgcacagcaggagattgtgtctttggtaatgttactttaaatactgaacaagttttctactattagctgttgtcctattaaatatatcattgctcaaatgttagaatacaaaggtgaaatcaaacaagaggacatgctccacttgattcttgaataattatttctgttcgttaaaccccatctttatgctttgagcaataacacttgtctgccttgcacaggtgaagatttgtattattaagccatcaaatgataggattcctcataatttcacaaggaaaagtcttattattcaagtcttataggtgctaagttgaggagaagaccgtatagtattgtgaataacgctattggctggggactcagaaaaccgagggtttgaattccggatctacatgtaataactgaatgtatgaacttggacatcctatttaatctcttgaattctcatttgtttcattttaagatgtggatattattggtactttctcatgttgctgtgaatcaaatagaagataaatgtttatgaactgaaagttctaagaatgaaatgagataatgcactgctgtattttggagatgctttatttgacccctccaaatctcatgttgaaatttaacctccaatgttagaggtggtacctaataaatgatgtccgggtcatgggagagagtccctcatgaatggcttaatgctgtcctcatagtaacaattgtttttgctgtatcaattcccagagagctggttgttaaaaagagcctggttcctccctcttctctcttgctccctctcttgccttgtgattacacaccagctcccctttgccttcgaccataagaggatccaccctgaagcccttaccagcagctgatggtgccatgcttcttgtatggcctagaaaaccataagcgaaataaatttctttataaattacccagccttgggtgttctttatagaattaaaaatggactgagacatgcatgtaaagcagttagcacagttctggacgtatagtaaacactcactgagtacatagtgctattattttgctggaaaagatttaccaaaatctaacttacatttctggacgttatggttaaagatgtcttttttccccccttagtagttttaagtgcagcgtctgcatcactagcaggaattgatagggttatagtctgttttattatttgggaacttcactcccatgtattatttattaaacactcccagtatttgctacaccttgacagggtatataaaatacagtcattgctcttgtggagtttccatttataagaaaagatgggataagaggagccggctgctgaagttatttggcattcatttaggtaagagaaagtatttgtcctcctccaccttcatatcagtaagtggccaacctacagagtctttatagtcagattctccaaaatacatattgagggggaaaaggaaatgagtaatttgtgagatattagatggaagattgttgcaggactatgaaagagttttctaattctgcactctaaagccagtgagaagaggccaataaaaaggaccaataaaagtgtgtgttgcaggtcttaaagggaaaataactggtggaagataggtggactacactcatgcaccacttaacattttagtcaacaatggactacatatacaatggtggccccatgaaattataatggagctaaaaaattcctatcaccttgtgacatcttaaccattgtaacatcacagggcaacgtaatagtcacatgtttgtgatgctgctgctgttaacctgcactgccagtcagtacaatatataatacttggtgataaatggctatgtttcttttttatgtatttactatgttttatcattattttagagtgtactccttgtacttatttttttaaaaacattactgttaacctcaggcaggtccttcaggaggtattccagaagaaggcattgttaccataggagatgacagttctatgtacattattacccctgaacaccttccagtgggacaagatgcagaggtagaagatagtaatattgatcatcctgaccctatgtacgtctaggctaatgtgtgcatttgtggcttagtttttaactaaaaagttttaaaagtaaatttaaaaattaatacaaaaaatatagaaaaagatataaagaaaatgtttttgtacagcatgtttgtgttttaagctctgttattacaaaagagtaagaaagtcaacaagtttataaggtaaaaaacttactttaagctaaagtagtttattattgaagaaataaaattttttatgttttaattttaattttttttaagatacagagtcttgctgtgatgcccaggctggagtgcagtgatgggatcacagcttgttgcagtcttgaactcctgagttttatagaaataaaatttttgtagaaataaaaatggactgagacatgcatgtaaagcagttaccaggcccaataccctaatcaacaatcaagcaatcctcccacctcagcctcccaaagtgctaggactataggtgcaagtcaccacacccagccagaaaaatattttttatatatttagtgtaacctaagtatacagtgtttataaagtctacagtagtgtgtagtaatgtcctaggccttaacattcacaactcactgactcaaagcaacttccagtcatacaagcactattcatagtaagtgcacctttttttatcttttatgcagtatttttagtatttttactgtatctttaatatgtttagatacacaaat

SEQ ID NO: 10828 - DNA, 81647 bp, Homo sapiens
  misc_feature (1)...(81647): n = A,T,C or G, or insertion/deletion polymorphism (see Tables 1-2)
gtattttcttcattgtgtatcacaaggtaaatgctaaattctagacatatattgacactcacaattatggacaccaatcattttgtgaaggtaagccatactttttaggttttatgaatactgaatgcattttaaaagacagccagattctcccagtgtttacacaatgggactaaatgagtgttaataacttaggtctcttagaagctgtatgaagatatgctaacaaaattctttgctaatacacagaagagatatgccagtgttggtggtgtgtctgtcctagagaaaggaaccctagggacaggctttcttattcagcttcatatcatcaatgagcatttcagggaccttagtgctaagtgttcttgaagtgatgctcaaattttaaatttaaacttcgcaaattttatgcacatattttaggtgagtaatgcaagttcaatccaacactccatacacaaagggcacctggatattcctaggtctcagttatgggaatacatgaagtcaaatgaacattcatagctcttgagatccttccatggccccaacaagaccacctgtcatggctggtcccttcttttgcttcatctgggctccactgggcccagcagttctccactgttgttcctggaggagtcagagtggctgtgaagtctgtggtgaagtgtgtggggcagatccctctgtctgtgtgtctcacttcatcactttagcctgtaggcagtacagtttggacctgagtctcataatggcttttgtgaaagagcgcatcagactgagtttctggcaccatctgggaaacacacagcattctcttccatcttggcttcccatgtcttcccagaaccttgtgttccaaagttctttttagtccagaccctcagcagtgttggacataaattcacgcagatacgtgttttggggatagcagggtaggaagtttgtagccccataagtcttagcacatgccacactactattaatatgtttccttttgacggatggctcaggcatagagtgacaatttgatctcagaatataaatagacccagaggttttataaaaagcttcttttgtgattttgtggtgatgactgtattggacttttaataaatttaccacctatagatgatggctgtagatacagacaccaacacaaagagtgaataagaattaaaggaaatctgtgaaagatcaaaataacaaggagatcatcatggtatttttccggggtggttcagatattggagaggcgtgggagtgttcagtagtcagtgacttctgcatgatatttgcatagagagaactttaaaaaggttgcatttcttttctgctttcatatttactttgggttaaggttataggatctccttggcaatgttgctgatgctatttttgtaaaccccaaatcagtgttcaaatgtggtgggatggaaattttgagctacagcaataataaatacattttatgtccccgtaacattcaagctgtagtatgtctaagagtcagtgaaagttgtttcctgccttgaactctgaagtaagaaagaaacttttgtttataaatgttagagattttgtttttgcatttaccgcaaagttaagtgcagatataatctaatcagttttggcaaaatatcaagcgtgcttgtttgtttgataagggagggaaacccccaacttttcatgagcgcaagtcctttacctgtgttgaagatacatgacttctgtccataaagtcttcgatcttgtggactcatacagaaaacacgggtcctgtacaggaaataagaggcagacatgtactccagaacatctttctcatccattttaataatgtctggttttgaatttataggatttcatataaaggaccccatttataagttttttattcttctcctctaaagatgtaaaactttatatgctgattcgagtgaaattgagagtagtcaatatcaatcaaacaaagattatttaatatgcactttagcatattctatattggatttcttcacgagaatatttgataagagaacaggtgtgtgtgtgtgtgtttctatatctatctttctatgtttttcaactcaccatgcttctacactataatctccttgaagggcagggccatgtggtattcattttgttaaccttgtaacacctagtgggacactctcaagacatgaaaaccagtttataattgtatcaactttacattctggaagatgcctgtcagtggccttttatgtaccttgcacccatctggtggggtggattgggcaagccttacagtccttattttatagaagatgaatttgaatttcagagagagtgagtgatttacaattccgggcatgtctttcaccccatccatttcttgtggcccatctctggacactttatgttgagggaaaggagcattaccctgcaagcctggcaggaagaagggctgctgacaaatggtgtgtttgaatttatgggttgggctagtgacagttgacagagccttcctatagagacacaggattctccatcaccactggcactttgcccctaggaccacaatgagtatcaaaccacatttaagacaaccgtgaacaaatttcagtgggattggcaatgagatttccaaatggacagatcttctgcctgaaggtggtcatcagcatgtctatagtgtatagagttctctgctaaatccacagcttctgcttcacctaactttttttttaacctggttttgttcattgcagatagagttctctctctgatagccaggaagttgtattgagaagggatcagccacaacaagcttgactcactgggcacatgttaccttttgttttttgttcagcacctctttatataacaaaactgtctaatctctcaaagtcgtaaaaggttaacatttaactaagtcctgcatgtcattctgggatggacatcatgacagtttggcatgtcctttggcattgtgtttgtgctgatacatttccattcaatttacaaacgtttcattgaatgcataccacatgccaggtgatagtgctgctgctggggagaaggtgggaaatgaggcatacacaatccctgccctcacagaacctagtggggacagatgagaagaaaggaatgccagtggaattagtgtgatgaaagaacaatcccatgagataggaatagcttttttagagcgctaggcattctgaaactttctggttatctcagatctcagattgcttaagcttcttcatgcccttacaggtaggctctggtcttagtagctctgaaatattgtgaaagtttcgtgacctcttgggaccatagttttatcatctgtgaaacatagacattaaagtggaggactttaaaagcttttgcaatcctaaagtatcattgttgtattattgcaatagctaacattgatcaaagtctgacaaggtgccaggcactggacagggagctcttataagcattgtttaatttattaagtgatttttgtggatctttttgtataaacctggatacaagcagcctaaggagggacatggcaggtactctggtgaaatccagataaccatcaagggagcaggtggctttgtctagatctctttcccaatttagatgttttatatacttttcaggggaacttgcatcacatctgtacacacctatgttatatttatataatatttgcatgtgaactctttgttctatttaaaaatgatcaatttgatgcctcaaaagtttttttaaaagcataaaactctaatgacaaaaaagcagttttcaaagcaaaatgaagtcctcccatttggtatagtcatttattttaaaagacaggtacattttaaatgccccctatccagctgtgttcatctatgtctccttttgtagagttatttaagtctttttggaattgccttgtgtcattttcaaatgttcttgaatttaatgtctgcacgacattcttaggcagacttagtcctcagctacctgccagggatgagttcacattcctttcaataatgagaaagcaggaaaatggacaacacatttgcaataggctcaaaaacacctgccaggggaaagagatgagctgtttgatgtcccatgtcccaccgacctggcaactctgttaactaacagtgatgatgaagaagatggtggcagtggtggtggtgatgacaggtgcgaatgtggactgagccactcaggaacttggaaaattatttgcatagctatttcattcaatcctcataacaacaaactgaagtagacgtgaatatgtccattttacagggatgaaactgagtctcaatatttgtaaccaccttgctctaggttactcagtcagtaactggacaaggtgggatttgaacccaggtcaatctaattccagatctcaggccttgagcttctacatgacactagtttaatcccttcttgccaagaattctttctaagagataaggcaaatctgctgtactatctttaattctataatgatatgaatagagctattattattttaatattatcaattagtaacttagaaattctcccaaagagtcaaacaattggaaaaagtacaatgtggcacaaacctcacaaacttttagcagttcattatttggtccatgggtgggaaggcagcatggcacagaggaaagagccaggacatgggctaggctgggctgggctgggctgggctgggttagagacctgggcccatactgctgactacatggacctggcccatctctaacccctctaagtcctaatttcctcacctacaaggagtggctaaaatgtctttgttgaaagaatgttagattgattgcaaatcataaattaaatgtgtctgggcagtgtctggcaacgcaagtgctatgtggttcctactagataaatggtagaaaagctcttggcacaaaccgcccaagcctgtcatgctcctgggataagactaccttcaagccctgcctgatttcattcctgtccatgtcaccagccccatctttagccattttccttttcattgatttttttctcatttctcatgtgggacagtgtcacccttccaccccagggtctttgaatatgccatttccttggctgaaaaataatctttcacccttgtatgaatgcactgttctgtcttgtccttgagatctcagctcaaatgtcacttccccaggggagtcttttctgaagccccaaagcatcaggccccccttatagattcccagggtgctttccgatttgggatacccttcccagtggtaattaagtacttaattcaccattaattgtttaatgtctgtctccatcaccagcattgacctccaacagggcagaggctgcatctgccatatttattctctctccccagatcctggcatggggcgtcgctcctagttggtgcttgatgaatattcattgaatgaatgaataaatgagctgatgaataaaggattgccttatttcaaggatccccctttacactttctaacctgtttttactaaaagaagaccacttgatgtgagccaggaagacttttaccaaaagtttttgccaaaagctgtgccctttttacccctgatgagagcagaacttcctgggggaccatttgttacctgtggcgcagaagccttgtgtaccaaatgagctgcatccactccgaccagagcgatacactggatgataaaaagatatcacctccctgaaacagatgcttcattttatgatagaaacagagacgctgaagcctgcaggtgccgggctgacacgcgctctgcagagaatcattagagcctccttagagaactgggtttactctgtgtttaatcagccccaggcagaagaaatggcttcatttcagctcgacgagagccagatcacaaaaggaagatagatggccaatacggctcatcactataagcatattgtcttaatttgaaggaacagcctggcacccgtgctaatcaggaaagaaagtgcaatatggctagcactgaaggccagtcagtttaactctcagtgtaccccttaaggagaagctctcatttattttcttaattaatattttaagggaagtgagaatcacaaaacacattactcaatcacttaagaagttccttggcttagaattaaagatgctccaggaaagactttttatacctgaaaactgtgaatctctacctagaaaaaagtcttaaagccggtgaataaagtggcttaggaaggtaaggtctattaatttgctggctgcttttaatattggtcacgtttggcagttgatccagaaatagctacaaatagagacgacatcagatctattgtgtggaaacttgctggtctcttgtaggctcttgtttttcatggctcagtcctgtgcttgttcttcaccaccctcagctttattgaggtgtaattgacaaataaggattatatatttaggctggacatggcagctcatgcctgtaatcccagcattctgggagctgaggcgggtggattgcttgagcccaggagttcgagaccagcctgtgcaacatggcaaaaccctgtctctacaaaaacacaaaaattagccaggtgtagtggcagctactggggaggtttaggtgggagatcacttgagcccgggaggctaaggttgcagtgaactgagattgagccaatgcactccagcctaggccacagagccagaccctgtctcaaaaaaaaaaaaaaggttataactttaaggcatgcaatgtggggttttgatataccttgtaaaatgatgaccacaatcatgctagttaacatgtccatcatgtcacatcattacctttctctcccttgtggtcaaaacatttaagatctactctcttagcaggccaggcacagtgcctcacgcctgtaatcccaacattttgggaggccaagtcaagtggattacttgaggtcaggagttagagaccagcctggccaacatggtgaaaccccgtctctactaaaaatacaaaaattagcccggtgtggtggtgtgcttctgtcgtcccagccactcggcaggctgaggcaggagaatcgcttgaacctgggaggtggaggttgcagtgagtggaacctctgcattccagcctgggcgatagagcaatattgtatcaaaagcaaacaaacaaacaaacaaacaaacaaacaaaaaactactctccttgcaaactgcaagtatacaatacattattattaactaagttactttctgtacattagatctccaaaatttattcactctgcataactgaaatattgcaccctttcactaactcgcccgcgtccctcctcacgcgcttcccctgacaaccatcattgtaccctcttcatctgcatgcttttgcccctctagaacttgccttggttaggactgcaaaatggatattcagttcagtcgctcttagcttctcgattgccccaaaatgccagaaaagggattttaagcttgtgaggagcaataatacatatctgaactcagcatccttgccaaacctctcttatttgaagtaaaagcagataatgagtagtgtgggtacttacaaacaagtggatgttttagaatcatttggtatgtgtcacatccatgttttcattatatcccctgagccttagcacaaagagctttaacagcccttccaccccagcgactgttttccagatgttctgaaacaacatcaagtgacccactttacccctgagagatacataaaggtgcatttatggagagactggatgagtgaggctgagacattcgctcagcagcttagtcctagataatctcccatgaacgcagtatcgaatcttactttttacctaaggcacattgagtacggtttctagaaaatgatatgcgaaacactgctaaagtgaagaagaaacttaagaagcttagcaacgggtgtagaaatattatcatcagctatcagggtaatagtatccagtcattctccacctacaggcacaagatttaggcttaagcagctgaagacaacacagaaagtgtgcagtcttagagtgtttaaatatcggcacgtcaaggggaaggactttaaaacctggacaagtgtcatttgatttttgtgctggataggatgaaagcaaaatcacaattgcagaactgaaaatacccaagaggcacgccaaggttcattgagaagccataccatggaaacaagagaaatcatcatttgtagataggagattgtttcattctttgcacatgggcagcaaataccagagcagtctctgggatcagaacccagctctttgcctctgtaagggagatgagccatttctcaaggaccaacaatatgttgccttatattcagtcataggggaagagctactgattccttccaaacatgggcatcaggccacatgtcaaaatctggcaagaaggtgggagaattcttccatagcacatctgtttgtgtagatgacattgagtgaaaaaggtgccccctccccaactcccaaagtaagcaacatgccaaaatcttgacgtgaaatgtacttaattttctacagtatgtcaatcacccaatgtctgctgtgcaaaatgaacaaccttctggcgtgacttccattgccactggcacagaactcactgcagtcatcccgttgaggtactttatgcatgaaagggaaagtgagcccacgtgaggggggtcggacagctctcagaatgcctgctagtggcctgctgtttagcaaccatttacatgggaccaactaatggatgacagtcctattgctgagttcagaaatagacaccctctcatatcttgggaggctgggaagtcttgcttggcactgacatgttggtctaacttaaactttggtgaagaagtacaactctgactgcatgacaaggtggatgcccacttgagataaaatgaactactttttgctttgaaaatctgtggtctggaacatccaagattgatcattttgagtcaattgccattgctggtgcttttctgattcctgccgctgatttgttcatagttagaaacatgagttaaattacccttatcttaacatccttaaccatcaatgttgttattggtcataaaattaggcacttcctgtcatttcaaatccactgacagttttgggtggtttgagttgagtgggttggacaaggggaaataggtgatttccgctgcttcttgtggagttaatctctcatccagatactgctaaagcatctctttcaacggcagtctttattcttagtttagcagcatcagtgtaaacaacaagtttctttagaatgctccaactcaaagtccaaatgacagatgatttcccagtcctgaagaagtcatttaagcacttgtatttcttttcttttgtttttttttttttgttgagatggagtctcaccctgtcgcccaagctggagtttagtggcatgatttcagctcactgcaacctctgcctcccgggttcaagcgattcccctgcctcagcctcctgagtaactgagattacaggcacccaccatgaagcccagcaaattttttgtatttttagtagagacaagctttcaccatgttggccaggctggtctcgaactgacctcaagtgatccaccagcctcggcctcccaaagttctgtgactacaggcatgagccaccgcacccagcctcacttatatttctttcagcaatttattccagtttgaacaagacagtcaatttctcatttaaacatggagcaagcaggttatgtgtgtgcaaacaaaaatatctggcaaccattcaaggtttggatgaaaagaaggatgtggaaacatgttacagctagaaatgattactttattgtaactgccatttgatatctgggggcttctctcttctctgcacaaatctctgttcttaaaagtccttttggggaagctccgggctccccacaccatcccctcctccaccaaatagctgctgggctgctcacatggtcaagctggccttgaatctagaaagtatttgcagcttcatctatgtcggcaagttttcctttcccctaagtaaaacacttgtttcagctcacatgttttgttcagtgtgaaatatcttagctgctaaaatgtcacttctgtggcaaatatttcctcaaggaaacatttgtaaatatcttcaaaaagaaggactcatcccttacaccaacaaaaatatagccaagtcagcacatgtgtttctaaaatcctccttcctttataaaagtcaggctttttcctactaactgatcagcaggaagaagtatatatatatatgtccatgtcctccatgtacttgacctactgaggctcagaggggctaaaacacctttgagtatagcattgatcttagcaatcttgtaatggggtgtattagtctgttttcacactgctgataaagatacacctgagactgggtaatttacaaagaaaaagaggtttaatggactcacagttctatgtggctggggaggcctcacaatcatggtggaaggtgaaagggacatcttatatggcggcaggcaagagagggaatgagaaccaagtgaaaggggtttccccttatgaaaccctcagatttcttgagacttattcactaccacaagaacagtatgggggacactgccccagtgatcaattacctcccaccaggtccctcccacaacatgtgggaattatgggagctacaattcaagactagatttgggtgaggacacaggcaaacaatttcacagggtttccaactggcaggtttttggaaaactgagaccagccacttgtatgggtgcctctcaagggatcaatgagaacaggaagtgatcaatgctctctcatactcatagcatgtctgggactctgagtgcccagaattctgccccatgtagaatagaaccttgctaaaggttgagcccaccctaaatctagaggaatcaccgctgcacagaaaacttctatcaactcctttctgtgctgtgtgaacataagactcatctcagtgtaatgttgtgagaaaattcatgctccatcactaagaaacagctgtgtgttgccacagtcattaacttttgaaagatgttaaaggcaggtatttgtttgaagccagtcacttcagacagagcttccccttcaggtttccttctggttctctaagtgttaccttgcttctctgatacaagtaggggaaaccagcaccagaaatttatggcttctattaagagggttggctggacgtgtggacaatatgtcaataattatttctggtggggatctaacagcagaggaagtgtctttgtagaatagcttattttaacagaagacagatctgcctgacctgggttttatgacagatgtcaaatatatcgaagtgtgttgtgaagcagattgccttattggcaaagaaatgaaagaccaccaggaagatgtatgggaaactttccttgaggggtttcgtgcctcttggtgcaggtgcggcagtaaacctggagaaaggccagtgggaaggtgagagtggagactgtggggagcagtttgaacttctgcctatccatgagacttggaaacaaaagaccctaagccccagagggttgatggaaaatggggtggaagaaagggagagcagggcagctcacatgagagcagttaagggacaagggtaaagcaagtgaggccacccgagagagagcaccccctcacttgtctcatctgaggtgcctgctcaagaatgggttgttctccaactttccttcttgagttcagttcaacaagtatcagtgccctgtgccaagagctgagctgggcattagagaagaatgctgaatacacaggctccctactccagtccccattttccttcctctggaaagaaaccactttagtgtccagggaggacatggtgtcctggggtcacttattagctgctgggtagcctgaggcaagtgtgttcatgtctctgagcctcatttccctgaactggacaaaggagctcaggacctgccccatagagttgaggattgagaaggacagtgcccttgtacttgacccatagtaggtatgggaaagaaggtttaggagcccatctgttctgagtttgtccaacgcacagtgcttcatagggctcctccagttctcatttactctctacaatatgggaagtacatttcatgattttgattaaaaatgaggaggcagaagggatggtaaagagaatcactctctgatttgtggcactactcacaatagcaaagacttggaaccaacccaaatgtccaacaatgatagactgggtgaagaaaatgtggcacatatgcaccatggaatactatgcagccataaaaaatgatgagttcatgtcctttgtagggacatggatgaagctggaaaccatcattctcagcaaactaccgcaaggacaaaaaaccaaacaccacatgttctcactcataggtgggaattgaacaatgagaacacttggacacaggaaagggaacatcacacagtggggccaccaaagtgtggccaccaaaaagttggtcagatacagaaactataaagggagtagtgaggatcactcaactgtttgcctttcgtctcaaaaagacggaacttcaggtaatttatgtggcccttcactgaaattatcttccattagattataagctccttgtattcttattccgtgagcttcctttgtcacaaaaggttagcaggaaactgtgccccttgagacagatggataacaaaaaagccaccctttctccaggctgctgtagtcagtaatggtggcttcggtgggaggacaacatggtggttttcagctgccccttcaaccgggctcccatgtctgggcacaatctacaccactgtttgtggtggccctgtgagcccttagcacagctaagcccgaagtgcatagtcagtaaatgttttccaactcaatttattacagtcactgttgtgcagaaaatgatggcattatgttttcaaagagattactttagtcattggaaaaacataatagagaaattatgggtaaaatgtaaaaagtcactgcaacagtattcttttgtgttcttaaatgtttcttctttgagtccatcatgagaaagaatacagtatttcattccttctggctttgctggctataaaccattaagggttttgtgtgttttttaagtgattggagggcccatggactacagttatgagaaaagcttggagaaactgaggcaggacaaataattaaagaaggatatttagactggactcagtggttcacacctgtaatcccagcactttgggagcctgaggtgggaggatcacttgaggcccggagttcaagaccagcttgggcaacatagtgagaccctatctctacaaaaaatttaaaaggatatttacatttttacatgtgtgggattccccaggattagataaggtagctgaaatacagaaaccaagaaaagctcacagaaaatgttagctgtggtatagaatattggtttgaactattttgccttcttcttattctttaaaggtggtctcgatggtaaaagtaaaatccttaataaatggaagagctgtacagtcttctgttttggacttttgtttgtcccattttgtggtagtatcatagggaaatctttagaatgcagatcttgtttacttgccacttctcccccttgatctactgggcttttgaccacttcacctgcaaagaggaaactctcagaaggaggtggaatgtaagttgttttcatagattttaccctccaaaccaacttccaaagtgattaactgctttttctaagaagcagagagtagaaatgtccatgcagaaaaaaaaaaccagcagtatctgcttttatgtttaaaaagtggggctggacatggatggtggctcatgcctgtaatcccagcactttgggaggccgaggagggcagatctcttgagctcaggaattcaagaccaatgtgggcaacatggcgaaaccttgtctctaccaaaaatccaaaaatttatggggcatggtggcatgcacctgtggccagctactcaggaggctgagatgggaggatctcttgagctcgggaggcagagaggttgcagtgagctgagatcacaccactgcaccccagcctgggcaacagagcacgaccccatctgaaaaaaggagggtgaagtgggtaaagtgcaaactgaaaacaagaatttccctggaaatgaagcaactgccttgagtcagatgctagggatgagatttgtccctcctaaggaggggttgctgaagtccttcatctcttagcctggcttgacatatggaaggagaaatgatattcaatttgaatctagaaagtgtagaatctgtcactgggcagaacaagggccacatggcttttcaaccacaggactatttcacaaattcatgttcttttcccttcattttgactcttttttggtcccctctgctcattttatttccccttgagtttgtattaaattcattacatgctcttaagggagagaggttctcaagagtggggaagatgctaccagtaaaaaaaagttggcggggggaagaagtcagccttggtgcattgaactaaactatagtttatctcaaattatttccccccttttggagaacaatctactgttctcctcgaagaagcttaaagtctcaaaggcctttattaacttgatctttgggaatagtgttttaatttttccataatcatcatgcaaattgatcatgataatatctggaaaggaaaataagtgaaccaatggcctcattaactccagtgctagggagacccatgttcctgagagctggtgcctttaccccatggtggctcaggacttcattgtgtatgacttggcccatacccagtgggagctgtggaacgttccctgcctggcgtgtttaaattgcctcatgcattttactcccttacaaaataataggggaaaggttccaaccttacaaaagaaatgtttgcattctactcagttctaagcaggatctccgactctcctataacagaaccataccactgatgcaacatgtcttttccggactttaccttaatgacattgaggtctcaaattgctagaccttgggtgataattgagtcagtcagcattaaaatgtatggctcagatgcataactctgaatgctgttctgctgaattaggaggctttttagagtgtgttttaattttaatttaacactgacaatggcaaagacaaatagatctgtccaaaatatacttagtaacagttttttgagttggttattaattttatataagtagtttctctttttatttttatacactataaaattcagtagaaatcagaatcaaatgcaatacacttttattgattgcctgctatgtgtcaaacaaggtgttgaatgttttcgaatgctgtctcatttatcctcatcttacagatgaggaaaatgtggtgtaaagaggtgaaatagcttgctagctggagaggggcagagtcatttacagatctacctcatcattgacaaattttggatgcaacgctttgaaaattaatttcttcagtgctacgtacagctaataactgtttctcagtagaccttgtcctatcagtgagtagaaaggaagtgcttataagcctgggggccacggggcaccataaacatctgggcatggattgtcactcagtgggtgtccaggaccatactttgaggcacaccagtgtctttcactgcctcatcatatctgtggctgaaaatgatctcttcctcttttggagacaattgccttctagggaagtacagatgcaggaaggtatgcacaaagctgatgttggaaagcaatcacctaacaaccagatgggttagccaaaggcatctgcctcctgagacagagcagggccacatgcacatctccctctggaaaaccccatttatctcagctgcagtgagaaaaggggttatatgttcttttaatcacttctacctctctggagaaattttatatgaatatgcatcaacaccaactacctgtaagctattatgttagaatacaataaactataccttctaccagctttgttgagtgtctactaaatgctgggaattgtgctaggcgttacagttccaaagacaaaagggcctaatattcttgtagggaaggtggacttacgaacagacgcctgcaaaattaaagagctgatgggcagcaagcaccaagaatgacttgaggaaggtgttggacaggtagtaacactggggctgggacttgaagttattagtaaaagttccttggatgaaaaagttgggggaaatgtatcctattttgaaggaacttcctacttaacttggcaaaacaagagtatgcttttgccttttaaatagcaataaacatggtgtaattggtttaggaaggctgtgctccatggagaagagctggtactacatttaatttatcttgtagcatagtgttttctcaaactatgcttagaagaatactggttcctcgaggtgttgattggtgttgtctggaaatacaaggagcttctgaggccaagtaatgtggcaaacactggggtaggccagttacctggggttaactttccggcaggacttctcagagtctttaatatgctactctgcatcataaattttcaagagcttgccctgtacctatttgtctttcccttttcatagtgctcacagggtttcatggatctcagcatagaaaaggctgctttagggtagaggcagctgccagcagtctttagaaagtgagtgatttctatttcagaaaggtaacactgagcacctgggaaggaaaacgccaaggatgagaaactagacccaaggcaacctataatgaggctgttaaaattttctaggcacaagaaaatgaggctcagaattagggcagtgaaaatgtgagggaagagatagaattgagagatacttaggaggtagaatggatactccataaccacaaggatggtgaatgagagaataaaatagttgaaggtgaatcccaagtttctagctgggaagcttggacagagaagtgttgggtagaagatgaaaaacaatttaatttgggacatacggataaagatggtcaactcatagccagcaactggtgatactaatgaagcaaggtatttccctgacctcttcatgggtgggaactggagtgcatgggtgctagaactagctggccactttggtgctggcacgggtggactccactctcttggtcctgctgtgtttcaccccttgtgggagcggggggagaacaggtgagtgggtgcaggagccagggagagtgcttttgggcactggcaggagctaaactttgtgcaggcccttcagcagcatctaggggagtgcccactacctctaaagcttcagaaggagtgccacagtgctcctttagctttcctgtctgtggatcacttaagtgttaacagctcagtggagggtcagtgtgacagccttttgcacctgcactcgtggcatctgaattcttgtctggtatcctgtagtaatgaggtcgcatgaatgaattggtgatggtaaatgtgggggattttgttggtgaaagtggctggaaggggagctgaaaaggggaaagagcaggaaggtgaacttcccctggagtctggtcatctccagctggactccttccaaggctacactgtcaagctgtccctctgaagtcaagctgcttctctccagtgtccaaccatagtttttcctcatccagcttcttttcctctctctgctggctgagcctggggtttttatggtcacaggatgggggacggggtgggccatgggtggttttgggagaggcaacattcaagagggacaacagggatttttactcccacttttggctgcagtattaggcttttcagcttgaaggtggggccggggacctgccctcttctgcccagagtttccctggctctggtccctatcaataatctgcagttcagggcacagatgaacatatttttatctttctttgatgcttcaagtgactctattatcttgcaatgtcttcaggtcatcataattaacatcatgttgttgactataaatgtttaacaatgcaggttgtagagagctgtgcttaatagaaagctgaatacaaattattcgttgagatactaacatgtgcctagcacagcaatactacgtaaagaaaaagcaagcaagcaaacaaacaaacaaaaaagggaaaaataaaaagacatatcccttgcttaatttgtttattatcttaagcctagagaaggtattacaagtggtcagaatagcagtgttaagattctgacctttcacttgctatgtgacctagggcaagatacataactttttagtgcttgggttttttcatttgtaaaatattatttgtagattattagtgtctttctcattaaggagttatgaggtttagctagggttaaacaaaaaaaaaaaaagatttacttcattctgaaagtataataaaataaatttctttaggaaataatgtatgcattgtgatctatttaataagttttactgttactttatttggtttccaggtaataccaaataataatgtgtctatttgaattgcaaaaatcaagctggtttgaattaaagaagtgtgaaaaactcctagcttggcaaaatatgtaacacttctatcaattaaaaataggtaaaatgtgttaaaaaataatgaaaagttcatgctttaattgaactggcttttttcaaaagcctatattttttacgaagcttaatgaaacaaaaattgaaatggtgcccattatgaaatctgtgttaattgttattattcccataaagttcacatgactaaaaaaatgcatactacctgcctttcgttttctctgtatttatttttctgtatatcttcaccatggcaaacagagcatttactaaattgaaaacttcctttaaacacactggaaacttttgacacaaaattgctagaattatagggtatttttgtcaatctgacaaaacttccttcattcttcctgatttaaacgcaagactgtttctctacttatctccaatactgtcatcatcttaaatatcgttgtgctggaaggcattgcaatattaattaaaaatacagtctaattatttaccctagttggttcatacaaacctctttggtataatcagtggactcccttaaggggtttcacggtatttcggagtgaaatagaaaggtttgttactgacttggacttggctcatgagtgtaattaagtataacctacaattcacctttaggtcaccagatcaaatacaacttatctgggcaatgtccaaaggtatgtgctgatgttgactgagtgctgacgggcggcatacataaacgaatggaacttttaatttacctccaggcgtctcggagaacattccgggtgtttcagcgagtcagagggaaagcagagggcagccaaagaggtccttcattttagacagtccccaggacaaagcagcacaaaccaagttgaaagagctgctcagatggctgaaggtgtttggcgacaacctcttcccacttctggccttagtgctaacctaaagttgcagggcaacctttgctagctgttggtgttgtgctatgaagcctcctggatgtgcctggggctcagtcattggagagattgccttctcaaggaaagcagtgaagtgtttccaggtccagcacagtgctcagatccaggcttcaaaactatgtccttgggctcatctggcataacaggggttcaattgatttctcaaggagtcttaaagcgtccatttgtctttctcacaaatatgttttagaaaaagtgacaataaggccaggtgcagtggctcaggcctgtaattccagaactttgtaaggctgaggtgggtgcattgcttgagccccacagtttgagaccagcctggacaacagagtgaaaccccatctctcatatatatatatgtaaaatatttaatttgtatatataattataatatattatatatatttaatatgtataataaatataatggcagcatgtgcctgtagtcctagctactcaagaacctgaggtgggaggatcgcttgagcctggaaggtggaggttgcagtgagctgagatcaagccactgcattccagcctgggcaactgagcaagaccctgtctcaaagaaaaaataaataaaggaataaaatgctctcgactcccattttaagataaaaatcagtgtctgaaagccctactcagtttgaaacattgaattgcctggcctaaggaagaagagaagttcacaagcagccccataaggtgataaaagagtttggcaaatggaaaacagcagtacaaataaaataatcttcagttctaaatattgaaatcgattagaaattatagtggctagggccaggcatgatgtcttacgcctgtaatctcagcactttgggaggctgaagtgggcggatcacttgaggccaggaattcaagaccagcctggccaacatggcaaaaccccgtctctactaaaaatacaaaaattagccgggcgtggtgatgcacacctgtaatcccagctacttgggaggctgaggcacaagaattgaacccggaggcagacgttgcagtgagcagagatcatgccactgtactcaagcctgggcgacagagcaagactctgttttaacaaaaacaaaaagaaattacagtggctgaactgtaaatttattggtggatattgtgggaaatgagaagaaaatggtagtttaggctagatatggaaggctttgactatctcgagtgttttttttttttttaaatatccaaagccggtggtgtagttttacctgcataaccaactcaacaggaagatttcgattaatctagaattgagtgggaataggtattttgtatgatttttcctaattgaatacaacctaaaattttggctaagttaagagttccaggaagaaatggatgaatcaggtgtttgcagtcaggaaggtaattcaagacgctgaagttttgtgaggaagatagtagatggtgtctcccctgaggtgatctgtgaagaggaaaaagaataaagcaaccagagattgtggcctttgggtttctgcctgctgagaaatgacagatagaatcccagccagctggaagctctgattcacagaaacaggagaggtcatgtgagatataaagtcaaacagggctacatgcatagttgctaagttttattttaaaacttgttaatcttgttattgggggattggactggacttcggtggaatctgctagaaagcattataaaacaaatcacatctgttcctgcaaataagctgtccatccacccattcccttaaaaatatttattgaactcctactatgtgctagttatgagataaacaaaagcagacagccccctgacctcatggagcttacagtcaaatgaagtgcccaaggacttggatacagtgggaatgtgagcagagtgagaggtgcagagaagaggtggacaatggccaggccatacaggcccctggagggcagggaaactattttatttttaatattaaaggaaaggaggacccattgaatacttaaaaaaaattttttttcattttattttgaagtggagtctcgctctgtcgctcaggctggagtgcagtggtgcgatctcagctcactgcaacctccacctcctgggttcaagtgattctcctgcctcagcctcccgtgtagctgggactataggctcatgccaccatgccttgctaatttttgtacttttttttagtagagacagggtttgctatgctggccaggctggttttgaactccggacctcaagtgatctgcctgcctcggcctcccacattgagaacttttaagcagggaaattatatgatcagtcagactagcttctaggatttttttttcctcctgcatcttcatgggatttttttgatgcccaatttctccccgctgaccatgtagatgcagttttctaatgacctcagaaaattgactagggcgtgaaagctgttgtgttgatgaactgcagaagtggagaaggatgaagagaccatgttttccagtttagttcggacactcaccaccttaccactggatcgcacagtagcttcattagttggcctgggtctgatgcttgcctttcctgccagaaaaattttctcaaacaattgctcatggcatggccctatccagaacctccaccagggccctagggccacagtgccagagcatcttaccagagcaacccaggtcatccatggaatggttcctgttggtcttctatgtgttattggccataaagtttgcaaagcatcacttcttttttttttctctctctctctctctatatataaaatactttaagttctagggtacatgtgcacaacgtgcaggtttgttacatatgtatacatgtgccatgttggtgtgctgtacccattaactcatcatttaacattaggtatatctcctaatgctctctctcccccctcccccccactccacaacaggccccggtgtgtgatgttccccttcctgtgtccaaaagttctcattgttcaattcccacctctgagtgagaacgtgcggtgtttgattttttgtctttgcaatagtttgctgagaatgatggtttccagcttcatccatgtctctacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttataggagcatgatgtatattcttttgggtatatacccagtaatgggatggctgggtcaaatggtatttccagttctagatccctgaggaatcgccacactgttttccacaatggttgaactactttacagtcccaccaacagtgtaaaagtgttcctatttctccacatcctctccagcacctgttgtgtcctgactttttaatgatcgccattctaactggtgtgagatggtatctcatagtggttttgatttgcatttctctgatggccagtgatgatgagcattttttcatgtgtctgttggctgcataaatgtcttcttttgagaagtgtctgttcatatacttcacccattttttgatagggttgtttgtttttttcttgtacatttctttgagttctttatagattctggatattagccttttgtcagatgagtagattgcaaaaattttctgccattctgtaggttgcctgttcactctgattgtagtttcttttgctgtgcagaagctctttagtttaattagatcccattggtcaattttggcttttgttgccattgcttttagacatgaagttcttgcccatgcctatgtcctgaatggtattgcctaggttttcttctagggtttttatggttttaggtctaacatttaagtctttaatccatcttgaattaatttttgtataaggtgtaaggaagggatcccgtttcagctttctccatatggctagccagttttcccagcaccatttgttaaatagggaatcctttccccatttcttgtttttgttaagtttgtcaaagatcagatagttgtaggtgtgtggtattatttctgagggctctgttctgttccattggtctatatctctgtttttggtaccagtaccatgctgttttggttactgtagccttgtagtatagtttgaagtcaggtagcatgatgcctccagctttgttctttggcttaggattgacttggcaatgcgggctcttttttggttccatatgaactttaaagtagttttttccaattctgtgaagaaagtcattggtagcttgatggggatggcattgaatctataaattactttgggcagtatggccattttcacaatattgattcttcctatccatgagcatagaatgttcttccatttttttgtgtcctcttttattttgttgagcagtggttggtttgtagttctccttgaagaggtccttcacatcccttgtaagttggattcccaggtattttattctctttgaagcaattgtgaatgggagttcactcatgatttggctctctgtttgttattggtgtgtaagaatgcttgtgatttttgcacattgattttgtatcctgagactttgctggagttgcttatcagcttaaggagattttgggctgagacgatggggatttctagatatacaatcatgtcatctgcaaacagggacaatttgacttcctcttttcctaattgaataccctttattaaaacatcacttcttaaactcgttcagtggattgccagtttaatgagatgttcacagtttctccattaaaaaaaattggcttagtttgatagctcacacctgtaatcccagcactttgggaggccgaggcaggtggatcacatgaggtcaggggtttgagaccagcctggccaacatggtgaaaccctgtctctactaaaaaatatataaaaaattaggtgggcgtggtggtgcaggcctatagtcccagctgaaggactggaggctgaagcacaagaatctctcgaacgtgggaggcagaggttacagtgagccaagatcatgccactgcactcaagcctgggcgacagaacgagactccatctcaaaacaaaaaaaacaaaaaacaaatcaaagcaaaagaggcaggggagtctattagtcaaatacatcaggaaaacaaacccaatgtataatatcctcactcttcatgaggcacttaatgtacttagcctcactaaaggctccaagaagtcctgcaaaaatgtgattaactcaacacttaccaagcatgatcaatgttaaacccttttctgcacctaaccatggttaccttgttgaacagtttggaaaacactgccccagtttaacctctttgaacttctcttgccatggctctgtttatgctgtttctccctttctgatgcccagtttggatggccttttggattctccttttgggaaaaatcgtcattatcccctctatcttttcaagctcatccaacagagatgtcacctgctttatgaagcccactctgatgatcctaactcagactgacattgcttttcctctaactcttgaagcacttttttttagctgggctatttggtgttcctttactactactttctggtgttcctttcaccatttatgtttataatggcattcttttcatctttactatgcaaaaaccagctttaaaatttcttgaagggattgatggttctaatttttaggttggaaggcagaattgtgaagaaacatgagctttggatcaagacagttatttcagtcacattttggttaaccagctgcatgactttgggcgaattacccaacttcactaagttttagctttcttatatctgtaaaatggggacaatgaactccctacctcttagaggtgttgcgaagagtaaatgagactatgtacagtgtctaatgtattggaagcaatcatacatgtcagctgctgtcattattatcacatcagtggctaagaatgcgacacaaaaaggtcccttttttgttataatgactgtacatgcccaatattctgggcaatcaaaattcctcaatattccaaatattttggcatccaaagaggctccctctctctttgcaaaggcagagagaggtatgttagatgtatccattgtctagcaaaaaatggtcttcctcccagagagagaaagcctgttgctgtgactgccacattccctgcattttctggtccatccagattgtaatagtgaatttcacaagcaaacacatagtccaaagcattctgacttctggttcaatataagtgctgtgtctttttttttttttttctggagacagagtctcactctggagtgcagtggtgctatcctggctcactgcaacctccgcctcctgggttcaagtgattctcctgcctcagcttcccgagtggctggacttacaggcatgcaccaccatggccagttaatttttaaaatttgttttaatttttttagtagagacagggttttaccatgttggccaggctggtcttgaactcctggcctcaagtgatctgcctgcctcagcctcccaaagtgctgggattacaggcgtgagccactgcacctggccaagtgctgtatcttgcatgaagaggtacttggcccctgcctgtggctagcgtgtccacctggtatacctgacctggacatcaggggacatgcaggtgtaagtcagtggctgggcagattcagccctttagttaatttaggttaaatttcacttgaatccatgtgattgtttatactaagatagttcagcaaaataaaatgtcgagtccttttatattttacatgataaatatatatgaatcaaggaaaaagaacttctgtttatttactaaacgtttatcgagtgcctactatttaccgggcacagttatatgcagttgttatacaacagtatacaaaatacagacaaccctgttgtaatggagctgaattctgatgggagaagaaagaaatcaaacaagggaatgaactaatatattatataacaaatggtagtaagtgacgtgaaaaaattaaagtaggacatggaagacagagagttgggaaagtcagggaaatcctttctgttacaatgacatttgagcacagatgtgaagaagaatctgggaagtacttgggctaaggaaattctcaaaaggtaaaggatcatgtcgcctgatagggaagagaaggcagctgagataaagaaaaagagtggtttgaagctcgctaaaaaacatgccagattttgtggccaagtcaacaagtcttttatctgcaaaggaattcaaaagccattggtgggtttgaaggagaggcactacatttgtgtttttggaagattactctggcagtgccaggtggagaatgggttgagggagtgaagtagatccagaggaagaggaagagggaggagctcaggtgactgatgggtgctgttgtttccagggtggccatgctggaagaggagcaggcttgctgagaaagatgctcacttaggtcagttctggaagggcaatgttggggcggtccaagagagagtctctccaatgcagatgggagcagtcagttgaagtaaaacctccctggagaggttatttttttattttttatttttatttatttattttttgacggagtttctctcttgttgcccaggctggcgtgcaatggcgccatctcagctcaccgcaacctccacttcctgggttcaagtgattctcctgccttcgcctcctgagtagctgggattacaggtgtgcaccaccatgcccggctaatttttgtatttttagtagagacgggtttttgtcatgttggccaggctggtctcgaactcctgacctcaggtgattcacctgcctcagcctcccagagtgctgggattacaggcgtgggcctctgcgcccagcccctggagaggttttaaagctggtggctcatggatggtgactggggccatgatgggagtgcatggaattatcagggagctccttagagtgagaaagaagaggaccgaaaatagagacgtaggaaggctgaagatctaagacctgaaggaggggccagaaaggaggccagaagacaccccggagcctgtgaaaacctggaggctgcccaccagatagcatgatgatcaagactacaggttctggtgtccaacccacctggctttgaatcctgacttccccactaaaactgacatgactttcggtactaagccttgcagggtgattgggagggattacatgtaccatgtttaaaatctttagcactttgtctggcttgtagtaggtgctcagtaaagtggtacatgtggaaggggatatggagaggcacatggatggaaatggagatggagagagagacggaggtattctctaaaaatgttcaactcgaagtccttggcagcattaacagaaggagtggcagcatctcagctagcatgccagaataggatctgctgtaactctacacagcccagagcctgtcatgccctcgggtaatgtaatgaaaggtgttttcctctcttcagaacaggtgctccactgatacaatttagagtctcaaattccagagcttaattgtttgttctacatacaagttagcccagctcagaacacctgtgggctaagttcttttgatgcaccaaagcctgtcttttattaagccctttgcgagcagtcaaaataagaccaaatgtccatgtgtcgctgcgtaaccatgtggacatgaaacaagccagccagcgtgaggagtgcacagtaagtgcttaaaatagcaagtgaatccttaggctctggaaaatatggttacgtgattaatgtaaccagagttagagatgaaataacattaaatattttatatatatagaaacttgcctacacacacataaaattccctattagttgtagttgaggtttagtcatgttgaatcgataaaaaatgatttagagcggatggtttcaaaagctggttgtgctttcagtcttccataaagaagttaaaattaattttaatatgttgatggtgcttattgatgataatattcataataaatatccatcggaaaaattctccggcacatctgtgtgacagagaggtcaagaatgttaatgacgatcaggactacaaaatgcaatccagtcaattactttaattaaatctaaaactactttatgtcttctcatttatgtagtaaactgatagtggagaaaagggcaccatctttatctggctcattgtagagtccaaagatgcggtctcagattgttttaacatttgtagctcttatatccttgtggaatatttaaagtatttatgggtcttatgagtaatgctcctgcttctgtaagaagaagaaaaggtggagattttcctttgaatgccgttttgtagaaggagagctttcttttcacagacactaatcttgtatttacagactgggttatatttggtagagccaacattccagggtaaatggtagaaacgtctacatttcagtgaatcctttttaattatattgtttgggatcagaagaaaaagaacacagctgtctgaagttctccctaccacagaggttcaagtgcttataacccagtcatcatagcctgcaaaatgcctttttattaattgtggtatcatacaaaagttggcatcacctatgtgtttcggttattaaacttggagaatagaaaggtgagcattttagaaaatgaatcaattaatgaatgagcaattcagtcagtttttccatgaatattaacagcatgtagtgcctactgtgtgtcatgtggtgttacaggcatctgaacacagctgtaaaccacacagagaagatccagtctggacctcaaggggttcccattttagcttgaaggaaatgaggaaacaacaaaaaaagtaaactgaattttatcagataaggcaaaaactatgccaaaaaacccccaaacaaacaccaaagcaggatgatgataggttgaccagcttttcctagtttgcccagggctgccctggtgttagcacagaaaatcttgtgtcccaggtaagccctcagtcctaggcaaactgggttgattggccatcttagtaatgggaaagagagcagctaaatgagaatttattttggatgagtggtcagggaaggcctctctggggaggtgatacttgagttgagataagagcaatgcggggacccagagctcacactggtaatcccagcactttgggaggctgtagtgggaggatcgcttgagctcaggagtttgagaccagcctgggcagcttggagaaaccttgtctctaccgaaaaaaaaaaaaaagtagccaggcatggtggtgcacacctctagtcccagctactcgggaggctaaggtgggaggatcccctgagccaggagaggtcaaggctgcagtgagctgtgatagcaccaatgtgctccagcctgggtgacagaataaaaccttgtctcaaataaagaaataaataaataaatggagcaatacaaaggagctgccttcatatacctgcagatccctcaggatgaggttcatctcctggtgatctttcaaaagaatagattcgtgctttgagaagaagaataaacatttatgaaaagttttctgtgagccaaacagtgtaaatatgttatctcatttaattcctacagccccaagtggtaggtaggcattagtttttccattttacatgttagacattaagtgataaataatgtctgaagtcttgagcctaatagaaaatggcaataagatctttctctgcttgaattcaaagcccacaggagggagtgtgaaaagtgagtttaagtacttttgggaagaagaaccactttctgcttggagaagagatgaaaatggatccttcatttatggagcccaagctcttgctgtacagcccctgaaacctcctctaagtgggattggcttggacattatcctttaaccactctagatctgacagccactgggctaagcagcctctttaagatacctcttaaagaactcaggactgcttgtggaaacagaaaaaactatggtgatgggaattggagtttctgcaaatcacagataagagggaatgagtgtaaatttttagcattactatggtcctactgtatctctgggttagtgttgcctatgggtgaatgagaggcgtgtatctttgtcttataatttagcttctgggatgtgtgtgttctttaaatcttagagaagacctcatgtatcatgtctttggattttccattgcagctaacacagatgcttgcatgtagaatgaaattcataatatttgttgaaattcaaatatttggagagtcagcattggcatactggcgaagttcagtttttgcattcaaagtgatttttataagacagtctctgaggtgactcactcctgggtttgactaaaagctattttgggcttttaaaaaaaattccttgccatagttttatatatacatatatatatatatatataactatatataaaaatatataaaactatatatataactctctatataaaactatatatatataaaactatatatatatataaacttattctttaaaagacaaggtctcactctgtggtccaggctggagtgccatggtgtgatcacagtgctcattgtaaccttaaactcctaggttcaggtgatcctcctggcttagcttccgaagtagctgggactacaggtgtgcacctccatatctggctaattaaaaaaaaatttttttttgtagagatgaaggcttcactttgttacccaggctgctctcaaactcctggcctcaagcacttggattacaggtgtgagccatcgtgcccagtaccatagttatattttggcccaactcatgctatgatgacaaactctgaaggtataaacttatttagcttaaaatacaaagatgtgagaaagcacttttggaatggtagagtgaggacattaaaaaaaatacataccacttcctcataaaagcaataagagtactggaaaaatagttaaaagcaactttttcagaactctgaaaattaatcaaaggttttcagtaacttgaagagtgttgattcaagaaaggtggctgaatcttggtaagaataataagtgttgtgatgttttaacttgccctagtcccattccactctctccagttctgtagtaatattgaaaactaacagcctcacaattatggtagtcctgaatgtaagcagcctagcagctactgaaggggagaagttccatctccagaaaactttcactgtttgacctgtctcacagcttgtctttgatatgactcagactttactctgtacaaatagccttttgctaaactatttgttgaaaacagtcagtggcaattatttaatgtggcagctacctgaggtgataataacagatgaggctaccaagaggctgagcaaaacatttaaaaaggaaaaactgaagaatgatatgagcatagaaggttttgaagagctccaacatattcccaggaatctagaagtccacgtgcaagttcggggctatgcacctgctccagaaagatccgaggaggttctgagttctcatctgtgactaacctgaagtttctgtgtaagcaggaagtgaaggcataggcagaattctcaatgacctgactgagcattgtagatgccctcccctcttccagaacttcttactgaagcctaggggactcattgtttcaagtcatttaagaaaatctctggggtgagtgtggtggctcgtgactacaatcctacccttttggaggctgaggcaggaggatcacttgagcttaggagtgtgagaccagcctggacaacatggtgagatcctgtgtcaaaaaaaaaaattaaaaaaattatgcccctgtggtcccacctatttgggaggctaggcaggaggatcacctgagcccagcaagttgaggttgaggtgagctgtatttgtaccttgtctcaaaaaaaaaaaaaaagaaaagaaaagaaaagaaaaccctctgtctgagcattagctaagcacagagtttctaaacagagactttagtggctgtacatgaccaagactacaaatgttacagaattagtttgaaaaagtcactgaacaaacagcagcaacaacaataaactttaagagtaacaaatcttgaaggaatcttctttccagaatagccacattatataattttatatatatatatttttataattttattttatattttatttacattttatattatatatatgtccagttttcaaaaaatatgcatgagctacacaaggaaacaggaaaaattccagatgttggaattactatacaaaaactttaagtcagctactattaataagttgaaaaaaggaaagaaaaacatatttagagaattaaagcatgaaaataatacttcaccaaataaagaatttcaatgaatagatagaaattataaaaaagaaaaatagagatctaaaatgaaaaaatacaatcattgaaataaaaatttgctagagttgcctaatagcagatacgaactgacagaagaaagaatcagtgatcctgaacatagttcaactgagattatccagattcgggaagaaaaagaaaaaagaaatgaataaaaatgaatctatgggacgctagtgtactaaaatatatgtaataatcacagaagaagaggagagaagaaaagttgaaagtatatttgagaaaataatggctgaaaacttcccaagcttgataaaaaacgttaacctgtacattcaaaaattttaaaaaactccaagtaaacttaacacaaattgatccacacctggatacattataaactatcaagacagagaaaatcttgaaagcagcaaaagaatcatagagtccaccataagatttaacagttgacttctggtaaaaacccaagaatatcaaaaggctactgtttacatattcaaaaggatgatagaaagactattcatcaagacttctatattaaatgaaacttttctccaaatataaaggataaataaaatcatttccagagtaggaaaaactgagagattgttactagcagacctgccctacaagaactattaaagagagagtccttcaggctgaaatgaaaagacattagagagtaactggtaaatgtactacataggtaaataaaaatatagcataaatgtattttgtttgtaaatcatttattctcttatttaaacacctacttcataaagcaagaattataaaactgtgtttatgggcttacactgtgtaaagatacaagttaattgacaaaatttcacaaaggagagagaagaaatggagctatatggaaacaaaattttagtacactattgaaattaagtcggtagtaatttgaactaaattgttctaaattgggatgttgatcataatgtatggggcaaccactaagaaaataaaaaaaaaaaaaagtaaaacaaacagcaaggacattaaaacaatatactatatcatatgtatttaacataaaataaggcaataatggatgaacagaggaatcaaatatggtagaagatatatagaaaataaatagcgaagtggaagataaaaacttaccttatttgtaattacttaatagaaatgtattaaccactccagtgaaaaggcagagattggcaaaatggacaaaaaacataatccagctctatgctgtctacaagagacaaactttagattcaaagacacaaattcattgaaagttaaaggatggaaacatactaggcaaacagtaaccaaaagagaactggagtggctctcttgaagacgaaatagacttcaagacaaaaagtgttactaaagacaaagatagacattttataataataaaagggtcaatccatctgaaagactttaaaattaaaacacatatgtacccaacctgacaagagagaaataaaactgtctttgaagatgacgtgatcttgttcacagaaaatctcaaggaatttattaaaaatttattagtgctaattgttgagtttagcaaggttgcagaatacaagatcgatatatcaatatgtgataaaatcaataaattctatttctatacactagcaatgaacaagttgaaaatggaattaagacaacaattctattttaacagtatcaaaaagaataaaatatttatgaataaatttaacaaagaagtgcaaaatgtttacactaacaactgcccaatattattgaaagaaattttaaaagacctaaataattggcaaaacatcccatgttaatgatttggaagacttgatattgttcagatggcaatactcccccaagtgatccacagattcaagacattccctttcaaaatcttagttgcttccccgctctgcattaaactactagttggtcctaaaatttaaatagaaatgcaagggatccagaatatacaaaacaagaaaccttgaaaaagaacaaaattaggggactaacatttctcaacttgaaaatttaggtacagtaattaagatagtgtggttctggcataagggtagatatttagatcaatggaacaaaatggaagattcagaaataacccttacatgttccgtgagttaatttttgactagggtggcaagtcaatggaggaaagaataatcccccaaaatgatgccagaacaattggaaatccacttgtaagagtaaatttagatactctatcccgcatcatatccaagaattacctcaaaatggatcatagacctaaaggtaagtgccaaaactgtaaaactgaattaggcaatggtttcctagatggcactaaaagcaaaagcaacaatagaaaaaaaataggtatatttgactttatttttatttttaattttttttttgagacagggtcttactctgtcaaccagactggactgcagtggcacgattatagctcactgcagcctcaacctcctgggctcaagtaatcctcccacctcagcctcttcattagctgggaccacaggtgtgccaccagtcctggctaattattttattttattttgtagaggtgaagtctcactttgttgctcaggctagtttcaaactcctggcctgaagtgatctggccacctctgcctcacaaaatgctaggattacaggaatgagccactgcgcctggcctaatttgactttattaagcataacaaaaaaagctgctgtgcttcagaacaccaccaaaaggtaaaaacagattggcatgtggtttatgcctgtaatcccaacacttaggtaggctgaggcaggctgattgcttgagcccaggagttggagaccatgggcaacatggcgaaacgccctctctgcaaaaaaatacaaaaaattaactgggcatggtggtgtgcgcctgttgtcccagttacctggtatgctgaggttggaggatcacctgaggctgcagtgagctgtgatcacaccatgcatttcagcctgggtgacagagtgagaacctagttcgaaaaaaaaaaaaaaaagtaaaaacacaatccactgaacatgacagaatattttcaaatcatatatctaagaagagacttgtataaagaatatacaaagtgctcttacaactgaataataggccgggcgcggtggctcatgcctgtaatcccagcactttgagaggccgaggcgggccgatcacctgaggttgggagtttgagaccagcctgatcatcatggaaaaaccccacttctactaaaaatacaaaattagccgggcatggtggcacatgaggttgtggtgagctgagatcgtgccattgcactccagcctgggcaacaagagcaaaactccatctcaaaaaaaaaaaaaaaaaaacaaaactgaataataaaaagacaaatatgtaattaaaaatgggcaaaggatttgaataagcattttttttctgaagaagatatacaaatgggcataagtacatgaaaagatggtttatatcattagtctctaggaaaatgcaaatcaaaaccacaatgagattcgtgacacacccattagaatggctaaaatttaaaaagacagacaataacaagtgttggtgagcatgcagagaaattggaaccctcatactttattggtggaatggtgaaatgctgcaacctctatagaaaacagttttgcagtttctcaaaatgttaaagatagaattaccatatgatctagtaattccatgattaagtataaatccagaagacttgaaaacatatgtccacacacaaacttcttcaagaatgttcttagctgcattccttataatagccaaaaagtggaagtagcccaaatgttcatcaactgattatttgaaacacaaaatgcaatatatccatacaatggatattatctggtcataaaaatgaatgaagtacagtattaatgcacgctacaacacagatgaaccttgaaagtgttatgctgggcgaaagacgccagacaccaaaacccctgcattgtatgattccatttgtatgaaatgtctaatgcaagcaagttcatagagacagaaggtagattagtggttgtcaggagcaaggagaggttagaatagagagtgattgctaatggacatgggatttatttttgaggtgttgaaaatgttctgaaattagatagtggtgatgtttatataactgtggatttactaaaaactgctgaattgtacactttaagaggacacattttatggtatgtaaattatatctcaataatgctgttataaaatctagtaatatgctttgtaggaaaatgtgtataaaaataaacatcttggtagataagtttttataaggtaaaaaaacagaggcaggcgttcagattttcccgctaatatctcattttctcttgtctgttttagatgagtgtaaggccattatcatggactttttccccagctgcaggtaggtgtacccatttgactgaattctggcctatagggtaagaacgaaatgtcttgtgaaactgctctgttgtacccttgaaagaaaattgctggctgtctatgtcctccttcccattttaggcaggctgaagtgtgcagatgaggggttgagccattgtttttttgtttttgtttttgtttttttgagacagggtctcactctgactccccaggctggcatgcagtggcatgtttgtctttctttctaaaacaaattattcttttacaaaattaaataatttaaaattatttttaatgctaaaaatattgtgcatgcaatggtgtacattcccctcccaggctcaagcaatcctcccacctcagcctcccaaaatgataggattacaggaatgagccagtgtgcctggctgccatctttgaactggttgttaagagcaatgccgttgggagctgggatgctgggccacttgatgagcagagcctacagaatcactctaatgccaaagagaaatacattctctaccagatattggccattgttatttttgccacttttaaagcagtcaaaccaatcttctcacttatagaataacatctttggggtcatgatatatattttttaagatttattgttccttcccatgaatctatgttcagatggttccaaatgaaaaactctgagggtatcaggacacatacgaccagtcccgatcttctggacgtttaaagtaggagctgtctgcataaatagcaaatagaaaacacaatttgaaacacaagagcagagtttcaaatggacttttgtggaagtgtagttcaagttgaggggaacaaaagaggactggaggaagatgtagaagagtaaggtgacctgagccaccccttggatggttaggtggagagcttcagcaggtggaagggtgtggccaggggggaacagaagagaggtgagtgcagtagacattagccaaggtcagaatatagcagagtgaccaaaggggaaaatggttggagattatgctgagctcttcaagttgactggtgctgcagataattggattgaagctcaggacagatgtccaagtgagaaatttaagtttgggaatcatctgcagagatggtggttgaagaattgggaagggctaaaacttcaaaatcatatggcttgttctatcatcaggattagccttctctaattccctgtgtgctctttgtctttctaaaacaaattattcatttaaaaattaattttacggtggctcacacctgtaatcccagcactttgggaggccgaggtgggcagatcatgaggtcaagagactgagaccatcctggccaacatgatgaaacccagtcaatacttaaaaaaattaattttaaattatttttaatgttaataattttttaaaaaggaaaactggtaaaaatttcacttatatgtattaattacaaaacaactctaccttatcaggatacaaaaacactgttaagaaaatataaattggatggccaggcatggtggctaacacctataatcctagcaatttgggaggctgaggtgggagaattgcttgagcacaggaattcaagaccagcctgggtaacataacaggactctatttctacaaaaatccaaaaattagctgggcaaggtggcacacacctgtggtcccagttgctccagaggctgagatgggaggattgcttgagcctgggggggtggggtggggtggagggtcaaggcagcagtgagccatgctcataccagtgcactcagcctgggtgacagaactggaccctgtctcaaaaaataatacttataaattggaataagaaattatgttgcctttacacacctgcaaatggttttcctaaggagttagttgaaaaattatactttgcttttctccaggaatatttacttataattttccctgtgccaatttggcaccataatgtgaatacaatacaatacaatacaatacaatacaatacaatacaatacaatacaatacaatacaatacggtacggtacggtacggtacggtacggtacggtacggtacggtacaatacaatacagtatagtacagtacagtacagtacagtacagtacaatacaatacagtacaatataatacagtacagtacaatacaatacaatatgttaatacatatcattttaaaggtaaattagttattatcaaattgtttttatttttaaacaattttagagttacagagatattcaaaatagtacagagaagtcctatacacttttcacccagcttgcccttaagttaacttcttacccacaagcgtgattctgagaaattaactacaattaagcataatactattaactaaactccagactttatcagatttcaccagtttttcttctaattgtttgtgtgtgtgtgtgtgtgtgtgtgtgtgtgtgtgtgtgtgtgtgtccaggatccagtcaccgatctaaaattgctggtagtctttaagttttaaaatcctccttagtcatttaaaaacatggtagtacagaacattcgctctagtccatctgaagcaaaggagactggaaggggaactatgaactgcctgtttgagaccaggattagttatgaataaaaccctagacctgtcaagtggatggttgtgggaatcaaacatgaaagcactctgaaaattatcaagtatttcactccagtaagatcatttattcattcatcaatttttcagaaactatttcctcagcaccagtcatatcttaggcaccatgttcggcaggggaatcacacaaaaaagatgccggttcttgcttgccggtaattctagccatggaaagctgatcattaagtatttattgaatgtctaccactggccctacgataccaattattacctttcccttagagtgcactcaatgactgttccattacaggcttgaaagagttaatgtgctgcaaatgcctctgtgcctggggagttctgcaccacctctgcccaggctgcagaggcattaggctccaagtatgtattttcttttcccttctgtttatgtctctgttttctgtaaagtctgctaaaccgcagcagtatcttccaagttctctgacaatgttataaatttcattaagaagatgaagccttctggggcaattaactccaaaagtggtacaaagccatagcaaggagatactggcctgtagtacttagcactcagctctgaaatggagataagccctatcaacccggggttgtgtttaatgttcactgcagcttccataccaccgctacaagctagcggtcaccgtgttaacactccccaatatctattacaattagtttttgattaagaggcctaacatggcttttgaagctttttatgttgtgtcaaatggctagtgatggagtgagatgcacagacacctcccggtaacaaagcatattgtaaaaggtttcgagtgaactattttatcatcctaatggaaaccagatgactcgaactccccccttaatttcaactatttactgaagagtccttgttttgaattactgaaagatttattcctatatgactacctcatgcattaagaatcgctaataacagagccatttggaatttgggaaagcttttaaaaatgactgaagcaatgttcacagaggatttattttattttattttattattttatttttcatttgatttttaaagagcaaatgattttgccctttcctagtatttaattattcctttagttattgtttatgacgcctttctctgttgagttatactgtctctgccagggtttcagtcagtagtcttggcctgctgtctaagaaagaggtcactggtatcttgtgaggagagaaaactttgttcagttatgtaagatataattctttgtgaactgaaactatatgctatttttgtaaaggtccatttgatgaaacaaagtataattattttaaaatccctttatagattaaaaagctgaagatctgaattgtttgacattttattactcttaacatgaacagtcacatgtaaatgtaatgaaagtggtatagaaatatgacttaacttgtgagtgtgaatcgtaagagctttttacggccgggcgcagtggctcacgcctgtaatcccagcactttggggggccgaggcaggcggatcacgaggtcaggagattgagaccatcctggctaacacggtgaaaccctgtctctactaaaaatacagaaaaaattagccaggggtggtggtgggcacctgtagtcacagctacttgggaggctgaggcaggagaatggcgtgaacccgggtggcagagattgcagtgagccaagatcgcgccactgcactccagcctgggtgacagagcgagactccatctcaaaaaaaaaaaaaaaaaagagctttttactaacatacttttttactgactctctggcctcattcatacatttccctttgaacctcagtttcctcatctgtgatctgggggttgaatagacgtgccctgagtttttgttcatctccggatgttattgactctgtgacatcagatgtgctggagactgttagtgcctggagcgtaaaggttttatcacggggacacagtatggtgtattgggttcaaaccctggctctgcctgttactgacctgtcattctttggcgtaatactaacttattaatgcttagagtccttccatgcaaaataaggacaatgttagctatttcacaggtgacatgaaataacctaggaaataaaatcagatatatagggtgcctgataaatggtagcctctcaatcatttccgtttccccctttttgccttcacgttttgtcctgtttaatggtgccttgtacaactggaatgaatgaaatgaccacgatgtttgtcatggacctccttatattacaaacacttagtgagcacttgctatgtgccaatgttgtgctaggtctggggatcctaagactagaggcagaggcttgctcatacaaagattgggtcatagacagtaggcagagggtttcaatagagccagacagtcagaaatgagtagagatggcagctgtcaggagggccgcccactcagtgcagattgcagttggggctcactctcgtatatgatcacatacatcatttcaggtagtcttctcaaccaccccctcggcctagcaaggcaggtgttatcaatctcccctttgtagattaaaaagctgaagatctgaattgtttgatattttattactcttattaataagatccattcaaaataaaacttgctgtcacaaatgtaattgcagcgaacatgtgcaaagatttagaccaagtaaaaaaagctgtagtagatttacacattcatatttcacttatcagagtctgttttctaagcattatcgcttggagccccattcatttcattcatttatgcattcgtccagcattaatacactgttttccaagcacagggctaggtggtgggggtttgaagatgaaagcggtagcctctgcgttcagcaaggaatttgcagtcctgtgaggtgataggcacttgcacccatgattatagtgagaagtagctgctggcccagaggttgacagaggtatttgagggaacacaagggaaaggccccctgaggtggcttagatgaggccttctggaagaggggaggggacaattgaacttagctgaattttataggattcaaaagggacaagcgaaagtaagggtgacatggagatactcgaggtgaagagagtctgggagacaggagaaagcatggctctctggggctgttgtcagtggtgacaaggtaccgtgtggtggggatgtggctgtggagaagtggagaggcaccaggttatgaggacatttggccaacactcgtccttcagcaagaaacaagttcccatatacactttgtagttcacatctgttgaagtctacccacatttaactagtaaacaagccttgtatcttatttctttccatttcctcttgaacccatctcgtttgctgcctgtggctagtctgggttgatagtccaccttagcggttggttagaggctgctattagtatgaccagccttaaataatttgattttcaggttgggtaagtcacagtatctcctgtgggcttgatagtcaagctacacatttatttaaaaattggtttcttcacattatatttgaaagcagtgctactcattcatctgtaaaccattaggctacatgtataacagtatctcatctgacttttatctacggagttccgaggatccgtttcaggtccttgcggatattccagttctctatgaagtctattgtcttattttattagttttctctttaggacaatcctatagtgaactgtgtatttaaaggagaagagaaaccgttgaataaattgtagagatacactcagactttcctcctcattggcaaattttcgggcgttcttttttgtttgtttatttatttgtttttaatttaaacaggagatttaaactggcctggtgtggcctgcagtagataacgtattgtttggcccatgagttataaatctagagatttcacacaaaatatggcttctttaaaaaatcaaaagatatgatgctgtggctcttaggggctcgctgtggggctaaggcacattcactcccaggttcctcagggtgcctggggcacccacttcactcaccaggattccctgccacatccccaacacctttgccttcctgtctacagcttggacttgaccttttcccattaaaaaactgggtgaatgccaatcagcaggtacaaaatgtaaccctcttagcgcagaagttttaaaacaaggcatggacttaataactcaatgaggaagcaaatacttttacagaggctttgcaggttagtgataaaataaatttcctgagtgattttacccattgccatggaaggaaaacaagggaaccacaaatgttagactaagtacaatttaccagatcaatgatcgtccagaaaattccctccatccttgcacttacttcctatcatgactgtctcagaactgttttttggtgagaatatgagaaatgtaaaaatgaagaagtaattttctcactctctaacaatcagaaatcaccactggggttttcttatatttttcggggggttcctctggcacccactttcctgagcttggttggaagtgctagcttttcctggtgttaattattaatgtgacctgtttatgtaccagttatccggctaaccattaatatctgtttactcattgatgacctttgcaattgcgtacctagctcctggctgtaaatgtcaactttttgtttttatatgctaaatgttttctctatatctactgagtacctgaaacaactccttaacaaggtaaaataatatcaagccacacaaatataacctttatgaatatgaaaaggaagacaagttccttttcaagctattttttctgagggctcagacaagctattttttctgaggcaacagaactttcctgtttggaatgagcaagagatgtacacaaatggcaaatgcgaaggatccctgagggggaaaaaaaaaaaaaaacaattggcaagaaaaaatgttcttctgctctctgcttagtttggggaggcggggtcgggggcaggggcagggacaagtaaaggactctgacctaatcctggggaatgaaacccaattttactttttcaaaatgtcagtgttaagcacttgcacattcaagcaggcctgcaggattgatctccagctacccagtcagtccacattaaccccaacacgaggaagacatttccattccacacaatggtaatggctaaagctgagattaagcaatgcagctggattagggctgcaactggtgaccttaattttacccatcattggagcctgtgtacatttgactcttcttaattgcatttgcctaatttaaacagacaatagtagcccaagacattttttcacccccaaataataaaaaaggaagaagagcgttttcctagaaattaaccacaggacagtgttgttatgtctgctgcttgggtaacaaaagcagctgttctctttctcttgccccattaacataccagcactggggaggacccattgagatattatccacctttgcataacaatacaactttaaagtctcatagtgcttctttagcgaaatattttaaaatattaatatcatcccagctgtaaataaccatgatggaattcatagagattaaagttttgagatccgccttaggtgtaccttcacattttcttgttcattgagtcctaacttcagtaaaattagtttttttagatagagctctgaacacttgctgtgactgtcacttcatgttgaatttatcatatagaatttaaggcggaagactggggagcaatctgtcacaaacgattgtattcgtaatcgttgagggttgggatgggggctggggagaagataagcatcctagggccgctcttgtcgcctgcaccattcattcggctccagtggcatcggcgaggcgatttgtgtaggctgagtgtgtaatgtgtttccttcaagcctgccttgatggttctgtctatgctgtacttcatgcacataaatgcctctcaggttttttcagctaagtgataactcagcttgtctttcccggtgaattcggtaataaatagatatatgggctagacgtggggtgttctgacttagttagatcctctcgtgtcctggaatagacaagtggactcaatcattgtgctagcaacaagatacatactttccagggaagcacggggttttatgctaagtttacaatgacatgaactgaaaagcaattcaaagtcaaggttagtatgacaacctcacatccgtctagggcatctagaggggaaaacggtcaaaatgcaacattattttctttgaaaactgaacatctgttaggggattttgaaatgatagagaagtagaacagttgagttgcttcttgaactcatttaatgtgtacattttactctgggaagtaagtattttcccaagactgctattcagcgctgcatttttttcctctgatgtgccaggcgtttcttcacaacctctggatgttgcaagtcaagtactcttaatagcttgcagatctatatctgggtatcaaaatcacaggcttttgaactttgccaatcagaatcccacattacatttcctttttatgtcacatgctcaatgagcttaattgacacatggaaaatttcctgtatacatcttactcaaggcaacactggaaatttgggtttatggaatgcgtcggcagccctgaacgctcttggcttcttcgctgctggcttggtctgtggcccagaatgatgcaagttaggcgtagctcagaactctcaaattagctgctggggcggtgttaggagtgtgttcaggctcaagagccatttttgagggctggaagagggagtggggaggctctggcccactccccactgtgaggcagcggaggttaccgttgtttgtgaagactcaggccgttaacttctgcaggaaatctgccctcattcccagcctgcagtatggctaggggcctcatcctgggcccctgtgggatactgggattattctgtctgtagcacttatcatattacactaaagatctgctcatggttctctcctccaactagacgggggaggcattgagagacaggactcagcacccagcactgtgtctgacctgcagagatagtaaaggcagcctaggtgctgggtaggctctaagactaagcaggactggacatggggatgccaatgataataacagctcctaattatggaacaggtactcagtgatcataaatgctagcctaggtgattccctacacccattttacagatgagaaaggtaaataagatgtagcaaggtcaggtagtgttcacagggtaaattaggaagccagataactgaaaggggaactgggaaatcccaggctattccttatgctctgaacatacacacctctgatttatctgaagaaagataatacttccatgatcaaaatacaatggaatagcacttacagagctagtgaagcctagaaagagtccaggccttgctgcagttttcttccagtggcactcagaggggtttgtgttttcagtttctgtattattttttggcctatgcagtatttcgttcttagcattttgcaataaattggtggtctctcaatatttctatgtatctggttttaccatgtcccagttgtgtgatcttggaaaatttacttctgtgttcctctgtttcctctgctgtgaatgtggggatggagggttgtcttcaggagtgaccattctaatatttgccaagatcctagaatggtgcttagcacgttctgagtgggcagcaaacattagatgttctgatttacggttctagctgtccctgtctcttctctcttctgcttgccactgtccccacctacctgagcttccctcttgtggctgtgctgcccacaagcgtgttgggtgctgggaactttgggtggcgcatttgctgcatctgtcagcctgggattaggggccagtggtccacgctcatcctctctgagaggcagccgcttctgcaggggctgccatggattgtggcttgtctgtaagtggcctgcttctctggccttcgccccctttccatctatcaaaatctctctctgtctccctgcctctctctctccctcctctcaaaggcctcgagcttctcccctcttcctccctgctggcattatctcctcccacagcttgagctttggggaaacaaaagccaggtgtcttggctttggacttttaaaacaaacctccctcgaggcaggggcacagagaggcctgacttcctttgtagagcagagggcaaacgctgagataaaaacacaaattaatatatcagtaaattatcctgccccactgacatactctctaatcagaaagacagtgaaaacacgggaggatgccaggaaagaatccaggggaggaaggaggagccacacagccagcagcagcccaaggagagcagcccctcgggaggctgcaacggctgaacttttcccctgacattttactggatgtgcagggagcaccagcttgcaccaccgtggggtgacaggaagagagagacaacagtgagaaatggagaatggaggaaccaaggaagaaaaccgaggcaggggcaaagaggcagggctaataaccatgtgggctaagatctcactcctttggactcataatcatcacagtgaccttccttagtggcctcactcactacagaagtcaccccattttaaagatgaggggctgggcatggtggctcacacctgtaatctcagaggcgggtggatcacctgaggtcgggagtttgagaccagcctgaccaacatggagaaacctcatccctactaaaaatacaaaattagccgggcgtggtggcaggcgcctgtaatcccagctactcaggaggctgaggcaagagaattgcttgaacctgggaggcggaggttgcagtgagtggagattgtgccattgcaatccagcctgggcaacgagagtgaaactctgtctcgaaaaaaaaaaaaaaaagaaaagaagaaaaaggtaaggaaacaggaagtccaggataagtggactttcccaatttcctgcacctgctaaatgatggagtcaggttttcagccagaatgttggaagatggtgatcatgcagttaaccactttgctattaatacaggctccctcttgacaagtctgtgatctgatcaaactggagaactcagttggtgtacgtaaacagtaaacaaaaacctggtagaaccagaagaaattaagactataaaagagaatgagccagaagtggtggtgtgagcctgtagtctcagctacttgggaagcttaggcaggaggatctcttgagcccaggaggtcgagactgcagtgaacacgccactgcactccagcctgggtgacaaaatgagaccccatctctaggaaagtaaagaaagagaatgaagctctactcccaggacctcaaatatgaataaaattttcaagtgaaagaataaaattgtcacatccaccacgcgctgaagagcttgcacaaacatggcctcattgcctccactcagccccctgggataaatcagggattattgcccttttatagatgtggaaactgaggttcaaaaaaattaagtgactgagccaagtaaataagaggcagagtttaagatggaacacagttctactgactcaaaatccaatgttgatgacatggaggacagtatttgtcagaggggctcatagccctgtactcaagggctgccaggaaagaagaataaactaatatcccttctccccatgcaagctggtgggttcacttaggaacaatgcatgttaaaggtaaactagtggggttgcacagatgggaagagaagagggattttcaggtggctttcagctgatgcatttgatttggcaggagaggagaggtagttgggattcaagatatgaaggaaatacgcaggaagggagcaagagtagcaaaaattgcaaagctgtgagatagagaggaaatgcaggaaggatttcaaagcagagtataggcaaagaatgcctggcatacaatctggagaggaaaaagatggggaaaggaagtaggaagtgaaaaccgagggaagtggaaaagaaagtgaacatgtggatggtttggaagctgtcctcaaaaagtagaaatgtggcctggaatctatacaacacaaacgaaagggaatacaatgtttggggcaggagaggaaacacctgcttaagaagggtatttgaaaagtcagagccacacccagaccagaagattcgggcagactgatggacatcattatgatgagaaaaaaaaaatatctgtaagtttcagccaaaataaaagaaaaaatgtggagtgaggaaaggaagaacaaccacaaaaccagtgttctttttagaacttgctagaatcacaatagaaatattgaagcactattagaccggtattttctaaacatatctgaggatagcacctcctcttatttttaatttttactttttttaattttttgagatacagtcttgctctgtcacccaggctggagtgcagtggcacgatcacagctcactgcagtctcgacctcctgggctcaagtgatcctctcacctcagctccctgactagctgggatcacaggcgcatgccaccacacccaactgatttttttggtttttagtagagagggggtctcactatcctgccaaggctggtctagaactcctgggctcaggcaatcctcctgcctcagcctctcaaagtgttgggattacaggtgtgagtcaccactcccagtcctcttttttatttttaaaaaaccttctttaatatcttgtggaactataattttaggaacatagtttataaaatgttaacttggtagcattagggtggacttttccacccctgaattccatcctcccaaattgtagtcctttttgagttttgaatgatggctgattactcttctgattcttggtgctttcaccatgcctgcctatatgcaacctctgttagggttatgagctggaaacccaggcttgttagaattttgcataaataagtgtcataggattttgagcattggctttagagagtcttccatgagcaaatatatgagcttggcaccctgaagcttttgcagctattttgactgcccacaggatttttcttgcttacttactggtttcttagcttccattcagaaggcagaactttccagctaattgacctccaaatagttgaagcgtgattgtattattgctactaataatattggcattgcataaaagcaacagaacaagtctgcagattatacactgcagaggccctttaaagaaacagttaatccagagattaggctgcatattctgaggactttttcaaatttttgtcaggcacacactctcatctgatgcttgcaacagtgttgagcatattgtttgtgaagtggtagtgaaccttagtatgagaaatacatgaccacctactggtggggttacaaaggcagaaattcagctataatcaaacaaacaaatgcattattctttctacacattcatgagacaagagcgtaaactcacttgtggaatttacagttttccacaagcggatttggcggaggcatctgactggggatgtttctatgtctttcactgtatgcatctcttatcataaaatttaaacaaagaaatgaaagttggccacttgccatggaattagattccatcatagaataaattctcatcactagtcctaacggtgatacccaagatacctttttggataccttgaaggtaggatacttcagggtccaatcagatacatcaaaggaaaataaatgctaacataaaaatggccaaaggaagggaaatagtgatgtcgctttgtgcaacttttagagtagtttgtttcatgccagacattacttttatcctttctgccccatttattataaaaattttactttgaaaatgttattttagaaggaaattttgttgtcacaagacttaaacagaggaggtgaaagaattagatagtgaacatccaggtatccatcaaccactttcgacaatgaacactttacttctcttgctttttcatatctcttgccatctgtccctccctccacccaatcatccaaccgtcttgattttctgatgcatttcaaatgagttgcaggccttgatactgttaccactaaacctttcagtatgcagatcattaactagaattcaatatttatttacaaggtttgtttttgaggtagatacagtataatgtacaaactatgtacattttggtggattttggcaaatacacacaactgtgtaacccaaacaactctcaagatctgggatgtttctagcatcccagattgttctctcatgcccatcccaccaatccttgccccattttcccaaagacaaccattattctgatatataatttttcaccctagattagttttacccattttaggatttcctgtagatacaatcacgcagtgagaaaaagatgtgcagggctttttcactcagaatagtggtttggagattcattatgttgttgtgtgtatccactgtagtttgttcctttttattgttgagtagtattccattgtagccatataccactgaggagaatttttagagagagagaatatgcaccaaagaatgccagagaagagtttccgggataatgagatggtggtggttggggggacctgaggtattttactataaaaaagggcacttttaggaaaggacaggagaactaccttctactatttaaggcaagaatcagcaaacattctctgcaatgggccagatagtaaatattttaggctttactgggccatgtggtcttttttcaagtacttaattccgacttatagtaaagtaaaagcagccacagacaatatgtaagtgaagtgtgattgtgttccaataagacttcatttatggacactgagatttaaatgtcatgtgattttcatgtgtcacaaaatattattcttcttttgatattttttccaaccatttgaaaacttgaaatccattcttagctcatggcccacataaaaacagatggtgggccagatttggcctacgagccatagtttgtcaatctttgataaaaaagcactgtcaaatggaaggaggaataattattctgtttagaactagtgggcaatatgaagactaaaggaggcagcttctgctcagaaaactgagtaattaaagtagtgttgaaatggactctaattccctactttgtctctgtcccttgcccctattggtagcatagaattagcaggacaggctacagggctagtctgtttagtgcaattgtccagctcttctcagtctatctgtgtgacctctggcaagttagtgaactcttttctgtttccattgattcatctataaaataagagcaataatagatcctacctcctagaggcattttcaagattcaataagttgagtgtctatgaagttctaggaacagtgctgattcacagtcagtactactcaatatacttaggacagtgtctggcacacagtaagtatgaaatatgtgttcattattatcattactgttgttattgctttagtcattgggaagttggataggcatgtgcgagaattttgttgaaggaattcctacttttcatagtaggctggactaatagatgcttaagttgctttcctgtcctaatcatcagcattctcttcaatttagtgccggatactttgaccctgaggctcaactgttgttgaaatctgagaagaaataatataacattctagtcattaatattagcatagcctacataataaggtaaaagtacagttgggcctccatattcctgggttccacatctgcagctttgagcaaccacagattaaaaataattgtaaaaaaaaaaaagaagtaataatacaacaataaaagtaatacaaataaaaatgcagtataaccatttacgtagcactcacattatattaggtattgtaagtaatctagagatgatttaaagtatacaggagggtatgcgtaggttatatgcaaatactataccatcttatataaggcacttgagcatctgcagattttggtattgaagggggttctggaaccaatctcctacagatacagagcaatggctgtgtattttgtttctgcttgatctctccttacgctggatcttggacctaactctcagtagatctgattaattataaggcctcatgtggatgctgactagttgtaatgctactttaattttttctccatgtgagaaagtgagaggagtagggatctttgctttgtaaagggaaatgtgtcaaagcattaagcaagcattaatttttcctcagagctttattcacatattggacgatgctgaataaccagagagttgtgcgattatgcacaacattattaatgcaattatgtctggatgtcctgtgatgttgtgggactggtgctccaagcccattatgattgctgttgcctgttgagaacaggggaatccaaatagagttgactgtggcagatctccatttgcaacccctcatcccccagttataacccttatactagattgttgtctttgtttacttggtctctgaaatttattttcccaagcctgattatgtatcgtctttttctctgttagctggctggaatgatggcccctgtttctaggtgtggtaagcacgatataaaatcacaaaatggtactaacagagacctgtgtgattatttatgtcaacattttcattttccacatgaggaaaccaaggcacagataagagaaacttcatgcttccagtccagtgctgtttgtattatgccagattcatcttcgactctaagcaggatcggatgtggggtgtgttgttgaaagtggcaggagagccagatggaggcaagccccaccttcatgcctacaatgtagagttttggcattatttccaaataaatatatataataactggaatactactctctgttatattgaacactctcagaaaacattataaatatcaaatgttaaagcctaatttattaaaaagtcctgttaggggatgtctttattatttcacatattggaatctcaaattgtggcattggtctcagcctttctgtaactcacaaaagctctactgatgagaaagtgataccatagtatttacatgggtgcttaaacatttagacatccatgtgaacagacgattccaggaagaattgctggtaggacacagagcaacatcaaggcaggccttgactcatcctagatgataagttaaaaaaaaaaaggtcaacatggacgtgaagaaagaacaataaaagggaagaaatgctagatagtgaaaagggagaaaagaagaaaagaaaggaggtagtgtaccctggcagttcccaggaagttaaggtggcaggggaaatgcaaagctctctgatggggatgaggctcctagtcttttgacaaaaatagaaatgggggctttcaccgttaacccccacatcacttaataaagcctgttcaatagtctcatgtgttttttgaagcataaaggatttgagttgactcttactattttctagcttgactcaaagatggtttacagcacaggaagttccaaggtttcacataaacaatgtcatgagagttattaatttttggagttaagattattgcctcctaactgactttctgaactttttggatttagaaactactgctttgaaggcaaatatttgctttccatattaaaaaaaccactttttagagtatgtaaaatgacacactaacatgaactaaattcataatgaagccaaattctttttaaaaatattaaatctataaaattagaaaaccatttcacccttttgtgtaaaatacctatgctaatgccttgctcactcgttttttaaaaaatcaattttaaggagaataaagaattctgctgcaaaaacaagttgaaagtctaaaactcgtttattgcggtagaggctccaagatcacacacgtccattagaggtattcagtgcagggtcactggagggtcggcaagagacagccaattagatgtctgtttttcctttcaaagtcctgtctgtttccttcactctcttcaaaacaccctaagtagacatatatatcatgaagtcaaagcgaaaaaaaagaaaaaagaaaagaaaaaagaaagacaaaaagaaagccttagaacagtgggagttttattatccaatagtcatatgcattttaaatacccatcattatcaagaggaaaaacgaagcctggtgtctggtaagaagatgtgctacaaagtagaatactattcaattttgtctaaactcaggcaggaaaaggctactgaatgcaatccttggtttcccaccgtggaagatagatgacttcaaagttgtagcaaaagtatttgtttagagtagggaggatcaagactttctggtatttacagtgaaaaaacaacaacaacccagcctatcttttagaaaaggaatgcatggttaaattggctcagcttgtccttagcaacctgaactcggaggccacattttttcctctctaagaagcaagtgggaacttgaaaagtatgtagcatgtcgtgaaaagggagcagtgaactttgcccaggtctgcagccagcactgaaatctgaaccttctgtagtccctggactggtgtcccacctcgctacccccaaccttcctttttaatccctctgcatagagcgccttagcaaactaccttggcctggaagcagagcagttgtgacttctgagggaaaacctgttctctaagtatttctgatgccattaagaaggaaatgctaatgacaacaaaaaaccccactaaaccccagctttataattatgattatgatattcaaccttattttttataatatgtatggagaaaatatagaaagattttgttctgttgcattaattttcaagatagcttgagaagttttggaggttccctatgtagagattgtcactgcttggaaagatttttcttaccttgttggcggggaatatcatcaaaagccctgcatttaggcggcttgcagtatgaatcgtttcacaacagtaagttacttggtaacttgagctgcactcgttcctgaaattctttcacctaattgaagattaacttgattccccggattgttgatggtggttgacagtgtggggctggggtgggtggaaatagattattcaactcacaaagaagtaggtgtaccctaagtgactgttccattactgatcatgattgtttgccttcctaagtattcatcaaactcggtgctgcaggatcgtgtggggagggaggagagtgtaccgccagtgttcagaaagcaggtgaacctcagagaaacttcaatattttgtaaagagacttatatgtagtaatggctactccagaatccattaacgcccaaacaagccgactcaagggttctggctttctcaagtggctaatgtaaacaatatgaaagtcaatagtcggggacattccaagatagtattaacacgattgatttattgatggttgcacaatgggaggttatcttttgttaattgactcggtaaataagctcccaggcgtcagggcatagggggaaaagcaaccagtggaggaaaaggtgaggcacctggattataatttttttcaactcccagcctgtcttggtaaattccataccacttcctctgccaacctcaaacacagtttagcaattttaattccggccaaaactctgcatccatgtttcatgaggggaagactcaagggtggtatgttcctatcaaacaatccaactttctttctctttctttctttctctttctttctctctctctctctctctctctctctttccttccttccttccttccttccttccttccttccttccttccttccttccttccttctctcttttaaaaacttttacttcaggaagattaaagcaatagtagttgagagagagacagagagagagagaattcaccgacttggcttatttattaatacaaatctagaaatggtagggaagatgcatgtatgatcttttttttttctttttcttttttttttagatggagtcttgctcttgttgcccaggctggagtgcaatggcacaatctctgctcactgcaacctctgcctcccaggttcaagagattctcctgcctcacccccccccaagtacctgggattacaggcgcctgccaccacacccagctaatttttgtattttttgtagagacgaggttcgccatgttggccaggctggtctcgaactcctgacctcaggcgacccacccacctcggcctcccaaagtgctgggattgcaggcatgagccactgtgcccggccttcacgtgtgatcttttaacctccaagaaatgattgaaccatagggataatacattgtttgctgttggcagttatttatgcagcatttctccataaagactaccataatttggtacttcctcctcctatgaggaagggggaaagaaaaaaaaatgctttataaattttggtcgactcctagtacagcagtcccccgtatccgcagttttgctttgcatggtttcagctacccgtggtcaatcacagtctaaaaatattcagtagaaaattccagaaataaacaattcctaagttttaaatttcacactgttctgaatagatgaaatcttctgccatcctgctctgtctcgcctgggctgtgaattgtccccattgtccagcggatccatgctgtatgcccacccctgcccgtagtcacttaggagccatctctgttgtcatattgactgtcacaatgtcacagtgcttgtgttcaagtaattcttattttacatagtaatggccccaaagtgcaagtatagtgatgctggcaattcggagatgccaaagggaagccgcaaagtgcttcctctaaatgaaaaggtgaaagttctggacttaataaggaaaagaaaaagtatcctgaggttgctgagatctacaataagaatgaatatagtatccatgaaactgcgaagagggaaagagaaatgtgtgcatagtatgtttagggcttggtgctgtcttcggtttcaggaatccactcagggtcttcgagggtatccctcaagcgcaaggggagactgccgtattatgtctgcggaagtgggacctcctagatcaattcctaacactttgaacttggcaagatagatttttttttggacttttacacttttatcagcgatagtttaaaaatttaaattgctcactgtttaacccttgctatcttctagaacagtggtccccaacctttttgcaccgggaaccagttttgtggaagatgatttttccatggacagggttgtggggatcattttgggatgacactattccacctcagatcatcaggcattagattctcataaggagcacctaacctagatccctggcgtgagcagcttacaatgggggtcagctcctatgagaatctactgccactgctgatctgacaggaagcatgatccgaagtgatgctccctcgcccactgctcacctccttctggggcctggttcctaacaggccacagattggtacggttccgcaggctggggttggggacccccgttctagaacactcaaaaaacatcaacttctcccttcacgctgtcttttcctctgtctccctaaggcttttctttttttgatacgggcattctttaagctctgacttctcttttcctctttcctctgccatctcccgtcaatctcttccagctgctggctgtactctgcaggggagttcagagtgagcgtgaagtacaaatcaacacctgcacccactccagctctgtctccaccttccaaccatttcccgtcctgacttttctatttctgtacctaacccaccccaacccattctgccattgtttttggcctcaaaacttggagtccgcctcacattcccactttcttctgtaagttctcaagtcctatagattctgcttttaaaatgtatagttcataaacgatgagctttgcctcccagatagattaaattggactgtggattggcacacggtaagtattcaattaatttttgttgaatgaaggaatgagtgagtggctcctccttaaaccagggtccctgctccaaaatataatcctacatagctttgcatactactgtattcttcataataatcatctctgatcacattatttcagggctcaaaaactgtcagtaactagttttctcctcaatccagggtaaactactcttttttcaagtcacccacaatgtctttttgtttatcttccactaaactcctaaatatcctatgctcaatacagaatattgcttattttcctctaaattcttttttttttttttttttgagatggagtctcactttgtcacccaggctggagtgcagtggtgtgagctcagctcattgcaaactctgcctcccaggttcaagcaattctcctgccacagcctcccaagtagctgggattacaggcatgtgccaccatgcctggctaattttgtatatttggtagagacagggtttctctatgttggttaggctggtctcgaactcccgacctcaggtggtccacctgcctcggcctcccaaagtgctgggattacaggcgtgagccaccacacctggcctcctctaaattctttatatctctctgcttccctattttagctcattttatttcttcaatcagaatgtttgttcaatcatttttttaagctgcatttttttaactgtttttttgaggcccatttcaaatgctaccctgtccatggagctatttttagttccatatacttctttctcagccaagctagatgtgctcttcctcttggggcgtttattgtattcagcctgtatcgtagatatttctatacttgatttattctttcctaatagaaggtaaatgcttgggagacaggagctaaataaatcttgcttctttcttctaagcctggactctcagtgccttgtacatagtaggcacacagaatgctattattgaattacaatgatttttatattttcatccgtgtaagatttttttctttctcctttgattgcatgttgttgttcagcattgtgtgcgtgtgtgtttccccatttgctatgtcctgcttagcacctttagttttgaaatacacatttatttatgtatctttcccattttgacctagtaaataaaatgtattttttcatgtgactatccaaagtgagagaggatactgtgaaatgtctcatgaactgctgttccaaggtagtatttataagcaatcctttgatctggatttcttttaaattttgtgtttatctgtacacatttagggggtacaggtgcaggtttcttacacgcatgtattgtgtagtgaaatccacatttatcaatcattattttaaactggtcttcggaatgcaggcaggtccaggagcagggctccttcagtttgccctgctgcagcctgcttcgggtttgcccagctttctgttctttccctatccctcttaatgtctgggaattagttacgctgaagttccacttcatacagagctgcctgcaacttgagatgcaaactccaacactgtgggccactttttagaagcatgtggtcattcgggaaacaaaggcactcctgtttcctcttctcaataacaattaagacatcagattaatagaatctttaaattcttgaactatgctcgcagaatagtttgtgtttgctttaacacaaaggaatactttccaaaccctaaaggtcacccaagaaataagagagagacggcttatgaatcgtgtatgctggtagatttttggagaatggcatgtgtcctaggcagtgcgctctggctttggagcgacttggcatgggagtactctgtgatttacgctggagaggcatttcctgggcaaggaatcccctgtattgaaggggcatgccattaggaggagaagaaataggggcggggcggggtggggaagaggaaggcttcttggttcacattctggcattcacttaatgagtgtgatgttcttgctaatgggatttaaccacaatacctatccctaaccttgtcaccaaaaaggtagtctacatgccccttttttttcaataccgtctgcctggtaactgtgcaaaagtctgttctcccaattttctaaatggtaatcctagaattatcttggctcagaaatgaatgaagaacccgtgtacaggactcaaatttccctacaggggttgtaactgaagcaaggattaagtgccagtacacaaaacctctcaagcaatggacagcatgtcgattgctaaacattctatggtagaaggcctttagtttttctcttttataaagcttgagatcaagttttggtaagaagtaaaaaagcaaggcaatttagctcctttaaaggattgcttgttgggaaggacagagctatatttagctctgtggctgtgtctccaggaagctaaagcaacaaggcaattaaatggtgaattgtgtgtgtgtgtagagagggggctcagggggagggcaggttagggagattataatataggccttaaaaagaatctgtttaggaaaaaaattttcaaaacagttgcaaagtatcatgaagatacagcagactattgactgaccacctgttgcacatcgcaaacctttattttgaagtggaacagacagagcctgaataactccaagttcccccatatggtgatagcaataataaactctctgtcatttattgagtacctactatatactaaacacagtgctttacttctattaagccatttagtgttgacaactgtgctctcggcagcaaataacaagagggtcttgcccaagatcacatagctgctaagtggttgaaacagatttgaatcttgttctctttctctccccacttttagttgcttatatacactatgcctcctatactcttccctgctgcactggcattttatgatctttaaattcttatattacagaactttgaccttctaggagaaaggcatgaaatacacccccctcccataatgtccatactcatatacgtgtgtgtgtgtgtgtgtgtgtgtgttaaaacatctacgtctaaatctacaatttaagtggagtgctatccttaaaaaaggaataattagaaactctcatttacattgtaatttacattcagatttcctggaactgtagctttactcttttttgcttttttttaaaaaaaaaaactccttttatttattataattcctggagatttggctctgctcatgtcctagatatagggttatggatgtggggcagagttcagcgagacagagctgtgtcaggaaacaaaacagcggggtagaattgagtgtcatataactagctctcagtcgttgtttttctctcattttgtgtggtaaacctaaggcctgtttgattttgcatcttcgaatttaaaccctgggtaaacaggtagatggcagccaatgatcccaagtggaaattattgtcttacaagagggtaaataatttgaccaaatctaaacatagaattcttcttctatgagtgcagtttaaaatcacagggcattttagtgcatcgtcatttttccttttcacacttattcccttattgagataggtaggaatcaagaattgcatctctgggaaaattgataagtgttctttctgaaaaaatcaacagtatatgaataagaagtatatttccttgaatgatattgttgttagtttaacaccttaaataaagaaggtattcaataatttttaggaaaatcaaatttagaaataaacattcagatatggaaggcctaacaaggctgttctcaaagtagacaaaggaatacttagaatcttattgaacctctttgggaccagctggacacgatcattgctccggtcctctagagctctaacattctttgaatcaataatagcccagtgccctttcatttctgggcccattcatttagagataggataaagtggtcaagaaagcaaaattcagctgttgagtccagaggtagttggagatataaatcagaatatttcttcctcccagatcaaaaagagagaagttcttatatctgctcgtgtttgaagcagagcagcaaaaattgtggtggatataaaaatctaggcttattacaagacctaggaagcaatctcagggggatggtcttgccatcagttacctgagattatttaattacaagcaactcgtgattacctgtaaaggcgagagatgcagtggaaaactcaaacaatgcttgttgcaaaatcatgtacattggcttgggaatatcccgtatgacattcccccccagaaatttgccttcctaattatgttttgcttagcccaatattaaaaattagttagtttccccggagtagctctgaagttaaactgcggagggagttggttcaagagcatgccaattggaatatggaggatgaaacattttctggcactaatgtggcaaaaaatcccaaagttattttaatcttaaagaaaaacataatcttgagcaccttaccagccttcacatattatctgaaatgctataaacatttgtaatgattacataaatgagattatttttatttagatatgtgtgtttttgccttaagaatgtgtgttctcactctcatccttcttggcagctaaagaaaataataaaccaattttcacagactcaagcatagtgctctgcacacacaattgggtcagaaatatttgttgaataaataaatgctcctgcttaggaagggtctcattttgtagcattgaagacagattaggctagatttggaaagttagaactagaggcggattagaaatcttggatccttgggctacaacgttgtcgtcatgggggggttcttgattgaattctcttctttctttccttcttcctccttccctccttcccttcctccctcccttcttccttccttccttcccttcttccctccctccctccctccttccttccttctttccttattttcctttccctgaatttaaatgacttcatagtctaatattcctagagcatatacaaacttgaaagtaggcatatattcctgaaatttatggctcttatacaattgcaaatccaaaacaaatttacaaattgaattcaaagaaaatgacaaactcagccttcaaattaacaacactgacttaatgtgatggacaatggtttgctaacgtttaattgctactcacagcattaattttgttccaactggtatgctgatgatgttttgattttagtatgcctatatttccttgtaatgtataagacaattccttaacacttttctgtatttaaactactgcaaaactttggtccacacagaatactggaacatcatttaaccttcacttggcagaaatccgtaatttacttacttgggggcggggtccaggttttgtggggcatgaagagtatacaatttttagggcttttaaaaaaatatatatatatatataataaaagtgaaacaaaattgctacggtccctcccaaggcattggaaggaatctgcataggagtcgaagctcaagcttcattagcttcatgctaaatccatctgtattcatgtatcaagcccgtctctatttttttcttgttgctaataaagaagaatgacctggcaacaatgaggagtggcatttttttaactttgggaagatcaatcttaaattacacattagtgtatttaaagattattctcaacctaaaaacagaaaattaaatattgtcattgatgacacagagacgactgagaagtaccttttagttaaattctttttcccttgataaattccaaggaggagttgctggaaccaagttttagagctctcaccaacttttcttggttggatttacagaggtcaaagtttggagtgcaactagagaggttagcagttcacttttcccagaccgcctggcttctcatagcttaatctctgggcacagctgctgtgagcacacagtccctgggactcatatcttgccctgctcctggcctgatgacaagactgggaggaactgtgggcaggtaaggccaaagggaacctcagaccaatatttctctggagggcagagggacaaacagaatccagaggttgggatctaccttggggacaatgtctcagagtccaatggttgcaatgagatgtgttgtgagtcagagctagggagggaaacagcaggcacaggggatgttgaaaggtcagccaggcaacggaaaccaggggtcaggaagaattctgagctatgatatcagttggcatgcatggtggggcaggtattcatatcaaaatcaagcaagtttcatttttcaggatccaagatcttcctgccttcctttcctggtaggactcaagggattcttcctgggctcatagacactaggtgtgaaaccatgcaaaaggacaggaaatgggtgtcactcttctttattgaggagattctggaattatttttaccggagttgattagagaataaaatgtggtagtcaagatcagacctgtcctctcaggctcttttccttctaagacaggagaatcttctgagaggttcccatagaagagaaccctcacgctgcaagtatccaggatacacattctgattcatgcgagttctaagaaaatctttattttgggacatttgaggcttgtcatcaaagaactctaactttctatctcccatctatctatctatctatctatctatctatctatctatcatctatctgtcttctttctatatattttctattttctatatatatttctattctatatatttctattttttatataatatatatgtgagatatatatcacagagagatgtattctttttctctatatatatatgtgggaaagtgttttgtaaatggtgaagaactactgttgttataatcccatttctgtccaatgtagatgctgatttttatcttgcttgataattgttttcaggtgagattatatccgataaatactttttaaattcctttttcttctgtttcctttctgtttgttttctttttgcttttgtttctttagttttctggtgaaaaatgattccattggaaattttatatcagaacaagtgttttcagaaaaggaagggattctcagatttaaaggaaaaagtttccctaaaagtcagagcagctagagctactaggaaacccctttatctaatcaatcaagtcttaactataacacactcaaccgatgcttgggtagaatataaattccaagtcacatgaggtcttatcagttataatactgagaaagaattagcccctctgttttggtaagatgatagctgtgggctaattcgttttttcttgatatatttgggggatttgaaaacttaggaagtaaacaggttattttgttcagggaaccttttctgaaagagttaccagggttcatctgatgccattagctttgccagtaatttccatgatgtcaagggcacatgggagattaaagagggattaagacctgcttgcacagtcaaagcatcacagtaaattgacttgacttggcaggctacacttcaggttggcaccttttcaccacctaatcatatacaatccaggtttgcagtgttagctaggctactttcacagaggccaagaaatgttaagcaggcaaggtaggaggtgaaagttgctgggaaggagtggatggacttccaggagaatgctcaaggccaggctgccaccatgagctgccgaggaggattaaaacattaaggaaaatgcttgttgttgttgttgttcttttttcctcagaatctttcaaaaatgaatttcattttctatttaccctccttccacccgctcccaagttttccagatatacgttcctcttaaaacctttttaatcgctcaggttattatcaactcttctgcaaaaggaatcaggtttgcccaggaacttcactgaataaagatgagtttatatcttaaaaaggaaacagctggatggcaaaagccagggcgggaggcagctcttgtttcattagtgaagggaaactcgagggcccggagagaacaactgggctggcagccacggcggggagaagaaaaggaaacacacgatcataaagaactaatcatgaaaaatggaaagtgagaaagagccaagaacaacaagcaataaatagatttggaagggggaaaaagatgaggaggaatgaaaagctatgctcaggaaagaagcaacaagagcatgtgcgtttcatttgaaaaaaattaatgattctgaaaatcattaaaaagtcttaaggaaaatgttttaagatagcttttcagacccaggttttatttctatgtgttgtttcagagtctattccagtgcatgaaaaaaaaaaatcatgtggaactagtgggagaaacttaacatacaatgtgcctgagtgattggtttccctctgctttttttttttttttaatgatttctgcctgatggtggggaatagaagcaattagtttggctatgtaggatcactgataaatctggggattctaagattaactcatacaattctagtcgtaattagaaatatcaaatacattttcacctgtgcagtaatcacgtaatgttcatttatttgtcatgagggggtgataattcagcactcacaggtatatctttaaatattttcagacgaaatgagcatggatttaaggaggaactaagaggaaaaccggatcctagtctgtccttcatcttgaaagaggactattggtcatgttcatatattttatcatgttgaatctgttcatcgaaacatagccaatagtccaggcaagcctagagagaagatatatgtatatatatatatatatatatatatatatatatatatatatatacacactatttgaagtttcacatcagttacagataatactttacaaattaaatgttgttggtcttttatttgggggatgccttattagctttttaaaaattagtttttaatagcagcatttgtttaagaaggaagaaaaaatgcttggtggtaccttctggaaggtacattaatcttgttaatgacaccacagttcatggttggcaaaacaggacttttgaatcaacctgtattgtgtgtgtgaatgtgtatgtgcttgagaaagaaggccagggcactaaagatacatgagaagtgcatgaagacaggatgcaggatttcctatgattttatgttgttcttaattaggaagcatattggcagcaaatgctaacatgtgttaggatgtttagctgaagccaaataaatgttttctattacaactctgaattccatgcctggtcggaacccgtgcttttctgctcatggcttacaaaatcccgttaaaagtcatctcaagggccaattttctgttggctcacagagcaaaatgactttcaccacatgttttcctgaagggttatctacaactccgggtggaagtcaaagattggaagaggatgacctctgatcctggaactgcattgcttggtggtcaggaggggttcttagtaagcaaactcagtttaatcccagagtcggaagtgggtgtcaacaagccaaagcaacatcctttcagctctgctgcttttttgtcttggtggaggaatagccaatggaagaagatggagagtccggaccaaaaaaaaaaaaaaaagatgaggtaaagtagctacacttgtgtacataaggaaccatgtaaaagtatgctatgtatgtatgtatttatttattgttttgagacagggtcctgctctgtcacccgggctggagtgcagcggcaggatctcggctcactgcaaccttcacctcccgggttcagatgatcctctcacttcagcttcctgagtagctgggactgcaggaaggccccaccatgcctggctaatttttgtatttttagtggagacaggttgccatgttgcccaggatggtttcgaacttctgagttcaagtgatccttccgccttggctggccaaagtgctgggattaaaagtgggagccaccgggcccggccatttttttctatccacgtctttttcactgctgtgtctgagaaattttacacgctctcatatatgtagctgaaatgatgcaggagttccccggcaccagccgcttggtactctcatttattaatatcaataaatcaatgaagccaggttgcaaggcattcttaggtattcattcaccatgctaggaccgcattgcctggagctcttcagcagtttttcactgcaaggccttcacacaagctagtccctctttctggaacattcctctccacgttttgcacggcctattccctcgcctggttcagatctcttcccaattgtcctttctcctccagctttccttgatcccttcatcattctttcctctatttgtatttatttatttttgttcattgttttcttccctcctctagaatgcccatttcaagaacgaagggaatttattttgttttccctgctgtgcctcaatgcctaggacagtgtgaagaacatagaaggtgcacaactaataatttattcactgaattaacagggccagggtgtttttgttacttgttacagatgtgtgtgtaacattttcaaagccttggaagttattaaatcactttcccgcattttatatgcaagactcctattattcttaataagagtcagctgtacatctagactgcattaaaaaataagcaaaactacattttccttggccttgtaaacaatcccacatggtatatgggccaaaaaaggaaaattaacaraaaagggagaatgtaccaaaccatattcagttagtaaaaggggatgtttttccatattcttaaatgaagatcttttacccaatatatccagtctctcataaaccatgaaatgaagtgactgggtatcagaactaattttcagaagaaaaactgtcatctttaaagcagtaaaatcttcataaaactgtgtaaactaattactgggttaagtaaaatcactgaaatatatcaggaccttcaaatgtctccagggcagacataatatagtaattctctaatagtcactctggggagatactgtaatgggcgggatgaagtcattgtaatattctcatttagtttgggtcctgagacttataaagagaataccggtggcagactgcacatacggaagagatgcctattyatttcacatgatactagctggcctttccaggctgtggatcatgagctcaggggagcccaatggagatgggcatactcatttgttctgcagagaagatatgccgaatgtttcttctcatccctcctcatcaaagagagtggaaaatattttgtgtacagtattttttgctttaggttatttagaagccttatgtatattaggtttttacatgtgagcaaataactaaaaacaagarcaggacctaccagaagcttcaacagaacagacagaccatggaagacctcatgttcttttgaattagtgaaaagctatatagtttaagtaggtatcttggtaatctaggataaatcacaaggattgggtaaactcaatggaatattgaaggtttattttattaggtaattttatatacatttaggccacgtgcagtggctcatgcctgtaatcccagcactttgggaggccaaggcgagtggatcacttgaggtcaggagtttaagaccagcctggtccaacatggtgaaacgccatctctattaaaactacaaaatttagctgggcatgatggcacttgcctgtagtccagctatgctggaagctgaggcaggagaactgcttgaacccaggaggcagaggttgcagtgagccaagatcacactactgccctccagcctgggctactgagtgagacaccgtctaaaaaaaaaaawatatatatatatatatgtatatatatctgtaatgtgacattgttttctcaaacctcagactaatcttatgctcaatatggaagataatcataactcatcactctggattataactgcttacatatgtctttcttatgagataatgcaccttgaaggtaaggacttcactttatttgcttcattctccagtgtccaatttgtggaatgaatgaatgacccttaacagaaacctgactgtgattcccttcactattaacttttcctagagttatgaattccagttagaaatttgttcagaaaatcacttgtccttaggaatataatttcacaagacacacaagttgatttccttatartctatcatggtgatttctaccctggctcaaggctgtgattcatgaagaagagtggtaggaaccagacttcttaaaagtggtgagcatcaggccacaatctcagaggatagtgtatgaggagtaaaattgggaagacacattcacatttacccaaatggcttgcacattaaaagctgtacaccctccccaactccaattaactcagagggaaatctttgggcgggtttggttctctccaatgtgtgtgagcctgcagttgcctggctggctcctgtgtccctttggaattgataatgaggttcaagagagaggaatagtcctcactaagcatgtcacccctatttagcaccttttccaggatggcagccactattgttttattatgtctctgatcagctgtcactattcataaagtaatcactgccattaacacatcacgcctcaagccatctgctgcagcatggcacacacagagctgttggttgcaagcaaagcaggtgtcacctaaaaatgacagtaccacagtaaaggtgggaggtcatcatggtgaaagaggatatgtcacgtcaagtaactctattttttgatgtattatagtgcaatgagcaatagtatttcttgctcaatttgcagaggctaaaattaaaacttcttatttgagatactttttttcaatattggtaagtcatggagacaaaaaatgtcattgaagttcttaaaacaatagcatctagattgtgaatgaactcttgcattaaatttgcagtcaagtttaaagcattcttgaagagatctgatccatcaaacctttatttgacaagtgtttattgagcacatattaagtgacactgacatgtggctggcccacccgaaatatacagttgctacgtaaaacaaaantcacaagtaatgtgtacagtggagattcctgatcccagctgcatttttgacccttggtcagtccctaacacttatcttgattttggataattttttggatagttttcagttttaacaggatccatattgattggattttatgtggatgtgttggaaaataagcttgcattggaaaaatacaatgatttcataaagtctgttaagaaggacaatatctttataggacaattagttctcttgaccaccttcattgtaaaggggctttatatttatacaactgagagaggagataggaatttaattgaagatcttaaatgctgatagaaagtgggacaagggatcataattgggttcaactatctttctagccccttcccctcctgcatatacactggaattgcatccttagcttaacttmagaaaattcatgtatttatccttggcaaatatacacacttatacatctatatgtatatgtaaaaaattaactagggtagttaataattctaccctccattttattgcatgagtttctgctcttttcctgggagtgagaagtattggatgagggtttggatcttctagcccatcagttactcttagcaacatcacccatcctttcctactggtgatgagagcatcttgctgcatgggtggtggttctcaggtgtatacaacaagtactcttctccatgatgcacatgtccacacatcctgtatgctactgctggtttaagggattttcaagggtcaattcaatagtacatttagaaattaacttctgtgaaacatgctactcaattacaaaccaattgaggaatgctacataaccccaaagtctatagaaagcaaagatatccatcttctattgatatagaagatatctataagatatctatatagggatctctcaactacttttgaatccaactttcttttgagaatcaaaaatctcaagctctctccctatccctgaagatttatagaatcatctgttgtaaccaaaaaaataaaatcgagcttgaatttttgtgcattcagaaaaatgtcttttattatttttttcaaattctataatgatctatatgcttttcaaaatgggtcccctttctccctggggattatgatatgcccaagcataagaggcattttaactttaaggatgatatttgtgaatctgggatgcacgcttttcaagataccagtgaagcagcagaggatgagcaagcagaagtgtctcctgatgactgatggccctttctttttttyttcttttttttttttgagatggagtcccagctcggtcacccaggctggagtgcagttgtgcaagctcagctaactgcaacctctgcctcccaggctcaagtgattctcctgcctcagcctcctgagtagctgggattacaggtgcccaccatcacgcccagcttatttttgtatttttagtagagacgaggtttcaccatgttggccagactggtctcgaactcctgacctcaagtgatctgcctgcctcggcctccccaagtgctgggattacaggcatgagccaccgcacctggcctgacagacggccctttctaaggagactgaggtggtacatttgtgattaccagatacgatagagttgatattgaccgttgcactagtgacttaatagtttttttaaaaagccccaaaattgtttgatatttcatttgcatcaaaatgttgtagctcaaatggctttatcagattggctccttaaaatatcatgtgccgttgttctaggctcagaaggaacacaaagacaaagacaaatggttcttgggtcctgccctcaaggcacttacagtccagtttcagttttagaagttcaaccaagaacatggctaatggctggtagagattgtactgactattataccacttctcctaaaatattattttggttgaaataataaaatgtagattcaaaacaaaataaaataatattttactgcatttttctgtgaaagaaatgggggaatcttgggatttcaagataatccaacaagctgagtagggctggccataggtttggaactcatggagatcacagtggaaacccaggaaacattctcctgagggctgcgtctccattaatgttttctgcctagggaatgtgcttgctctggctctatgggtaaacaggagggtgaagaggaggctgactgagttaaagacatcagcaggttgggaactattaacactgaggatcatctttctgtttttattttccagacagggtctcactctgactcctaggctggagtgcatcatggggctctgcagcctcaacctcccaggaccaagcggttctcccaccacagcccctcgagtagctggaaccacaaatattcatcaccccacctggctaactttttcctttttattttttatagagacaagttctccctatgttgcctaggtgagtcttgaactcttaggctgtagtcatcctctggccttgggctcccaaagtgctgagattacaggtgtgagccactgcacctggcagttgaagattatatgcggatcacctaggtcaggagttggagaccagcctgaccaacatggtgaaaccccaggggctctactaaaaatacaaaaaaaaaaaatagctggtcgtggtggtgggcacctgtaatccccccttctggggggtctgaggcaggagaatcacttgaaccagggaggcagaggttgcagtgagccaagatcacaccactgcactccagcctgggcgacaagagcgagactccgtctcaaaaacaaaacaaaacaaacaaacaaacaaaaaaaaacagaaaaaaaaaagacggttataatgggaccatatttttaccatcccatttatatgtttaggtatgtttagatacacaaataccatggtgtgaccattgtctacatcattcagtacagaaatatttgtacggatctgtaatctgcacaaatctgtacaaatattagcctgtacagatttgtagcgtagatgcagtaagccataccgtgtagcctaggtgtattgtaggctacgccatctaggtttgtgtgactacactttttttttttttttttgagatggcgttttgctcttgttgcccccaggctggagtgcagtggcatgatctcgcctcaccacaacctccgcctcccaggttcaaacaattctcctgcctcagcctcctgagtagctgggattataggcatgtgccaccacgcctgactaattttgtatttttagtagagacggggtttcttcatgttgaggctggtctcgaacttctgacctcaggtgatccacctgcctcggcctcgcaaagtgctgggattacaggcatgagccaccacgcctggccgtatagctacactttttgatgttcacacagtgacaacaaaatcacataacatttcatgtctcagaatgtttcgcaatcattaagtgactcatgattgcacttaatctctctggtctgtaaaataaagacaaccagaagacctactccaaaggattgttggggtgataatataatgcttaaaattaatactataaaataacgtaatacaaaatatttatgatatttataaatacagacataaaaatatagttttacttatgataatatttctttttttctttttttgagacagagtcttgctgttaccccggctggagtgcagaggagcgatgtcggctcactgcaacccctgcctcctgggctcaagtgattctcctgcctcagcctgccgggtagctgggattacaggagcccaccaccatgcccagctaatagtttttgtatttttagtagagacaggttttcaccttgttggccaggctggtcttgaactcctgacctcaagtatcctcccacctcgacctccccaagtgctagtattacaggcatgagccactgtgcccggcctacttattatgatacttctaagcgtgataaagcacttatacgtctagcacacaacaaatcctcaataaatgtaatgtacgaatgtggcagattaagagaaaaagccaatgaaataaagctgcaatacttgcatttagaaaatactataggaataggacagaaggcttggctgactgaaaggaggaatatattaaaggaaatgtcttaagagtaggtgacatttgaattggctagtgaaagagagagagaatagcttgctaggggaagtatgaagagcaacgttttggaccatgaaagggaaggaaccaactgctttcttccttcattcctcccactgaagtgtttttctcagtttgtcttaaatctcactttatgggttcttcaaacaatttgcccatttttgtgtttacctgagtatcagatctgtcacgtagattttctttatggagactcacacatttaaaaaagactctcataaacatcattgtttagtattagtatagttaatcattttataccttaggcttacaatataatgattttaaggttttactcatccaaaatcaacttctccagcctcccttactattaactcactctttgtatttaatttattattcagttttctatttctttggactgagtgggcatgggaaatagaatgggagaggaagcacgtaattagaaaatattgtacaaagctgctggctattttatgtagaaaatgaaatttgggacctcaggatgcaaaattaatatgtaagaatttcatcactttgttagaagatgcaatcggagttcatccaatatactgtcagagacttggtggatatttgtcaattttgtttgttattcaggaggaatacctggattttctctgagggagtcatccctgcttggtctcggtctacgtggtttatgtggtgctttgccaagtccactccctatccaccttccagtcttaagcagggggaatagctcaagctcagccactcaggctttcccttccgggaagctgaattccgagtggtgagacacaaaagtgggaatatgcttggaacagattcttcctgtgagcagaaccttgaagaggctgtttattcattcctgctacctggagccctgaagctgtctggttcccatctttgttctgtcacgatctgagcgtccagcttttggtttctctgagccgctccatatccttccaatcattttcctcttttcttttgcttcatttagtcagagtttaactgatagtctaagtgatagaataaaaatgtgaacacagaaaaaaatatcactagatgacagctgggattactagacagcattttctcactggacatgtgttttgaaagcacataccagcaccaggcactgttctaggcacttgagtcagtgacaaacaaaacaaaatattgagaacaatagatgtggctgggcacggattcacaggctcgtgcctgtaatcgcagcatgttgggaggccaaggcggggggatcgcctgagcccaggagtttgagaacaatagatgttctaacaaatatttgttgttgggctttcaggagctaaatgaatgggctaatgacatttgttcaaccttaagataatttttatatgaccctctgtgagaggttctaataattctttttttaacaaacgaataagaatattaacaacaatctaggtaaatatttcgaaagagttcttcctttggaaaaagcaagccgagtgttgatttaaatttctcaatgatcaaagtgttaaagtaatatgttttgaatagagccatctataaaacatacccatataaacaacaaaacttgtaaatgtgtaatgggcaaaagtaataaaactattgaaataatgcattttcctcataccaactctatccattaattttttacagttttctaccatgtaacattacccttcataaaaatgatattttaaaatgagatggggttggtaaaagaaacaaggggtaataatggaaggaggattgcaaagctgtgctctgctggatgagggagaagggaaaatagaattcatttgggctttctgtgagccagaggccatggtctgtagcctttaaagggatgagcaatgctcagagccaaggatttttatatctttattttgattatttgtttcttttctctaaagaaatcaagcacaagctatttaaaataatgaaagtcacttcaatataatactttataagcaaatttgtgaatctctcatgtattaaacatttaaaaattcttcatgcattcttggatgggttgtataaaatctaaatgtaatatgatggtattcttgcatgaggcaacttggtgcagtcagagggacatagatttggattcagacggatctgagttctaatcctgactctgctctattcaagttatttgacctctatgtaactatttctttacctgaaaagtagagaatataactcctagcaagtagtgggtactcaagataagatggttttctggccaggtgtggtggctcatgcctgtaatcctagcactttgggaggctgaggtgggtggatcacctgaggtcaagagttcaagaccggcctggccaacatggtgaaaccccatctctattaaaaatacaaaattagccaggtgtggtggcaggcacctgtaatgtcagctactcgggaggctgaggcaggagaattgcttgaacctgggaggtggagattgcagtgagccaagctcatcatgccattgcactccagtctgggtgacagagcaagactccattaaaaaaaaaaaaaaagatggttttcttccactgccttcatccttcattctgataatacttcaaattatgaaagattagcttatttgcaactagaggccattacagtattattaagagacccactcaaaatgcttaatatcatttgatattatgtgtcaactaagtaaaaatgtacatgcttgcaattcctaaaaatgaaataaataaaaggttgaaatttttacacttgcattaaaatgagaatccatactgtagcataattttggaaaatggaattatctgggatatgaatgctttatttctccatttattcaacaaaccccgagcacctgttaaactcttggtcccatgataggcatttagaatacaaagataaatctttgtattctaatacaaaagaatacaaacatgattctgaatttcaaaaagttacttcaccctcttccatggtgaagaccacaagcagagaattaaacgcagaaatgtaggatggagtgccttatgggaacaatggggagggtcacctcattggtgagtgtggggtgtcaggggacacgggagttttccagcagaggtggtggtgaaggtatgtatgtcaagccttagggaatgagttgaagttatctaggtggattaggtgggggagactagagtaagaggacattccagagagtgaagcaggaaaatcagagggagatgaacccacatggtatgtgtacgtgtgtgtgaggtgtgtgtgtgtgtggggggggggggtaagaaagtcccagcaatcaatgttatgctgcacagagctagaggtaggggcaatgagagtgatgctactggagaggcaggcaggggccagttcatgggtgttttctttcccaggccaaattgcttaagctttatgcagaaggacaaacgatggcttgggcacagctgaaatacctctgctcacacctgtgtgaagaataacaattagggtggtaaagcccattaggaaatgggtaatgtagtctgtggtccggggccaggctgtaagggcttgaaggaggtcaggttcactgggacacagaacagtgggagggctgggtggttggtggcagataggggtgagctcaggcgcagaaggaagagagagaatccaggctgactctcagctctggagtgtggtacctgacgtggtgccaccatccaagatagggaatacatggacatgaataagggttatggtccaagtttaggcattcagtga

SEQ ID NO: 10829 - DNA, 13876 bp, Homo sapiens
atatatacattgtataataatcaaatcagcataattagcatattaattacctcaaacatttgtcatttctttgtgatgagaacattcaaacttccctcttctagctattttgaaatatacaacacactatctttaactgtagtcaccctactatgcaactgagcaccagaagtcattactcctctttaactaattttatacccaataaacaacctctgcccttctccacctccccactactctcccaactttggtaaccactattctactctctactcctatgagattggcttttttaagattccacgagtgagaccatgtgacatttttcctgtgcttggcttatttgggttaacgtaatgtcctctaggttcatccattttgttgaaaatgacaagatttaagtcttttttatcgctaagtaatattatgttgtgttgtatgtataacacattttaaaaatctattcatccattggtaggcacttaggttgattctatatcttagttattgtgagtagtgttgtaataagcatagataaacataggagtgcagatattccttcaacataatcatttttcatatatagaagaaaacagttctaaactttgtatggagctacaaaagatcccagatagcaaaagcaatcttaaacaaaaagaacaaagctggaggcattacactttctgacttcaaagtataccccaaagcaatagtaaccaaacaggttggtaccaatgtagacatggacatgtagaccaattaaacaaaagagagagcccagaaataaatacacacatttacagccaactggttttcataaaggtgccaagagcagacattagaaaaagtagtcttctcaataatgatgctggaaaacctgaatatctacatgcagaagaatgaaaatagacccttatctcttataaaaatcaactcaaaatagattaaatactaaaatgttagacccccaaactatgaaactaccagaaaaaaatatgggagaaacacttcatgacattggtctaggcaataactttttatgtaagacctcaaaaaaaagacaacaaatacaaaaatagactaatgagattaaatcaaactaaaaagctgcacagcaaaggaaacaatcaacagtgaagagacaacctgcagaataggagaaaataaatatttataaactatgcatctgacaaggggttaatatgcagaatatacaagaagctcaacaactcaataacaaaaaaaaatctgatttaaaaatgaacaagagatcttaatatgaacttctcagaagatatgcaaagagacagtatgtatatgaaaaatgctcatcactaatcaccagggaaatgcaaatcaaaaccatagtgagatatcacctcactccagttagaatggctattacaaaaaaaacataacaaatgctggtgaggatgagtagaaagtgaaattattttaccctgttggtggaaaggtaaatagtacaaccactatggaaaacagtttggtgtttcctcaaaaaactacaaatagaactaccatataatccgacaattccactactgtctatatattctctatactgttttgccttaatttctatattgtctgatagtgacttagtttttctttttattagaattgctttgcatatctcttcttattaccttcactcttaaagcctcagcctccttaaagcaaaatttgcaaagaagacatagcagatattttttccaatcactgccttcaaactgacaataatatttattgtgattgttaagaacttaaaatagagctaccattcaactcagcaatcccattgctgggtatatacgcaaaggaaaatagatcattgtactcaaaagacacgtactcatatggtcatcaccatgtattcacaacagaaaagacatggaatcaaccaggtacccatcaatggtggattggataaacgtggtatatgtatatactgtggaatactatgcaccactaaaaagtatttcattggccatggaatgctatgcaactataaaaaagaatgaaatcatgtcatttgcaacaatatggatgaagctggaggctataatgctaagtgaactaacacaggaacagaaaaccaaatactgcatattctcatgtataagtgggagctaaacattgagcacagatggaaagaaacatgtgttgtaatagacactgtgggctgggcgtggtggctcacaccgtaatcccagcactctgagaggccaaggcgggtggatcacctgaggttgggagttagagaccagcctgaccaacatggagaaaccccatctctactaaaaaaaaaaaaaaaaaaaaatacagatttagcccccagtgggtgtggtggcatatgcctgtaatcccagctgctcaggaggctgaggcaggagaatcacttgaacacgggaggtggaggttgcagtgagctgagattgcaccattgcactccagcctgggcaataagagcaaaacttggtctcaaaaaagtaaataaataaaataaaataaaaataagtacagaaataaataatagacactgtggactactagagttggtaggtggtgaagaggatgtgaattgaaaaaccaacaattgtgtactatactcagtacccgagtagtgagctcaatacccatgtaacaaacctgcacacataccccatatatctaaaaataaaagttgaaattaaaaaaaaaggaaatttgaaattttgatttaaattatccagtgttttgaggttttttaaaaaactctttttcaataataagaaatttaacagcttcataccatatcatcctgctattctctttcattcccattttggtttcttatatatacactttatcctttccatttgggagtgctcttagccttttaaaagacaaaataaaattttccaggtattttatcactcctacttcatgtatctcctgcagcatttgttaggtttgtttcttttcttatttggatactttatcacaaagtctttctaaaatgggtcattgttagacaaaaccaatgaagccttccttgtatgtctgaaaatatttttatgacgtttgaaaggcaatttgtctggatataaaatttcagatttaatgttcttttacttaaaatgccttaaaataccttactccattgtcttattgaaactaatgcttctgttgctcttgaaaagtctgatgtcaaattgttctgaaaggttatttgctcttttttttttttgagttagatcattttaactatgagcttaaattatttcagtgttcaaagtcattgcttttctaccatgatttgcccatctagatctcttaattttcagagtggctagattatatattcacgctgtttttccaagcaagccacttttgattatttctgagccttttatatcttgcaatgggcttcttagtccggaatgcacttcttgtggcattacataagttggagacatttactcctttctgttgttgtttctagggtataaaatggaaggtctgaaataaagcagatttttagttaataccattttttctctgtaagaatttgttatagtatgtattctttgtccaattaatattttaatcacaatatgtctaggtttattttaagaactttgtttagagtgtgataagtccctttggcttacagttgattattttgaaattcaaaagtatttctccaatggtgtcttctttgagcctgtcaaagttttgtgggttttctggtttgtgcattagttttcccagaattatctgtgattccagctttgatctttattctctattctctccacaccattccccttgtccttgtcattgctatctctgaccattcctttcacattgtcaggaagagaaggcttcccatgactgatccagtcttttcttcgtcaattccaatgctgggattagaggtttggttttgtttgcaaccctcccttaactccccagctccccttttaagctcagcttgtcattttttctgtctcttcctgtgactctccatctcagtctgttttcttccttcagttcttcataacagtttcattataaacatgtcctctgaatcatttggaagatgttgtttactgttgtgtgcattgttctacccatggtcactttctctagattgctcagcaagcaactgcaagccctgctgtaagatgttgagattctttgtaatctgtcttggccaaatgtgctttgctggtgggcattatgggtgccaggattcgacgtgccgttgcctgtctcctttctcctccacttcctgttttctgtcttcctgtttcctggtaattgttttccctaaattaatttagagcattttctgaaaatatgtttcagggaacactagttcttcaggatgtgtatagatgataaatgaaaaataaaaatgccttgtattcaagtgcatttaagaaatattgaattaaacaaaatcattacaggattgtttactaaatggcttctgagagcctttgatgactgtggctttttgagataggactagatgaagctctctgaggtgcgtcttgtaagactgacatgctgcagaacaccttttagaatcttttgctgtcatatgtttggggagatgcagaaaatggtctggctgccccaggaacaggaagcacacagtagaggaattgctatgtactattcaatttgacataaaccttgggcctccaatttcaagaacaagcaaagaaggaatgaatgatgttagaatatccttctgtggtgattcagagtggcgaggctgtcctgtcttttgaacaaaagcataggtagtccagtgattatatttctcgatccatatccatctacctatattcaagggaaattcctaatatttacagtgggatgactgtcagtattgtcttcatcttttttctatattttcatcatttctgtgtctttataaatatttagttagaagttgggggagaatgtgtcatctgccattttcaactggagacctatgtaaatagtgcaagaggttggtaagtaatccaccttgaatttgctgtgtctttcaggcaggaaaagcaatcacttggcagtatgtcagcttcacacttctacatcagtgtttgacctcaagggcatggctatactgtcttatgattacaggaggcaaatgcagggtcttatctccacatcagctgcctttacatcacttgggtctattagcacccagtggtaaatactactggctgcaccgcaggcactggcttagaagtaaaactttgaatttgccattgccattacttaacccccatcaaaggtagattgagagaaacaacacttttagtagattacctgacagctattcaatctgtcaatcctttggacactaacgtttataatcagcaagattcttccagtggagaattgctttcctctgtgaagatccatttaatcaaatatttttggtgtgatgtcactggctttcattcaagagcatgattagaaacacacttataaaattcattattgactttattgtgaacatgatcctgaaaacattcactgcctgacacacattttctctttagcaccgatgctctgagattcaatctcagggacggaaatagctgtgcttgtttttgtcctatgttataaatcatataaatgattaggttactgatcatattaagcagctaaaatgatggataacagagttgatatttaaatcattatggcaggctgggtagaggctaaccaaataacctcagcagtggaaaatctacagccttcatttgggtaaaaacaatccattgaaacacctgttctgacagagagattaattcagcatttccaaaagtgtgctcggagatgctgtccttcaaggagatgcttcttgaaggaaagaccccggagagaactaagtatgggaaatgctgcatgttaaatctatcttatcatgattcacaatacacattagcatattaaaagtctgtagtaaagaaatctgtttaattctgttgtttccagtttttcttcctaaattcatttaatgcagggcttttgttcttgttgtcattcctggtaggacccaggactatcccaggaatgctctgcagagttcattttagaaaatgccaggttaaatcattcaacctaagaccagtgagttttccttcccactgttgattgattctcactataataatgcttttattttttcatatagttttcattacctttaccatggtagtaatagctatcatttgtggagtattttgtatgtgccgtaccttgtaaaygttactatcagtgagcgtagcagagatgccaaatggtgaagccctgcagagaccatcagaccctgaagaggctggaaaactcacatgatagctgttggtccaagggcagaactggattcctccagtcatgtctttcctgaccttcttccaggcctgggctgggttatgcagataaagttatgagtaagaaatatggtctttgtctccaagagcttaaaattgagatcactgacagacaatgcatgtaagaggagctgggtaagagactccagaagagaaagtgattgcttagtggaggttcaagtgcagcttgattgcggagagcacacctgtgctgctggatggacagcagctgctaggtgggggcaggctaaggatccagcagaagatgcaccagcagagtccctgcaggatgccactcaaggagtgcacatggaagtgccaggagttgcttctggttgaggcagtggatttcgcatggctggatcatggaaccctttgggagaggaagatggaaattggacgtggaaaggcttcaaagcccatcgagagtgttgagctccagaaaggaggcatgcctgcactctggagctaatatgtggcacttgccagaagttgtatcatgaaaaagctaagggagggatgggacaagggtgtggcagagccctgaagcaggtactgatgacatcggagtaggcatctgacttaatctgaaatgtttcatgccttcctcactgccatcattgtgacaggcaagtgctcctgctgacacttctctgtctgctctgctggcccaccttctcagagccctgtaagtactctgacgggaactcagaataagggtcattgtggcctactccctgcaggactctgggtgtcatttccatcattccactgggataccaggaggaagaggcttcgagcttgagaggaagaacacagcttcctgagaggtctggagtggccctgcctttgaacctgccccatggatctgggtgcttggacagagctgcagcagtcacttcatttagccagcattgtgaggagtggaaagagagagaccaggatcctgaggccttcggcacctctcagctcagatctcaagctggattcctccagagtcataaaccctatatcctgccagagaacaaatcattccagcaagaaagaggattctggcttccagtgtctgatgacttatgaagtgcagccaagagtgaaaatcattttaaaaatattgaaaggcacctcgccagggctccctccactggtggaaatatgaatacaggatttatttgaggccccaagtgctgtggcatcatccagagatggggacaacactgtctgcattttagagctgacagctacaacttgtttcttcctgctgctgtggctgcgactgctgccaccgtcaggagcttcgagcatcagggcggatctctggtggcactggcagttgaggcataatccttcaatggtgtagatgatggtttcagggaggctgaggtcccaggcctgtggcaggaggatttggggaaagccatgctctgtggtttggccagcttgggtagataacttaagttatgcactagctcatgaatacacttaggcttccagaacctaaggtgaggacactcttttggactggctccctggcctcctgcctgggggccccagggactcagctgcttctcttatttctgacactgcatcttccccattggaccacagcccagccctctccctatgccccctgcacaaaagcccagggtcccctggctttgtctcttccctaagctgaactatttgcttttcatctctgtctgttgttttataatctcttctttgaactcttgtatctcttcttagatttctttttccttcaagagaccatgttctctgtaacttttttgagactggggagaatatttgcctgaactattaatcttttttcccctaagagataattccttgtgatcgattgttacattttctttatctgcttttctccccatgctggcttctccctcccttactcatgatttggggacattctgttcatatatatattgtcactttctttctggttatcattcaccttcaaagagagctggctccctgtttcagaaagtgtagggagggactggggaccagggtcaggagcttgctggggccgtccttggcttctgtgagaattggtgagttctctctttccaagtttttgattcactttgtcctggatgtgtatctctccataattttcaggattcaaaatggaagggaactttcagaaaattcttctaagatctgcattgcgccagtcagggttttggcctctgccttcaggtcctgtgctccatctcgccatggggcatctttcatggcctgggtgtggctggaaaccacaacacagtttctgccttgcttggcctcctgttggatttgggggccaacctggactcagtcacgtcgtctgtgggctccctgaaatgctcttatctgaggacatctgtgttctgctcggacctgagctgccaggtgggtatcgatattgggtgtcactgcctgtctggtgtgcttctgtcaccatgggtggccatcgctagggatgaagtcactcgttgtctctgggaaaggcaggattagaaggggagtagataaccatggaggcagtagagtgtgttgcccccaggccctcaggaaggctagaaccaaatcccagcaagtttctctactctgctcagagagagcggggctgtgcctggtctctaaagagcagaggagctggggagagagggtcctgtgcagccaggacaagggcttggtcaaggcacttgagaggttgtgaggagcgggtggttgagaagccgggtggccctgcacagtcagccactgctgttctctgtctcagatgcccaatcatagagcagggaggtgaccattctcatatgcacctgacccagacagaaggcgaggggaccaagggcctggctgctccctgccaggaggctcctggtctgactcaggacagggcctgccccaaacctagtgaccccagcatcccctggtgccccatactgacatggcctgaactccacacccttccccccactccctctgcccagacaggaccttcctttgatagaaacatccttttgccccactctgaatctccttcatcatctgcctgtcctgcagtctcctcacagatgcagaccttgtttgtttctttccagtttccctttcccaaggcctgaaatggcctctgggtgtggagccaggtcccctgaggacaattgcctagtgacaaactgctggggcttggcagcctctgtgtcatctcatttaatcattctcttgttccgtctatatttattgagttcctggtatctgccagtcatggattcaggtgctggggaatgacaggggacgaagggaaacacagccttgtcctcccacatctggggctggccctcacccgctttggtggacaggctcagtcatgctggagcgctgtgataggagaggtgggtggacccaggaacatgcagcagtggtcccagcctggctggaggaggatgaattgcccactgggaaaagcttccagacaaagtaaatctaagctgaggccagaggcagagtcaggaaaagggagagggctctccggagatggaagagcaggtgtggatgccaagagccatgagggcgggtgctgccactgcagaacttggggctcttcagcctgggggaagccagagggtcccagggcctgatcactcagacttgcaaactgcacttgtgtttggactgtaggtttgcattgaatgagatcacagtgccacagtgtggggatgttcaggacccaccccctgctcttggcctctgctaccctgactgtgaggcccctaaatctcctgggttcctgggggattgtcccatccatgggcagttctgaagccagcctggttccttcctctcagctgtgaaacctgaaagtgtttgctgctttaattgtggcaaaggaattcataaagctacagctgaaagggcatcctctgaagcctgcctgtgtcaccagaggggctgtttaataataggaagcatacttggatctgggcactgcacagggagctttgagacccattttcaccctaagaggtggtctttcttccaagctgccatgttctataaattcaagctgagacccagggagagagacacctctatattatccatgattctcctggatagtgctgcccagtctggagtgctcacaggtcctctccacactgcggctgctctggcatcttccccagggccctctgggtgggcaccagcctgcacacggatggcggtactctgtgcagtgtcagctttggcaggtgtcttggctccagagccagctctgtggttcctgcttacacagtcacaatcctgaaatttgaaaatagatcataaatagacatgtagatgacctgaatccaagcagagggggcaccctgggggaagaagacaaagctcatttatttatttatatttacttatttatattctgcctccttcccgaaaaggatttctgacagtttacagaaacacttaatgtacaatgggaggtatcttttgttttttttccctcttaatcaagaaatgggggaaattagggcaaagagaaaatgagggcagagatgcaagatgaaactggtggaaagctaagtatacaaatgcatgtacccaccctacctcccactgaccccgagttctctagcttagttttatttctcagccaagtcctaacttgggctgacatctccaaagcagctgaaagccctcctggctggtgcagtctggtgctcagcaactcatctgcgaaggacttgattagttgctagaggtcagctccagacactccatatgtgcctgtgcacctccaactagccacagtgaggaggcaaacaggtcccatttcacagtgcaagactttcctaacggaagaataaatcagtgacccagaagatgacgagacttcccagacctctactcaggcctgaaaaagtctgtgggtaatgacttatgtgtgggacaattagggtttgcctgtcactgtggagtaaattcatgaggttggccaagaaaacttcactggccccactgtgggccagccacattggttgatgttacagataagaccgtgggcagacagactcatccctgctttaatggggaccccactctttaggggagacaagaccataagaaagaacacacctaaacataataattaagtgctaagtaggaatagaggggcttccaaagtgtgctttgggagcatggactgcggacaaccgtgagcctcttctggccaggctcactgcgcctccctgccttggccatgttttataagaaaagtttctcccacagagaaagagcaaaccatgaaaggaaaaggctggcaagcatctaggcagtcaataattcctgattttttttccccctcattcatcagctcttaattggtgtctgctgtgtgtcagacattctgctaaggggtaattaaaaggcaaaataacttctttttcttttcttttctttttttttttgtgaagtttatagtctccagagggtgaccgatgagttagcagatccttgtgatgtgctcagtattttgcaggggtaacaggagacaagagcaaagagcggaaccagggccagaccctggggagggatttggaaatggattctgtgagccactggggaccttctcagtcccaggagcagaagcatcgggagtagaaagaaaccggagagagggagtggctggtggtgtgggggcccctggctgtcagatgacagcagggcacagcagcagagaggggcaaggcggggtgggcttggcagcagacccacccatttaggccggctgggtgatggtggggatgcaactgggcagtgtgctgagctgaggatttacctggctccactgtggtccacacgagtgggtggtcctgtgtgtctcagaagcagtggatgtcacagagctgggcaggctcttggaagggaaatggagctggctgggcaggagacacccacgacatcagccccttgttgttccctcccaggattcaaagcagagctccagttcctgtgggagggatgagtgagaggaatgaggcctacatttttcaaatccagcagggaggtgggtgcccagccccaggacatggcaggagctactcaggccgctagcttcacccacaggacctcttatgaactgggtccaggtggacagcagactcagaggaaaaagcagagtgcatggccaagatggacctgaggacagagtgttcagatccaggcaatgaggatgtcagcaccagtaggcccaactggatacctgggagtggccagggcaggggcaggcacatttaccaaacccttccaggactgtcctggattcactatgtctgtgatctcaccaccacactgcatgaatgggaatggtctcttcagctaccaatgggaacaaggctcagagagtgtataagtaactcactcaatgtcacagtcgtcttccatgggtgctgtgctctaaccagggctgcaaggcattgatgggagatggtggatggcagctgggaggcagagggggagccctggggcaagccccagccatggctctgcccccagctctcacaggtgtgacctccaggcaggctggagagaggccccatttcttaatggctggtttattttcaggttgaaagcttctccctcccaccacccctcctccacgccctgccctttgcagcctgggccctgggaggccatagtgacacccaacactcgcagcaggttcattgccttctgcacaaatctccttcctatcagccgggtcctggcggggggtggggcatgctaatctaatcggccctttcccatctgtaattactgtaatctataacaataattacagtccattttattttagtgccgcttatctaaatgtggatgtgcactactgagattgccaatagaaataagcccctgggtgaggcagcagggtgggagggatgtcggggagaaagctatgccttgcgggcccacgtggttccaatgtgctcctctccagccctttgctgccctcctgaggcaccctgctgccctgtggagtccggcatgcctgcagggggtggaccactgagcaaccaggaaagagcaggggttgtcacatcaatgctagagtttagtgacttccctcggaacaggttatcttgaatcctagagccagcatggcagctgctacaaacccttttgggaacagggatcatgccctcagcgcccagtttctcagatgccaagtgcagtgtctggtgtgtggttggtgcctaatgagtgcttggtgaatgatgtagaaatcacactaaaatcatatcgtgtcacttaggctggctattgattcaggcagctttcccttcatgaatcaggtctcactgcctctgtaatttggaaagataactacttgggggaatatcatgaaaaaaattcattttatacagcatgatgtagctgggctagag

SEQ ID NO: 10830 - DNA, 40650 bp, Homo sapiens
  misc_feature (1)...(40650): n = A,T,C or G, or insertion/deletion polymorphism (see Tables 1-2)
agagaaattgtgacagaccaggtnnnnnnnnnnnnnnnnnnnnttatgtcgggacgtgaggtgcggggcatactaagaaaattagtgggggtgagttatagagaatgggaaaataagaggtaggtagggatgtgctagagagagtggaagtgatgtagagtgggggggagggaggtataagaaagtttgttgggagaaggagtaagtggagaggaaggagaataggaggagatagatagtgggtggatagtagaagaatgtgaggggagggagtcggtggagatcctagtgcgggaagtgagggaggggtagaggatatgggcgtagggatagagatgtaaggcgtttggaagatctaggtgataaaactatattatcaaaccgggtagaagggggcgtgagatgtagaagatagagtagaaaaggataggggagagtgggacttccaaccttagatttttgagagcgcccaatgacaaaaacattctttcagatctgtctaactccttacccctaccacctggttttcaaatgtaatgccactgccttccagccatataacttgagacaactgacctgattgctcaataatttctctttttttcttatttttaaaacaagataaataaaaagaatattgcaggtgactattaaacaagacgttacagtacaaacaatttcagagagaatgctctatgatcttagttccttgtcccttttcctccaaacctcattatacatttcactcacagtaaccatacaaaagagaaatccctattcctacttcatatttaaggataccatggctgagagagctaattgcctacagtgacaggcactaagtcaccttgccctctctcctgacccttgtcatgagcctctgatggactctgcactgttaactcattcccaacttactacctactgaggtattttccagaagtaggaccaccagtgctaaaaccagggcagtctagggcaaactaagatggcttttcaccctaaattccccctcctggacgaaactattattcctttttttgtttatttttttcttgctgagagggcatcacatttactctactggtttatctcaattaagtccttattctccccagagataatccctgctaccttcatacactccatcctgataccatctttgtgtcctcctggtcctcagccatggtctcatttaattttgggttgtttaagccaaagaggaagatggatatttttcctgacacgtagcaatctcctgttagattcaagactgattgaccttgctctttgatcttcttgaaacttgttttccccagctttgttaaggtataattggcagataaatgcgtaaggaaaatacgacatatgtgtacaatggtatactattcagccttaaaaaggaaggaaatcttgtcattcgcaaaaacatggatgaacctggaagctatgctaagtgaagtaagctaggcacagaaagatcaataccacatggctcacttacatatgcaatctgaaattatgctctgtatgattcctcttcatgagaggtttcaaacccaggggatcacgcaccctagcaatatgcatcattactatcctgataggctttgggcccctgaatactcagtgctctgctctgacgttccagaatctcactttggtctgggacattccacacatcggtggactgtcaggctatatgtcatttgctcagatttactaataaaccctgaacaacaacaacaaaaaaacccaacactggaagaacacacagcacacacacacacacacacacacacacacacacacacaaaagaaaggagaaagaaaaagaaagaaagaaagagtgagagaaaaagaaagaaaagaaagaaagaaagaaagaaaagaaagaaagaaagaaagaaagaaagaaagaaaagaaagaaaaagaaagaaagaaagaaagaaagagaaagagagaaagaaagagaaagaaagaagaaaaacctactagcggtacatggagcatgtgggtcttatatttcgtatcagctgggttcctgtcactttgtgtgattttagacaaggcatttacttcgagtctagttctccttgctataagagggagtaatgattaaatgatttgctctcaggaacaacttagaatagtacctgcgatacaacaggtgcttactaacacctaacttccttttttctgttaagctgagaaccatgacttttcttccccagaacttgcaggctgtgatgggcacacagaagtgggttttactggatttccagcaggattggatgggccctcctggtacggatgcagttggtgcctgtagggccagcatgaatgccatcttgtagaagccagagtgtctcaatttcttgtgcaagatacgtggtgaccaaacacccctgggaagaacccagagtcactcccaagtccacccgagtcctcactgactacatagtgctgaatgcaaacatgggtactaattgaataaagcttcctcaggatcaatatggcttcactccaagtaagcctactatttaaataagtgaaacaaaatgctacttactggcctctgctatttatctcctaattacgagcatatttggctgactcaaaaccaatttatgtgtagaagtcaaacaaaaaggtctcattactaaaacctggacatccttttatgcaaatgaagtgctatgatatacaaggatttactatgaacaaacaaagctgaacttggatgcacatgtgcttccagtcaaaagaagttcccaactgggtagagccctggactgcctttgctatgtgtcttttgtggagagggaagccaacagcaccatctccagcctgcagcctggcacacacaacagcaatggaggcagagcaaggatattacacttgatcttagccaaaagactgagaagtgatagagagcaagaatattgttgtccaccaaaacagccatgtgaatggcccttcccaatccctggtcttagttgcaaaatcttctctactcgaaaaccctgcacatctgcacattttcagccactcacagtcacagccacattctgaggtcatatgtatcataaaagtataaatatccacctactcctagagagcttaccatgttctatactgtgctaagtgctttatgtgcactactacattgaattctcactacaagcttttgacataggaactattattatctccactttatagattaggcaattgagttccaagttcacacagctaataactaagaaacaagacttatacacagatgtgtctaacatcaaggtatgtgtttatatcagttgcacaatacgtttcttttctacagtctctgtttaacctttcaatgtctgactaaagtgtgtcccttcacctgtcccaataaaactgccctgatgtgagctcacggagaactccagccttccagtcctgctctgtctttccagcccatcaaacccagaccagcttcacttctttcctatcaacctggcggctgttatcaatcatttcaactacgtgtttactaactccctcaattcccctgatcccttaatctttttctgcacaggttctcatgatgtacaggtctggattaatacaatcacctgtttttccctttgcggcccagggaacatggaggccattggacaaaatctgctacatgtgtttgaattcaacctttgtggagctttcagtctcactgcaaaccctttatcctgctcaagttgtctctctttcctcttccctgcagtgatggctctcagccttgtctttgtcttcaggctccccaccaggcccctgccctcattctctcagctgatgaataagtggtctgtgttgctgggaaaattgagatccttaagggtgaactccttcaacttttctctgaaaatatccctttatcttccctcattttttccccacctgttgccaagatttcagatatcacagttttcaacaagaccttgctttgtcaaaaagcctcacccaaacctgtgttgccactgagtgtccactgtgtctttatgtttaccatccaatgttccatcgttcctctcctgagtcccctacaacctccctatggcccctctgggaagagtccactccttttaatggaaattggaagttgctgatagtgcttatcatacctccttctgaaacatcctcctcccttgatttctgtgataacacactcttaatgtttgggtggctacttggggtattccctttgacccttttcttactccactctctcttcactgaatagatttcatccaaagacatgaatgcaaataccatccatactctgatgattccaaaatcaatttccgaatctcagatcttaactgaaaactagagatgtgtacttatatggcaaaaatgatgtgccaagaaataaacccaggctcctccttctaaacctagttttttgggggtaatccttgttttaaagacattaaatttgatcgaattacccaaggtagaaacctaagaattatattttaagccaggaatggtggctcatgcctataatcccagtgctttgggaggctgagacaggaggattgcttaggccaggagttcaagatcagcctgggcaatgtagcaagaccccatgtctacaaaaaataaaaaataaatatcacattttatgtcttcttttcaattgctctcatacatatgcccaattgatattaaatcccactgatttaatttcacttattaattcactcaaaaatatttatttgaaatttcctccatgtgaagtaagtaatttcagctgtaataatgcacagtgccagggacaccatgcattaggtacaacataatgaccctgtgagtcatggtgctacgccatgactataataataaagataatagggatatagatataataataaggataataataggtaatagggcctgcccttatggctcttaaaatgtactgtagggacatgaccataaacaagatcagcatcaaacaagtgaaaaattgcaagaaaacatcagaaaatgatgattgagccaggaactgaagaatgagggaaagagaaagaattgaatagaagtcaaatggctcctgcacatagtactgtaggcaaatgcctcaggcaggagcatcatggggcataattgccaccaaaagaccagtgtggctgaagcagaaattggaggaaaactgtgcaaaatgagactggaaattaggaggaaagcagaccatgcagagcctagaccacataaaggagctatgtctttgtctgttctaacagcattggcaagacagtgaaagcatttgcagatattcagcatgagagagagaaaaagaaaagcgaatttgaattttgaaaaattttactctggtcacagtgtggcaaccagcttggtgaggagcaagggtcgaggcaggagaatgttgaggcagcaatggcaatatctctggcagaaggggtggtggtctcttgaatgagtaggaaggcaactgggcagaagacaggtggatgggttggtgagttatttaggagataaaatcaacacaatgaagtgttgactatggaagattaaggagaagaggacatcatgtcaggttcctggcttttctaagtggacggatgatggtctccttcactgacttggagaatagaaaaagaagattatgcgatggaggacagcactggggactgtatcttaatttcaattttgaacatattggtttgcagggactttcagccttccaagaagagatatggattacaagtttgaaactcagaggaagatgatgctgcatatgaacgcgtgtactgtctgtatatagatgataagtgatgtcataatgtagatgagaatgtctagggagaaaaacttgagtgaactgagaagacagacagcccgtgaccaaattctgagaactccaaccattcactggttgagtggaagagaacaagctcagaaaataaatggagaaaacatggtaggaggagcagaagaaaaatgaggagaatgctgtctcatggaagacaaggtaagagagcattgcaagaagcagagagtgattatcaggaccaaaggtgctgagaattcaagaaagaggtcatatgggaatacctctattcagtagagctacttggatgtggaattatgagaatgtaagccacagtagagtggttaagaaataatgtaaaatgaagaaataagattttctttaagaagctcaataaaagaagagaggaagcggagcaatagctgggggaatgagattaggattttatgtgtatttaatggaaatggtttgaacaaattaaaggctaatagacaaatctagttaacagaaggaatctatgtataaggaaaaaataattaatacctgtttcattgctcctgggaaagtaagagtggataggayctggtttccaggatgagatgtggctttaatcccagaagaaagtctactttattattacagcaaaaaaagggggcgatattgaggacagatgcaggtcattcatatatttataattggggagataagtaaattctcatttgaaaacttttactttattttttatttttctgtaaagtggatatgaactgacaaaaaccaatcctaaaaaagcacataaggtatatgatttcatctatataacatgctagaaatgataaaatgatgagaatgaacaacagattagtggttgccagaggctaaggagaagcagagggaagtgggtgtgactatacaacagcaacatgaagcatcatgtcgtgataaaaayatactttatctcggctgtattcatgtcagtatcctggatttgatattatgctacaacttcacaagatgttatcattggcaaaaaccgagtaaagagtacagggaaattctcttattacaactccatgtgaatatgtaagtatctcaaaataaaaaagtttaattaaaaaatgttgagtaaaggagaggaggcgtgtttatgcatttaaaaagtgtgaacagtttctggggaaagtaaagaaagaattggccaaaaagtcctagtgagatttccaggtctcttagagattggcaaccatgaatttacaaggacagcaatcaatctgttctgctgtgtagctttcatcacctgcactccaccatctggggataagaatagagaaaacaggtggttgggttgttcaggatacgggtgcaccaagccagtgcaataacaacagcaagaaatgaaggacaatttttctcagatccatgtctgtcctttccatcctccctgctggtgctttggtttagaatcgtgcttttgtatctccctcctcaacatgttcaagctctttcctgggctactcccacaccagcattgtaatttaaacagcttatccttcaaattcttgggcccagaagtgacaacaactgcaactatgccttcatagcttcttatacattagtatattttatttatcagtgttctctagagaaacagagccaaaagattgtgtrtatagatagatagacagatagacagagaaacagagaaagagagaggggacggagggttgtgggggagggacagagagagaagagagagagagaaggagagagatgtattcgtttatgtattttagggaattggtrcacatggtatggaccccagcaagtccccctctgcaggtcaggtggggatccagggaagatgctggagaccatgttacagctccaatccaaagggactctgaaggtaaaataccctcctttcgggaaaactcagttttttttcttaacaccttcaattgattgaatgaagctaacccttagtacagaggttaatctgatgttctcaaaaatctattgatttaaatgctaatttcatctaaaaatgataccttcacagcaacatgtagactagtgtttgaccaaatacctgggcatcacgatcctagctaagtcaacacaaaaaaattaaccatcacatccattataactagagtgatcacaccattcatcattctaatggaagttattaataattgttagaacaataagcacaaactggggctgtctctggcaaaccaggacataagaccatcttcattacagtctcatcacaatgtgttttgatagctccatgggagttcccatggatctctgtgtccctagaaaaagttggtgccctgcacactgttgtattcgagaaatgttgacggcccctcctggcctatcttggtttttatttgtctgtggtctgtccttaccacatagtccattccaggtactcccacccatctgaaatctctcgggtttatccagaagaggatagattcatattttgttagcctctgctgacacatctgaaatgcctgaaaaggaatagtacccaaaaacaaaaagagaagaaactattatcttcaacttaagtgtacacaggacatgtccctgggctcaagagtagctgccattgggctgatggccactccacttgggccctgatctgagcagggtctgagaatcacactcagtcctaagacccataacttggggtacctgtatcctgccttggcattgttccaggcctgcttagttctcagtattctgggtgtcccttctytcccagcttttaggtcttggcagggacatctccgtagctaagaacctctacccctctacactgcagaatctttgtataatcctgagttctgttctgctagttctattctgatcaaattgcctcttcctgaaagcaggaactctggatcatcaccaagtcccagactgaaaaacccacctagaacctaaattcctttgacagatatgcatagctcttggaaatcactcactgtgagtgcagagaactgccgccaagccccacgggcaggttcctgctactgctggcatgtggccatgtcatattgctgattctagtttcctgtgtcattgcactatgcccatcagccacagatgcatccaagactggctactgcctcccagcttatttgagtttgcttttctgctcactgggaacctgtaggccctgcctcagggtctgtttgcattgtcatatgtagrcttgctatgtgctcagttccaacaccagttcttggactctgccatactatgttttctgccctcagtaactaaaaacctcccaatccatttagtctagggtttgtcctcccattttgtgcagctgcagggagaatgtttagtgcagtagttaagaacaaagatgtgaggaccagactgacctaggttgctctgcggtcttaagcaggttacacaaaatctcctactctccatcatctgatctcacagttttattgtgaggattaaatgatggaacacgtgcaaagagtttgacatgatgcctgttactgagtcagccctcagcatacaagcctaatacagggtttgaaatctggccctagtgttctgccattcacctcctctgggtggtaatatgctggctaatgttttataatcagctctctgagtaaaacaaggctctgatttatagtgcttgctgatttccatggtgtaaatattcccatcatggccaatttcatggtgctaatgtgatgttactgaacacagagttgagaaaagatacacacaagaggttttcatgagytggtaagagcaggacgcagcacaccagtgacattggagctacactggcccagtgcttatgctctgacctggatcttttatgaggaactcatttctggctcatgctcaagaagctgtctctccgtgatgtattaaagagcggtctccttcacattcttgggagtgatgctggataaagcatgtagtcatttcatctcttcaaataagatattacagatgattctgatctgctgagatgcagcagcctcttcaattgcagccaagggtcagctcatgatattgatggtaaggactgcccttctgggaactttccagagttctctacagcacctctgcttatttcattggttgctatgaacacctgcctgaaacttttacttcttacaagaagtggccccaggactctcatttctgtctattaataccaatacttccaagagcaacaactagaaaagctgaatgaaatgaaagtaacatttgtttgcaggtattagggagctactgaataaccaagagttaaaggccacagtcttgtgaggaactgcatgaggcttttcctattggtcattgccactttgatgtctatcatggagataagtgcctgccagaaaatggagaagaacccaacaaagaatcagcagctaagcagcrctctccatgtatcacgaaagtggggaaacgaaggctggagtctggaccaatcaaggcaacccaatcttgaggaacccaaatcctggatagtgaaatggggatattaagatgagagccacactgtgtgccagtcttcctattgagggattaggctatttgtaagttgtttaggaaaaaagactaagaagcagaggaataaagacactaaaatgatgagtagagtttttggccatttcactatgctggggagaaaaaatatggagatgagaataagtcataaaaaggggtgttggtaaacataacaggtgttcaggtgtgatccctgaagggctacagtttactagtggggataaaacagaagtgaaacaggaaattttcctggaccccttcatgggtgggaactagaatgtgggtgctggagctagccagtggcttcagaggcttcactcactgggatccactgcattccaccccttgtgagaggagcagtgcagctgagcttgtgcaggaaggagccagggcaagtgcttctgggcactgtcaggagcaaaatgctgtgcggggcccatggcagcrtctatgggagagtacccacwatccccaaagccccagaaggagtgttacaggcagtgctctttcagctttatcatccacagatggcttaaatgattaacagcttagtggacgctctgcctttttgcaagggtagagggtcagcgtgacagccttctgtatcttgagctcttgttcagcatccaggaaaaatcaggtcacatgaatgaattgaaggatagcaaatgtgggggattttattgcctatggaagtggctcttagtgggaagaggagttggaaaggggatggagtgggaaggtattcttcccctgaagtcccaccatcaagctgtccctctgaagtcaaactgcttctctccaacattcagccacttcctctcttctccccttctctgctctctgccagtggagcttggagtttttatgggtacaggatggagtgcagggcagtccaggtgtggctttggaaaaggcaacattcgagcaggaaaacgggcatgtaaagttctcactttgggctgtggttccaggcttgaggatggggccctcgccagagaccccacccttttctgcctagaatttctctgcttcctgtccctatcagaagtagtcaaaatcttttaagaagtgaaaccagcctgtaatcccagaactttgggaggccaaggtgggcagatcacctgaggtcgggagttcgagaccagcctgaccaacatggagaaaccttgtctcaactaaaaatacaaaattagccaggcgtggtggctcatgcctgtaatcccagctacttgggaggctgaggcaggagaatcagttgaacccatgaggcagaggttgcagtgaggcgagatcgcaccattgaactccagcctgggtaacaagagcaaaactccatctcaaaaaaaaaaaaaaaagaaaaaaaagaaagaaagaaagaaagaaaagaaaagaaatgaaagcaggctcaagtcagttccattcctgaataattgagattatctttcttgttctagttgcccgctatatgatagagtaaattatctctgggaaaagagaatgcggttctgagcctacatagtgtttcatacacaatatctgatgctccataaaatattaccgagcattttttaaagcctcttctggattctagacctgcatgtaaggagctttgaggtcttcactaacaacaagtaaacaaaagaaaaatacataaactgaaaaatcaactcttcttagatctgtcataaacgtaaggtcacaggataaacctcctccccaaaaataagagagacacacgagcgtatacagagaatcacaacttgccagaacagagacccacaagcagaaacctctgtgggaacaaatactggggcaggaaaacccaaactgtaactggtgaattgctgaaagctcagtgtggatgaatctgagagttagaaactccagtgggggcaggcatacagaggcccctcacttkttatgagttttacttccaggagctctctcaggttctcaaagtgagtatcagagaaaactttcctcatgtatttgaaaatagaagggagaagtaaccattatgaaatatgccaaagcattctgttcttaaaaaggcctgtggtcaataaaaaatatcttaccaaagcctactcttttgtggttttaacagagcctaaccaacctggagaaagagaaagacccaactctagcccactctagtcaacctgtcctacctggagcaggggtcagggagactgagaagcccttgtgaagttcatattcaaggggcataggatcacaaaaggacgaaagcctaataatcacagagtgatagaacacttcacctgcccaccacattactaaagatctgttatcagaattccttttactgagtatgtcagtcaggcttacgacaaaaagtcacaatatatactaaaggcaaaatacaaaaaaaaacaacaacaacaaaaaacagtttgaagagacagaacaaatatcagaaccagactcatatatttcagacatgttggagttatcaggccgagaatttggaactatccttaataagctaaaggctctaatggaaaaagtagaaaatacgcaaagcagaggtaaaatgtaagcagagagatggaaattttaagaaatattcaaaaagaaatgatataaatcaaaaacattgtaacaagaagaatacctttgatagagtaattcgtagactggatatggctgaggaatgaatctctgagcttgggcatatgtcaacagaaacttctaaaactgaaaatcaaagagaaaaacatgaaaaaatagaacataatatccaagaactgtgggacaactacaaatgatgtaacaaatgcttaatgggaatatacgaagaagaaataaagaaacataaaatacttgaagtaatgactgagaatattccccaattaatgtcagacaccaaatcacaagtccaggaagttcagagaacaccaaacagaataacacgaccctgcttctgaaatgaagaatcaaaacaagacaaaaatacactacacctagaaaatttatattcaaactgtgggaaatcaaaaattaaaaagtcttaaaaataagacaaatgtaaaaaacatcttactcataaaggttcaaggataaggattacggccgggcgtggtggctcacgcctgtaatcccagcactttgggaggctgaagcaggcagatcacagggtcaggagatcgagaccatcctggctaacagggtaaaaccctgtctctactaaaaatacaaaagaaaattagccaggcatggtggcacacgcctgtagtcccagytacacaggaggctgaggcaggagaatcgcttgaacctgggaggtggaggctgcaatgagccgagatcacgccactgcactccagcctgctgacaaagcgagactccctattaaaaaaaaaaaattacgtctgatttctcagaaaaacttcaagcaatagaatgaagtaaaatatttaaagtgttggaagaaaaaacactagcctggaactctgtgggttgcaaaattatcctttaaaagtgaaggaaaaataaaaatattctcatacaaacaaaacttgaggaaatttgttgccagtagacctgccatgaaagaaatgttaaaagaagctcttcagaaagaaagaaaatgatataggtcagaaactcagatctacataaacaaaggaagatcactggagaacgaacagtaaagataaaataaaaacttctatttttcttgttcttaattgttctaacacgtaacagtttgttccaaataatagcaacaattttttaatgattatagcttatgtataagtgaaatgaataagggcaatgattcaaagaacaagaaggaacaattaggaatattttgttattataaggtacttgcactgcctgtgaagtggtataatatttccactttcaagtggacctggattagttgtaaatatatattgcaaactccagggcaaccactaggaaaaaaaaaagaagtataaattatatgctaagaaaggagagaaaatagaattatataaaatgctcaagtgaagccacaaaagactgaaaagtaaaaaataaaaacaaaggcaataaatagaaaagttattaatccaactatattaataatcatttcaaacatgaaatatctaaatacacaattaaaaaattgtgagagtggatcaaaattccacaagaaacccactttaaatataaagaaacatatagattagaagaaatggagaaaggtatatcatgctaacactaatcaaaacgaaaaggaagaagctgcattaatattaaacagaacagacttgacagcaaggaatataatcagggatcaagaggggtaaacataaagggatagatttacaataatatacaacaatccttaacgggtgtgtacctaaaatgagagcatcaaaatatgtaaggcaaaaactgatagaacttcaaagagaagtagatgaatccactattatatttgtagactttagcactcctttatcagaaatggacaaatccagcaggcagcaaataactaaggacatagtcgaactcaacagctccatcaatcaacttgwtataattcacatctatagactacttcatccaataaaagtatagtacaaattctttttaagctcatgcaaaatatttaccaagatagatcaatattcttggccataaaaaaacaacaatttttttttttttttttttgagatggagtctcgctctgtcccccaggctggagtgcagtggcgcgatctcagctcattgcaagctcctcctcccaggttcacgccattctcctgcctcaacctcccgagtatctgggactacaggcgctcgccaccacgcccggctattttttttgtatttttagtagagacggggtttcaccgtgttagccaggatggtctcgatctcctgacctcgtgatccgcccgtcttggcctcccaaagtgctgggattacaggcatgagccaccgcacctggcccaaattttttaaaaatagaaatcatacgatgttttctctcagaacaaaatagaattaaactagaaaacaataataaaggtaggtgaaaaatccccaaatacttagcaattaagcaatgcatttctaaataacatattggtgagtgaaaaaaatctgaagagaaatttagaaatattttgaactaaacaaaaataaacagttcatcaagaattgtgggatgcagcaaaagcagtgctttgagagaaatttggagcagtcactgtatatatacttttgtaaaaagaaatatctaaagtgaataatctatgcttccactttagaaaagtggaaaaagaagagtaaattaaatccaacgtaagtagaagaaagaaataataaaaattaaagcagaaataaatgaaatttaaagcaggaaatcaatagagaaaatgaacaaatccaaaagctggttctttgaaagatgaataaaatttataaaactctagtctgcttaccaaaggaaaaaaagaagacaaaaatttctaatatcagaaatgaagaagagacatcagtacagatcttatgaacattaaaaggataataaaaatactatgaataactcaacacctacaaattttattatttagataaaatagaacagaaaggcacatgtgccaaaactcatacaagaaaaagtaggcaatctgaatacacctatatctactaaataatttgaatcaaaaattaataacctttcaaaatccaaagcatcaaacccagatgggttcattgatcaattctaccaaacatttaaagaaaaaaattacaatttctacaatctcttccagaagataaaagcagaggacaaacttcctaattcattctgtgaggccaccattaccctaataccaaaaccaaagacattttacaagaaaataaaggtacaggccaatatttctaatgaacaaatatgcagaaaatctcaacaaaatatttgcaaattgaatccaataaaaaaattatacatcatgaccaagtgtcatttatcccaggtatgaaatgctagttcattctatcaaaagactaaacaacagcaacaaaaagttcatgattatatcaataaatgcaggaaaagtacattttaaaaaacttgatgcctattcataattaaaactcatggcacactagaaatagaagaaaatttctcaactagataaaaaaaaaactacaagaacctataactaaaattttacttcatggtgagaaattagaacgtttcccactaagatcaggaaaaagatgagtatatctcctcttaccattccttttcaaagtgttaaaactatgcaataagcaagataatgcagtaacacaagaaaaggaaataaaaagtatacggattgggaagaaagatataaaactctttcataggtggcagatttctttatgttgaaaatctgaaataaccaacaacagaactcccaaaactcaaaagcaattatagaaagccttcagatataaggttaatatacaaattaaattgactttctatatgtcaacaataaatggaatttgacattaaaaccacaataccatctacagtagtgccaaaaatattaaattacttggcataaatctagcaaaatattacaagatctatataaaaaatgaaaaactttgatgaaataaatcaaagaaccagataaatagaaagatattctatgttcatggatagaaacactcaatattgtcaaggtatcagttcttcacaacttgatcaatagactaaatacagtctcaaccaaaatcccagtagttattttgtggatatcaacaaaatgattctaaagtttatatgaagaagcaaaagacccagaatagccaacacaacattgcaaatgaacaaagtcagagaactgatactatcagactttaagacttactatgaagctacaatgcagtattagcaaaagaacagacaagtagatcaatggaaaagaatatagagcccagaagtagaaccacataaataaagtcaactaaattttgatatagaaccaaaggtaacgcaatgaagaaagatactcttttcaacaaatgttctggaacaactgaaaatccacatgcaaaaaaaaaaaaaaaaacccacaaagaatttagacagagaccttataccctcacaaaaattaactcaaaagaaaccatagacctaaatgcaaagtacacaactataaaacttccacaagatatcataggagaaaatctacatgaccttgagtatgatgatggctttttagacacaacagcaaaggcaaaatctatgaaataaaaacccaataaggtgactgcattaaaattaaaaatttctgctctgctgaagacactgtcaagagcatgagaagacaaccacagactgggagaatatattttcaacagacatatctgataaaaagattattatcaaaaatatacaaagaactcttatattcaacaataaaaaatcaaacaactcaatttaaaacatgggcaaaagacctgaacagacacttcatcaaagaaaacatacagatatcaaataagcatataaaaagatgctccacatcatatgccattagggaactgcaaattaaaacaaagagatagcacaactatcttttagaatggacaaagtccgaaacagtgatagtatcaaatgagaagcaataggaactttcatttattgatggtgaatacagtcactttggaagacagtttggtaatttctgacaaattcggtaaattgtgacaaacacagtcttattatccaaaccaccaattgcgcttttaggtatttacccaaatgatttaaaaacttaatggccaccaaaaacctacaaatggatatttgtagcagctttatttgtaattcttaaaagtgttttttcaggcagaagaaaaatatctcagaaagaaacagagacatagaggaagaaataaacagacacagaaaaaaataaatatattgaaaagcccaaatgattccttactgtatgtaacaatagttaaaaaattattattgaagttttgttgaaaatatatgtaaaattacaattataaaaaatggaatgggttaaatgaagttaaggtgttttaagatcccgattttgtcttggacatggtaaaatatatatttatatctataggataatccctttaagaatataaaaatgtacaaccaacaagctaacagagagaggatactgaataacaaagcattattttaactactaagaaggcaaaaaggggataattaaaatagaacaagagggaaaaatagaaaaaaagactatagatctaaatccaaatacatcagcaattatgttgaatgtgaatgcactaattaaatattttaaacaccgtattaaaacacacacacatacggacacacacgcagagcctcaaactgctttcaaatgtcgcaccttaaatataagaacacagaaaagttgaaagtaagaaatggaaaggtattaattttttcaaagtttatctgtggattcaatgcagttttggccaaaatctcaagagtaattttccagaaaatagcatgatgttttaaaatttatgtgtaaatgcaaaggactgactcacataaccagataatcaagattgatgacaaagttacatcaactaagacagtaggacgttagtgcaaaaacagacaaatggatcaacagaatatgataatgaaaacaggcctacacacataagatcactatattcatgataaatctgatgctgcagtgtaatgagaaagggacttttttctataaatgattctgtaataaacaaatgtscatattaaaaacatgttataacctctttctgatatcatactaaaaaattgattccaggcagcttgcagatgtaaatgtaaaggcaaaacaaacatcaacacaaaacacccagaagaaaacaaaagaatatctttgtggcctggtttaggcagttttcagaaacaggacatatctaacaccgaaggaaaaaaaaaaaagttgaaaatgaacttacatttaaattaacaacttctgttcatcaaaagataccacaaagaaagtgaaaaggtaaaccatgctatggaagaaaagagacagctcacaaaagcaatatacaaatcggcatatgtaaaatgygcaatctcattaatcatcagtaaatgcaaattaaaatcacaattaagtgtaccacattcccactagaatggctgaaaattaaaatatatgatagcacaggtgttaatgaggatgtgggacaactgcagctctcaaacactgcaggtcaactgcataaatcagtacaactatttctgaaaactgtttagcagtatctacataaaattgaacacatgcatacttgtgacccagcaaaccaacagaaaagcatacataaattcacccaacatgtccaaaaaatgtttattgggatactgcttgttataacccaaaacgaacacaaatcaaaagtctattgacagtagaatgcataaattgtggcatattcatacaaagaaatcctgtaaaacaatgaaatgaacttcatgcagaaacataaagtccctaaagccagtgttgaattaaaaaaaaaaaatagaaaaaagtataattgattctatctcaacgtatatctaaaatagatgaaattaatcaacggttctagaatttatagtactgattaccttcagagttccagagttgtcaactgaggaagtatacaagaggaaattctattctcattttgggttagggcctacacaagagcactcacactgttaaaattaaccaacctctatacttatgatttgtgcacctttctaagtaaattttataattttctgaacaagtatattataaaactgtgaccttgtaattgggccttccatgaccattttcctgtactgctaatggtcatcattactgagcacttgctgtatgtcagccactggcactaggtactttagtccgagttttcttttcttttcttttccttttcttttctttctttctttctttyttttttttttttttttccgagatggtgttttgctgttgttgcccaggctgcaatgtgatggtgcaacctcggctcattgcaacctccacctctggggttcaagcaattctcctgcctcagcctctcgagtagctgggattacasgtgcccaccaccacacctggctatttttttgtatttttagtagagacatggtttccccatgttggccaggctggtctcgacatcaggtgattcacccgccttggcctcccaaagggctgggattacaggcgtgagccaccatgcccagcctcccggttttcttagttcattattcaaaataaaattgctgctcacrttgtttagatttcatagatatggaagctgatgctcagagaagttaagggacttactcatggtcatgtaactaaaaacctccctccaaaatcacacctttctgattccaacactgactcctgtgtaattctgtgccttagtattctttagggatccattcagaatagtggcctcccacagccaaattagaattatgcaggatacattcacactaccccaactgcaaaaaggctaactagtgttttctccctgaatgccacaccctccacactgcctgtcctcacctgcaagcttgcagtccttggtggctgagaccaagatctggggaggtgaccctctgtctgatgtgtcttgtgtcgccatcttcggaacatgtggggcaattcagggcagaaaaagcatgagctttatttaggctgacagacaagatgaatgrccttgagcaaaccactcaactaccctaagtctcattttctgcatttatcaaaaagagatttctttaattttccagggggagaaggaattaattctcctgggacatgctaggcatatgatccatgtgaattccttttctttcccctctcgactcccctagaggaaatatattttatttcttccctgccccacacccattttccatctttctctactctgcctcagtggactcccttgccatctgctctagggattggcaggagattcgctggcaggagaccagtgaagtcagagtatgcactcccgcagctggctgcttgtagagtcaccattgaatggcttatctctggagctgggctcagctcctgtcaggcagtcctgaccgtagttagaacatgtgctccctccttccaccttgttgggccatccgtgggtaagggtgtgctcactwtttaacagaagtgagggctrctgttactgccagctcccagtgggagagtgagacccaatacactcaggcttctccactatggaagaaaagagacagctcacaaaagcaatatgcacataagcatgtgtaaaaggctcaatctcattaatcatcagttctccttgtgactttgctttgcctgtgcacatctttccaaatagtctctctccccaaatttctcagtttccctgtgccatctctttcttaccatgcaggatccttactgacatagcagctcactgggtcattttctctagaatacaacaagcaccttctatgtgagattacttagcctagccagatgacaagttgccaacaaaagaagattcaactacctttgggcttcgggcctaaggtagaggcagaagctaaaaaaaagcagacatgatggaatagatgtaaaataatcccagcacatacacagctcattgcttcaggtktgtgcatttatttcccccataaaacacaaggggttggatgctacctgaaaagcacagggccatcaccccaggaacctctgaaggtctttgttttttgaactatatggccataaaccttacctctcaaactatattctggaggatgcatagatayctccaccagctttggagagctagtttcgctgaagtttgcttcttttcggctgcacttcatcatgagcatgtctgaaagtcaggagctgagagggcactgactgagcctctcacaatcaaatcactcctctctaggtaagccaggctgcttttcatttgctttctgataacaatcagagtgattacctgagagggtctcgggaacagaagtgagggctgctgttacagccagcttccagtgggagagtgagacccaatgcaagcattccagttctagggacgaaaatggaaatgcttccttcctctgtctcagctgacaagctggaaggaagtggtctgtacgtgaatgttacaaatgagatgggtgactaagctaaaagcctgagcagttcacaccaagaggcaggatgctgtaggtgtgcaaatcacaagagctgctatttataagagtgtgtttgtgcaggtaccttacccacattatcactgatcttcaaaacagctcaggactcagaatccattctacaggtgagggggagaaagaaggctcagagacattggtaataggatcaaggatacccatctagtgagtggcaaagaacagatttttaagccagatctgtcttttcctactctgatctactgaatcagcactaggccatgctgttttgcaggaaaaaaagtaatttgccacaaagcaaaaggaagcatggctttgcttgtcaagagccagctctggtctttgggaactgtataggttctgcaagaggctcagctggcagaagaggggagcttatgaactgggaaaacatcatttcagcaatcatgaatcacacatatagctctgtgaattcattcttatcacttcaratccaaaatcatacaactgtaaagtccagagccaaaatgcaaaagcaggtctcacttattttattgccatagcatttgtctagcatttgtctccatctaaggtgcacgaatcccttctccctgcaccccttgcccagggagctaggcctaggagaacagaggaaatgtggatatatcccaggcagggcactgacccttcccatccaagaaagccacagggaggtaaggggttgaaagcaggaggcaaggtgaaaggaaccctctctacttaatgccagggaaacaagcatgagagcttcaggggaagacagaccagccaaaatcctctgaaggaagatgtgagcgagggaggtctctgagcaggtcgacttcaccactgaagtgcaagcgagaggatgctggagggtggtggattgtcaagtggcagggcacaggcgccaagctggaatagtaaacacagtggtggggagtggatcaggtaatactggagcatttagaaccaagatcagcccagggactgagtgtggagacagccaattccctgccagtctattatttctgaaggaagagcttgaataagtttatttcacccattttttttttgcttgcctcaaattaaggatgggtaaagcagttctaaggactgcaaagctgtgttgtgggaagcaactcccaattgcagcttttttttatgattactaactatggaattttcaccaaatagaagatataggtattattgtcactaatataagaatgaaacagagagactcaaagaagtaaaaaggaatgtgctcaagatgtcacctccaataatggccagacataggaatccagtccagacctggccagttttagtgttctttcctttgacttatcttgagcactttcctgggtgccaggatcaggtcaccagccctaccctgttgcccatgtatctcatggtgcccacggtgccctgccagtgggattttcccacctcctcttagtcaaagccacaacgcccccatctgcaatgcattttctacactccctcctcggctactgttctgcttttcacctcagatgagcatcaaaataagattgcacctaaacactcaccttggaagagtgagatgcagaggcttgcctgactcacaactcttaacggaagtggcttagagcttttatacgagaattttaggaatatgtggaagatatgaaccaggttcctggaaaaaaggcacatacacacatgcatacacacatgcacaagcaatttggcagataatttttggaggttttcaggcacctctgaggtctatcaagggactttggtgaaggaattcctgcccgggggagaatcctaaaactctttagagcactagttagtctcagagtttcccttagcttgatgcacactttaccttcggcagaaggaggatatgcctcttggggagtctaggggaggaaggagatatccataaaggaacagcccagcttctgagtaagcctgacagactgatgccctgcctggcttaggcaacttcaggggagcagatatccagcccaactctgtggttacaaatgaccctgttagcccagcctacctacagccactgcaggggtgcacaagcagatactcaccgactgccctgaagccactggagagaaggcagcagatgtggaggctgaggtacctgataggctggtgacagggaaggtcagcacaggtgcagcagctgaggcacagtgggtatgctctctgggagggagagccagctgtactggcaggagtactcactaaggactcagatagacaagaaagtgaatcccagcactrtctctcaccagctttggaaccatgtctttttgagtttcagttttcctatctataaatctatttataatatttttttaccttgcatggctgatctgagaataagagagtgtttgtatgtgaggggtatagcacagtctctcaaacagcacacctgatcaagaaacggtcactgatacggatgataatgggttttcttattaggaagcaggatgttttggagaatgcttggggcttctttgcatatttcagggattctggttgcaagtcaggattttagagcaagggactgatgacacaggagggtttggtgagcacaccaggcagctttgcagacagcaggccgcattgcaggaggtgctcctccctcctcggcagctgattgcagagcaccgcttggctgattgttgtattgagactgtgcactgggcagggaagccctgaaacagcctcttttctcccctgggttctgtttctgatgagcctatctccatttgcttatgtcacccaagcgcattgccatgtgctttaaaactctacatgcatgtgcctgatatggtgactgtgtttgcatggacttcggtgtttgtgcatgaacatgtacatatgtgtatatgtgtctgtgtatacttattttagatgtacaagtctccatatgttggtgaatattttgttttcctctgagtttggacacccctgagcccctggcaactgtctacttgaatctgccagcaactgagctctccttgggtcacatttggttgctcaccctaagtaatccagatctatctagtgccctatcttgcagatcccagccattggccattgtaaacttctgtgcccatcttttttgttttttgtttttcctgcagacagaatttctattatcttttgagctcagtgctcaatgtcaagttcagaggtgagacaataaagacaataaatrctggcaggggagggatgatcagacattacagacaattgtcccttcctcttttgtaggaggtgactattagctcacctgatttatctggaataggttcacttctctcataagtaatctcctctgactaaataccaccactgagagacaaaaaaaaaaaaaaaaaagacaatgattaaagttattggcatagaagagggttatttatgtgcagtttcttggtacraagggtgaggataataagaataaacagttttattaaaaacaactaatggcataaaagaatattttagatacaaaaatgttacattaggaacagaaatgctgcctcttttattgtgtccacagcaaggaaaggtcagttaaaattgtctggagcttttatctcatttacttttgccaaggctaggagtacaaaacaaggctctagttaagacacagatgctaattcatgagcagatacttttgggagtgaaagtttcctgaaaacgaagctggaggcactcaattaagtgaccccttcaccttgggagcagaaggtcacatagagacctgagttatccgttagaccttgcccatctctgttatttaataatatttaaaatatgtttaatatttcaattttttatatttctatcatctattattaaatggaatgacttttaaatgaaaacgcacaggccatagactgcgtccctccatgtcctcgtggcctttaggaccactggtcttttcttctttaatgtgtctgcttctcctttagwacttgaaaagacaaacattaggtatggaattagttttaccttggcactattcgggggatttctgatttaggaactaggcagcttcttcttaagaaaacagccctttgtggttccctgcagctgctcctgtccacccatctgctcacagaatccagcggtgtctgttgcccgcccctcagccccagtctgaggagtggccccaacgtggagaagcctgtccttggtgcagggcagaagaactagggctgggcatcctccttttggtttctagaagaagaaattttgatcatgtcagacagcctcctcagatcagctttactgagcttgaggccgacagcggggctgtcccccacaaagtcactgaagccaggggacttyttcagaggtcggctgaaaagcacacacatctgggggtggaagatcaggttgatggcttgaggcctgtaggatgactgagggcataagatgttcattggagaaaggtctccacagatcctgtaagggccaaattttgagaagccaagctgggggtccagccaagctgtgctccaccaggaatgacagtcccttagctctgagacctaagcacagggaagcaacttatctgaggtcagggtgagtgcagagatgagagtggcagcacagtcagctgacaattaaaggggtgttcattcctccaggccatgggagcacttctcyacgcatgatgatgacccagttctctcctaagacacttccaagaacgtaatattttaaagaacactgttaggttaaccaaaaattagacttgctcctcagcctgtccctcacactgtcccctggttggtttcagggaactctggatatgcactgggtgaggagggcctgcccccacctccaggcatatctgagacccccttgaggagaggagttttcctcatgactgtccctgctgatagcacagaatttacttcatgatctcagcatgcccagaaacaagcagacagtatttcttcaccccagagaataagagcatagggagcaaagacaagatttattattaaacaactttaatccaaatgctgattattatttgcagtgtctgaaggcacaaaatatacctaaaatgtatggaatagtctaaacagagttataaatccaaagagcaaagcatgaaaaaaagatacattctgagctgacacagaaatctgagttgggaagtttttttttttcctagagaacttgcttgaatatcaatcatttcccctcatgccaagggtagaaaattctaaaaaaaaaaaaaaatatatatatatatatataaacatggtgaagaataacaccatgaggtgttaaggattttgtataagcagaatacttctcttgaagatgctggtctctctctctctctctctctctctctcacacacacacacacacacacaaacacacacacacaggcgcacaaacacatcctccatctccctctctttcctccttgacactcattctaagcagaaccatccaagaagacatccaagctataccccagaagacaggccatctcagggggcaatgaggaaacagagttggtgtgagataaggcagtgagaccagagtttgattaaaaaaatagagagatatatatgtgaaaaattgaccattcagggcagggcccccaacgtgctgatggaaaacaaagcctgctcttcctcggggtcatggtagcccacctaggcttctctgagcatgcctggctccaaggtccacatgctctgattggagaaatgtcaatggattgcctaggtagcacgaatatcagaccattctcagcatccagcaataaataacataattataaacactctcttccccacagtgcttttagctgactgtgtgatttggccgttctttactgctcaatcatgtcactagggactttaggaaagaaatcaatcctgggctagttatcaccctcataaatacatctctctagaaactctacaaggctatagaagaagcaatcaataggactttgtatttctccatgatcacagaaccaggctctcagctccctgattactgctggctgtgggagctccacctccttcagtgacagatgtgggctgtgtattccattctgacgggtctggagatcagactaacctttgtctttaggagaggaactgaagtgacacaactcagattcccccagttccactcctaatggttctttccctgattctgtagtttagttgcctcagaaagggcaactgaaggagggrgcgctgttaggtggtcctaggcttagaaaactgggcttccctgcagctgtacctgcacagggataggcctggaaatctcagaggttatcagatgcctgagtggggagggcccctgctctgggttggattgctgcttgaagaggactccaggtctggtctggagagggtcgtaaagstggaagggagrgtttgtgctggagccagccctgtttgttggactgcctgcaggatttatgacccagagataggcctttacttttggggctacaagcaacttccctggtggatgggagttacacttatgcttctcacctaaggcgcaaggcaaggcttcctcctacccaaataaacatggtctcttttctctatttctcagcatgccccatcacctggagtactggtccacccacctgggcacctcccccaactcttactaacagagtccgtttgcctgacaccacaaagcttctactccctgcatctatggcctcacttccttctctcacctgggaccatgggtccaaacccaagggaatattcttcctctacctggccttttgttccaccacctcacctggtccatgcaactaaccccacctcgcaactccctgcccccatggaccttcttccagaccaaccccacctccgcccagtctccctgaggaaacgatggagtctgccctccttcccccaatattctatcactttttgattcttctaattttgaaaagaaaatgaaaaacaaggccaacagtatgatatgagaacagctcagtatcaaagccctcaattacctcactatgggtaattgtcagcttctctcgggcccatggggcagaggcacactgcaacacacacagcggtgactaactcgtcccgcaagatccaagacaggacaggatagccctgagtccagggcacctcctcagccccaggctacccagaacagccgatcaccctacagcacagcaacccagtgggccagcccaatgcgggctccaaactcactctttatcaagctgagggactaaaagggacgaggtgccaggagcaaagaaatggggcagcaagctgtgggacaaggcagcgagtggcatgtggggttcctcgtcttcccttctcccccagcagagaggggctccttatctggtcgcccctcctgccctcagaaaggcccaggaatgggggggctcctttggcacttcagaatgatcacaagtaatttgcctttttattcatatagaacaaaatttacaaagtcattcatacagtttttgtgtttttttactgacttcgaaaattgggaatattcaaaatacacttttaccccactccattctgtcattatttacacatatgtacaagaaaaatgaaagagtctctgtgtatgtgtgtgtgtgcgagtgtgtgtggtttgtgttgttrttttcttgtattaaaaagctctgctggtcgggtgggtgggagggtgggcaggagggcaggcggcgcagtcagatggaggtcccgtgggaggtgtccagagcctctggaaggacgcctccaggcacgggctggaaggacatggggatgggggtcttcaccgggctctgccggaacagccccccgttgggtgacctgtgtttgcactgcatggagggcatggtcgccgagctgctcagcggcagcggcaggttgctgctgggccctgatgagagtgtccggctggtgccatggctgctctgctctggcagaaaggtgctgaccgagagctgggtgttctggtactcccgtgtcggctccaaggtctgggtgggagccaggccccccatctccagggccgagagctcaatcgacgctggggaaatctgcttgtgagcaatgtcttcatccatgaggctgttcatgcgccggtggacctgctccaagttcacttctttgtcctggagggaaggcataggaaggtcaggtggagccctaacagtgagtcaaggctggcttgctacagctctggatgtctgtagtcaccaggcctggtcagcctgttgggctgtgggcgagtatccctttcatgtggctcccacctcccctcaattatatggccaaccctcagttatctggagaagccaggggggagacatgatccctatgtagcaaagaagatgccatcaacaggccttggctgcatcctgccttgcctctgtactcagtttagagtcactgccatacccagaaccaacccttaggacaagatgctttcaagagcaggcagagacaggagaagaagtcccacaggaataaaggaaatagtccttgagcccctaaggtgtcccatgaatttgccacttagagttcaagatgatgaaaagactttgtatgatcatccccaccttgcacaaaaggaggctcaggctcaggaaggttcaatgattcatcagagtcacaggaccatcagtgttagaggcagcttggaggcctggagccagagagaagccctgcctcacccagtgacctgtgtcctccctgtgcaatctcttcaggcagcccaaggagggggacatatccctgtctggaagggcaagggggcgtgggttcctgggtggagattgtgaggaatgggacttccccagggtcagctgaccctcctggtttcatgagggttcaaggctatctaagtgggtgatctcacacctgatactgtctcaccacagtgggtgatatcacaggaaattacttggcttgtttatttgcttaagaaagaaaacaaaacagaacaaatattgttcctttcaaataacttgatgatttccctacaatgtcagaataattaaaggcagacaaactgcctgaaagctcaaggaagacgtcatctccttccttggcttccccgctgtgaggtgggcacaggacctggtgctcagcagaggagccatatgagcttcccggtgaggttgaggctgcagggactttgtaagcagcatgggtgctgatgcgccagggaatgtggtgacctttccctcacctcaaactcctagagaaatacagtcccaaagctcagctcccaggccaccctgcaggtggtctcatgttggcatcttgtattggagaaaggaacccatcccctgtccaccttgcaggggagttagaaatattaagaaatgtagaagccctgaatatgccttcagaaggaaaaagaaggaatcacatgaatctaagagccattccagtgactgctttgagcttctgtggggacagtgggagaggatttccacccccagaagttcaactgaatgataggcatgagccctgaccagatgagtgcatgaatcacagggctaacccccacaaagggtcaactcagtgttcctcaagcaaggaggtgaagtgctctgcagttcactccttgcctcaatgtcccctggcatatagaaggtgggaccactgctctctccgcacctttatgagttcatggttggcacacatggtttggcttctgatgagacacctgctgtcagtcctagaatctttcccaggacaagaaaactgacaacacccataggacaactgacaagtcattccagggcaggaggaaatcaagacagccaactagtttgagaatagaggatgctatgggatgtggctcgctgtcataggtgaaaatgacatcagaaaccattggcacagcctcacaggcacagtcacaactycagtgatctgaagcccacccacacaagcagagctcagctcattcgtgctgggagaccatctctgagttagggtcacctctgcatggcaagtgtcgtcgggaaattgtgggaactggctggagaatgccaggcttctacttgtcccagctaaattattcatgaaatgtttatgctgactccttcaaaggtttgtaaaatatagagcaaaccaaattcaagttattttcctaattaccttacaccatggtggagccagttctgttcaactttgctactttttgtgtattctattttatttgctttgttttcatttttgcatgtaagactactttaggaatattttataaccgttatacagtgtgttagtggcttagcgccactcagcatcaatgatcttttcccaaggaagtctatggtttattgcttttagggagttactatccccaccggataacagtttgacagactatcaagagacaggttacctaacgaagagacaggaccatgatccaaataaggacagtaagactgaagctgaatccggaacaaagagacagagagacagaaagcagcaggtgcttcatctgctgcagcagtgggactctgccaaactttcttttccacagccatcctcctagtgttctgggcctccagacaagccctgactcttgcccagcatcaagcctgcatctctagcattcttggggctgctatgagctcctgttaaactgtggatacagtgtcatctgtattagccagaatcagtgctacaatcgttttggcgaatatttgtatctataaggcatgttcatttcaaaatgtatgaagggcacaaaacaagtaccagggagtctggaagctgaagtagttgagaragaaattcaggtacttttagggtttaataagataaccttctctcttctttgcagctagcaaagcttggagaagcctgaacaagctggtcaccctcactgtcaaagactttcatttcyacggaagggaaactgatgacctgggaccattggaagaactagttagtaattaatcagttgcataatcttcccttatcctcttttctaatttcccttcaggactttaaggacccctttgaagatgaaaagaaagaaagtttgagtggactcaattaaagtgggaagcaggtgtctaggttccagggctgctcaactctggattctggcagttgatagagggcctggccttttttctcagtcaaytgagcactagcccagggtgttcaggagatgctcccattttgttagagtttggagagagggaaagattaacttcctgtccaagaagaaagccacagggaggtaggaggttggaagtaagggacaaggtgaaagaactctctctatttaatgccagggaaacaaacatgggagcttcggggaagacagaccagccaaaattctctgaaggaagatgtaagtgagggaagtctctgagctggatgacttcaccactgaagtgcaagtgagagaacactggagcatggtggattgtcaagtgccaagctggaatagtaaacgcggtggtggggagtggatccggtaataatggagcatttagaatcaaggccagccctcagactgaatgtggagataactagttctctgccagtctattatttctgaagaaagagcttgactaagtttattttactcacatttttttttgcttgtctcaaatcaagtatggatgaagcagttctaaggactgcaaagctgcgcagcgggaaccaactccctactgcagttatcattcgcctttaaagtctccgtgtcaagacacacagaaagtgtctacaccaaatggacaaacgttccagggggtttccttcccaactgcttattaagaaatccatcctcttcacatcagtgggacttcattctactcaaattccatcaattcccaatagctccaacacgaggacaaaccctaggagatgagggtgccatctcaagtctcttattttggttatttaactgaataagaaaatgtgtataactgcagcaaatgactcctatctttcctggaaaacaaacgcagccatttgctgtgtctcacaatgtgtcctttaagtcgcctgctcctgctgctgtctgtgggagccagagctgaggtgcgcaggacagaccgcctggtttggaaaccttggaagcatggtctgcttgtattacctggggtcatagatttagcactcataaagtcatgtctgtctgttccttctgtgtctccagccaaggaaagaggagacaggagtaatcagcctactcaaggaaagaggcaggagtgatttgaataattatctatcttttagacaaaatactgcattctattatgttatgcaaattcaaataatgggcttttttatgtgaactacatccgtttacatcctcattatcccaaggtttcggtattcggccaggtaatgacagctgtgaaaacagacttggaaacttactgctatcttcattaatttactgtaggtaactgacctagtcaaacatccctgaatatgatataaaattcacagactgtgtttacccgtgaatccggctgaattccagctctgcgtttctcatcccatattaaacatgacgacagatgcaccaacagaggttactggggaacctctcccaggcattgtcttgcagagataaagttctgtaattaagctgctgttcaccaatgtggaaataatacagtgtattggaaaacggtaattaactaaactatcatctttgtaacagcctgttacacatgggactccttagaacagactttgcttggagtccaacagctcttattgtaagttgggcaggaacaaaaatggggatgaggaacttccccctgactgagctggctgttggtggcattatcctattaccactgacaccaatcaggtgctaaatgggacccaagggctgggagaaatgctaccaacacaatcttcagtgttgttcccaagacttacccaaccccaacgggccgggctaggggtctgagagtattggctgggtaaggacaaaggagctcaagtacgtaagtgaaatggtctcaggagatggtgggcagtttttcaaagcatcaggagaaagagttctgatcagttcaatcgcagatgttttagggagggcaatgagagcgaaccgacaatgacttcacatcgtgggtggtagcagcaggtgcaccgaggaatgactgaggctaggggtaaggcagcttgctgaagctcaggcaattccacagtaagtggaaggtcaggacgagaactcacatctaccaggttcccaaacctgggctctttccttttccttttttttttttttttgtttgtttgtttgagacagggtctccctctgtcacccaggctagagtgcagtggcccaatctcggctcactgcagccttgaactcctgggctcaagcaatcctcttgcctcagcctcctgagtagctcggactacagtcacataccatctcacctggctaattaaaaaaaaattgtagagactggggtctagctttttttgcccaagctggtctccaactcctggcttcaagcaattctgccttggcttcccaaagtgctgggattataggcatgcgccactacacccagcccaaaacctgggctcttttccatgacaccagtgtgtcaagaaattcatcctccccataccagtgagacttcattctactcaaatttcattacccccgtagctccttaccttggaatgttggcataaatcagtggttttcatccttggctggatatcagaagcacaggtggagattttagaaattatggcagtccagatctccctaatatgaccctttgggaaacagggcccaagcatctgtatttctaaaaagccccagaattaatcacctctgacatgcagccagaattaaaagccattgatccaggtgcaatgattacacaacaatttaacattagtaatgtcttctttacgggagtcttgactagttcattcattcaataaacgtgtttgagctcctactaccagatgagctaatgttcttggtaaagcatctatcttggtccctggcacatagaaagtgctcaatacttgaattatattcatcaccccttaataagagcttccactgttccagagagaaggcacattgatggcaatgcagaggtgaggaggcactggtggatctgaagcagagacaggcaggtaaaccattactggcaatgtggagcatacccagcaaggggggctgctagtggtggcagcaagcaggggaggctttgccaagtgatctggttttgagatacacagcggtgtatggtaaatgttccatggcttctcactggaggccgtgggctgaaacatgcacactcactattcttactctcatgctaagccatttgctcctgagcatagttctcaggccaggctgtttccagcagaagggagagactgaggttcagataatgtaaatgtgtagccagaagccaggatccaggagcctggccctgggtagagcactgagtcacaaccttcactcccaagtcctctggaaaatgctacctcggaacccaatgggctcatgcacatacccagaggaaaggacagtgccctggccttttgacaagcttgcgcctgggaggcagcaggggtacagaggtagacacatcattcacatcccatctctacccttctcacttctgagagggatttcatcagggataaggatgccttcttcaactactgaagagggctaacaagattgctcagcacaggaaaggagccctaaggtgtcacttgtctctcccatattcctcattgcctagcccaggacctttggatagagtagccccttggccaccaacaaccaagcgtgtctctgggccaggcacatctttaattcactttatatgccttcccttgttgaatcctcagtgcaacgctgtgggttggcataaatgaagaagaaaaatgtgcagactggcaaactctttacatgcagttgaagaagacatcaaaggagtggaggcaagaaagggtgtggagttgaagaagtgagggcccctgggatctaatctttcacagtgggttggggcatgcagacagaggctgcccacagccagaacagaggggccatctgcttctctgtcccctgctgcccggccaccctggcctcagccagctcctgtgtgcgatggaaaccgggccaggggagggcaggcaaggcagaaagcaacaagaattccaaactctgagcccagtgatggatgactcatccctcactcctcatgtcgtctcccatttgtgcagttctcatctttatttcatgaatattttattctcagagcaatggctccacatcccccataaatctagcgagtggctctttactgcatccatggagtttggtgcattcacctgcattgggtaactacataatcgtctgattccttagaaaaaatatgagctgaaatctacatgaatattaaggggttgaaagcacattactactcttcttcaagtaagtgtctaaactgtgacgacatcctagagcaagccattaagcacaacttgggctccacccaaagacaggtttctggctcttaagaaatatggccaatgcctcaaaatgaaacattcaaagattaaccagacactctcacctaattgcaaatgctgccccataaaacacaggcaaccagtagcacaaagtagttccggattaaataccatcattattttttgaaggttttaagaatatgcttctaaaagactgtcgttttgagccgtttcctgcctattccctgcatgataaagtcaaaacctctcagtctggcatttaagtccttcggagcaggccccgtatccttccccagcctcccctgccagcatctccttcctcacgttgacacttcagcccttgagctccaggaggtatgatgactttgttcacctccagctgttcaccctgcccaaaatgcaacttcctatctcatctttagtaccagggtttgtatcaatgcttcaaagctcagttctaacagctctgagccccaagtagtcttcaataaccagcacccctaacccctctgaccccaccatgccctggctgggctggatgtcctcggtgcttttgtgatacctgctgatcactgcagtacagcctgctcaatgagtggagactgctgggcccagctctctgccacatctgtgcatgaggaagtaagctccctgaaggcaggggccaggtctctataggcaggcttattaaaggaagaaagggagagagggaagaaggaagggagacattgcatttgaaatttggaaacccataaaaatatgaaaaagatggaacatttccatgcaacccttcttagcaacaccagaaggggttggaggacaggcagctgctgtgcttttccaacctgcctctctccatgtgtcctcattcctatctggaagcaggttggcaacaggggcaggaagtcccacattctggaagcagggctaatgtattcatcatttcataactgagatcctggacttatgcagaagccagaataaaaggtaggatgttttaccggcaagaaaggagctgttcctcacagctaggttatcccttggtctcctggtctctccatttttttctcttttcttttctgtcttcctatctatgtctctttaacaatcaccagtctctctctctctttctctgtctctctcacacacatagaccacaacaattaactgtgggtggtccaggctgaaattgtccaaaccgtcactaaactaggcattgtgaagggacaaagctaaaagcagacaatgacttcccatccaaaggacaagctctccctgcatgtggctcacagatgataggctagaggctggggctgagcctgaacctgtgtctccaggcccccacccttgcccacagctgcccaggaagacaaattcctgacagtgcaattttcatccacctggagaccctcccctgctccgctgacacaaggggcctttgcacagaggaaaccaggttgaagacttagggaaaacaagcaaaatccaaaacaaacaacacggagcgggtgcaacgtgtgccaatttgggggcctggtctttcccatccttctcatccttcttggttctactgggggtggctttggggccaccccatcacagctgcctactgatgcttctgtgcatagagacctgggtggtaacaagcaggtgaagggtgcacactggtcatggcgtggaggggctgacatgatgaggagaggtcagatatgtgtagcccttccttacaactgctagtcagaataattcactgtccctcccactgacttctttatacaaaattttccagtagccaaagaagcttgggacagaaccatcaactattcctttcagggccttttcctcaaaggtctgtcttccttcccttctgagctccaggggtgataggacagccactgaggctgcagctggccccagcttcacattcccttacatggagatacacagaaggccagagaggaagacagatatccccgaacattgcagatgtactgagttaagcagtgtccttccagggaagagacagcataaggacagagagctcactacctggtataatgcagagtcctgtaaggagcgagggacgcccacccctgtcctcacccctgacctgccaggaatgcccttatggaccaatgaatggagggtgcgatgtggccagacacccaggccacacacatggtggacccagccttgctgtccagaggtgccaaatcccttccccaaatcagtctgagaaggagcccgccggctcttacctcctcctggctgtttttctttcctgtcccagtttattttttgtgccccttggaccttctacctctgaaaccatttaatgaactgccctgtactatctgagcctccagtaaaaacaaaaacagacaaaaaacaaaacaaaacagaagtgcttttgggtttgatgcaggttgct

SEQ ID NO: 10831 - DNA, 26566 bp, Homo sapiens
  misc_feature (1)...(26566): n = A,T,C or G, or insertion/deletion polymorphism (see Tables 1-2)
aggtgggggtagtaggtggggccagagctggggggtggtggtggcttaaatcaagaaagccaaccaatgagcaggagggggtgtggtttaacgtcaggccctccaacccgtgggggtagtaggtggggccagatgaggggtggggctcaactttgatgattccaaccaatgaacaggaaggggcaggacctaaggttagtgcatctaatggatgatgggtagagcttaggtgggaacagaaggaaaatgttctgaaagtgagtaaattggaacctaacctcttagcaaccaacccaggagttgatcagctaaatagcaaagagggaggcatctagttgagaaggtttcaatggcttgtcgtggagcttggagaggtcactcaaccaatgagtggggtgggtctacccttgaagtttcaaattgggggagggtccgaaaacgggcagagcccaaactaatgagggtaggggttgggaagggggagtcatctcttacaggtttccaaatgagggtctagccatgatgtgcctgctcttggggagtccagctcctgcttgtccaccctctttttgtccaactgagaggcagaatctggggacaagtggagccaaaaaggggtatcaccggccagtaatggagtgagtcccaagatatgaagtgggcaggacagattcagattttgctagtggaatctgtaggtggtctttcttcctcgtacctaatgccaaggtaggaataaacaagggcacctagtatgtcttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcaggtgggctgggccccttccccagatctctgaagtcctgtgtcccttcctgcaggacccaggatggcagtgagtttttgctccaggcaaaagatgaggtgagatctggtcctttcctccctctgtgtggacctcagtaatgacctggctgtctggctcctgacccagagtgatggggctgtgagaagggacactcacaggccagagttatcagggctgtaatgggaaagcccacaggcactgagagcccaaaggaggttcctaacccagtggggagtgggaagggcttcagggagggctgcctgcagatcctgatgacaaagtccaacatctttgccgtggtcactcaggtgagactggaatggagggagttcgctttaaaaaggggtgatttggccaggcgcggtggctcacgcttgtaatcccagtactttgggaggccaagacgggcagatcacctgaggtcaggagtttgagaccagcctggccaacatggtgaaaccccgtctctactaaaaaatacaaaaattaactgggcatggtggcaggtgccttaatcccagctacttgggaggcagaggcaggagaatcgtttgaacctggaaggcggaggttgcagtgagctgagatggagccattgcactcaagcctgggggacaacagcgagacttccttcgaaaataaaataaaaataaaaagggtgattcagagggacagtgggggtctaaaaaaaggagtgattcaggttgggcaccatggctcaggcctgtaatcccagcactttgggaggccaaggcaggagactgcttgagcccaggacttcaagatcagcctgggcaacacggaaagatcccatctctatgggtaataataataataaattagccgggagtggtggcacatgcctgtggtcccagctactcaggaggccgagtggaaggatcacctgaaccagggaggtcaaggctacaatgagctgtgattgtactatggcactccaggctgggtgacagagtgagattctgtctcaaaaacaagagggggtgggtgatctaggtagagggaactgcaagtgcagaggaccagaggtgcagtattgcaaagggttaactgctggagggcagagttcatggaagaaggtcccagaaaggttcccaggagataggtgtctcaggacaggatgggccatttggaggagattggattttttacctaagggcactggagagctaggggggattacagtgatgtgtaaaaaagattcctggctgggcgcagtggcttacgcctgtaatcccagcacttcgggaggccgaggcgggtggatcacctgaggtcaggagtttgaggccagcctgaccaacatggagaaaccccatctcttatggtgcatgcctgtaatcccagctactcgggaggctgaggcaggaggattgcttgaacccggaaggcagaggttgcagtgagctgagacagcgccattgcactccagcctgggtaacaagagcaaaactccatctcaaaaacaaaataaacaggccgggcatggtggctcacgcctgtaatcccagcattttgggaggccgaggcgggcagatcacaaggtcaggagatcgagaccatcctggctgacacggtgaaaccccgtctctactaaaaatacaaaaaaattagctgggcatggtggcgggcgcctgtagtcccagctacttgggaggctgaggcagaagaatggcttgaacccgggaggtggagcttgcagtgagctgagattgcgccactgcactccagcctgagcgacagagcgagactccatctcaaaacaaaacaaacaaacaaaacaaaacaaaacaaaacaaaacaaaaaaagattcctttggctacctgggtgggtagcccaggccgcggccagggcagggacccaagtgggagagcgcatggctgggccacacaggcctgtggggagaggaggaagaggagtctgagagaggcaagcataaaggtggtttgaagagatgttgagagtaataactaacacttgttatctcattcaatcttcacaagatgcaatgaagaagtgggctttttttttttttgagacagagtttctctcttgtcacccaggctggagtgccatggcgcaatctcagctcactgcaacctccacttcccgggttcaagcgactctcctgcctcagctacctgggtgactgggattacaggcttgcgccaccatgcccggctaatttatgtatttttagtagagacggggtttctccatgttggtcaggctggtctcaaactcctgacctcaggtgatccacccgcctcagcctcccaaagtgctgggattacaggcatgagccaccacacccggccagaagtaggcctttacccactacatgccttcttttacttatctgcacaatgaagattaaaaatagtttcttggcctggcatggtgcctcacacctgtaattccagcactttgggaggctgaggtgggcagatcatttgaggtcagaagttcaagaccagtgtggccaacgtggcgaaaccccatctctactaaaaatacaaaaagtagccaggcatggtggcacgtgcctgtagtcccagacactcaggagactgaggcacaagaatctcttgaacctgggagatggaggttgcagtgagctgacatcgagccattgcactccagcctgggggacagagcaagactctgtctcaaaaaaaaaaaaaaaaaaagtctcttatcatagggttactgtgagaattaaattgctccatgtttaattgatacatgataaactgatacttagcacagggcctagtaaatatcagtgctctagtagtgcctgcccatattattatcattgtttgtgtcatttatctctgtagtaggaagtatatacaatcctattgcataggtttaagggaattaatccactaaagtgtttggaacagagcctggcacatattgctatgtaactgcatcatcatcatcatccctttttaatagatgagaaaactgaatttcagagagggtagtctgatctgaaattcacctattattccagcttctctcttccaaatacggcctctgtgccctgtttcttcccccaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacccccccccctcccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttgacggtctatggtcctttgtttgggttttctgggctgcgcccgggaggattgaaaggagggctgtggtggctgtaggggtgggtgcggggtggggagaggggcacgggggtaccgtggctgcggagaacatccagatgtacccttttatgtggacttaatttcggggtctaaacacacgccccttgacgagaacctagagggatggagaatatttcgttatgcttcgtaataaacttccccaaaggagactccgggtccgccccgtcaagttcaggaaaggcggacccctttaaggaggcggaaaagttaaccgcgatgggcaggcgctctgtccaatcgctagtgactcctggagtctctggcccaatgagcagcctatggaggcggggtccgggtgcacacccggaagtgggtgcgggccagccggctcgcccgggggccatggcagcagcggctactgcagccgagggggtccccagtcgggggcctcccggggaagtcattcatctgaatgtgggaggcaagaggtgagtgtgggagactcctgaggtcccatcctcgggggcgggaagcggggtgggagtatccgcctctcctgggggaatccctgtccatcaagggttgctccgccccccccccctttggaggcgcgagattctggaaaaacgccgggggagggggaaggggagggaaccctggatcctgcgggagggggacgcattcctcacccgctcctcttcatctcttgcgtccgtttaccttccccgcccagattcagtacctctcgccagactctcacctggatcccagactccttcttctccaggtgatcgggagagcgagtttggggcgagggtaggagggatggagagggcgtgggagacctaatatccactcccccggcccgtgacgcctgctcggtgtcccttccctgcagtcttctgagcggacgcatctcgacgctgaaagatgagaccggagcagtgagtcggacaagaactgaaatgggatgggggggaggggttggtaggaagaggggcaggaccccactcagtcctgccttttaccccatccatcctytgcccccctttcccgcagatcttcatcgacagggaccctacagtcttcgcccccatcctcaacttcctgcgcaccaaagagttggatcccaggttggcatggaaaaaggggagggagtccctcactgtcttcagtccctgaggagttctttcacctcctctgaatgtccacgtgagctccattctattagaattctcattcagaaccttgatcacaggccgggcgcgccgggattgctcacgcctgtaatcccaacactttgggaggccgaggtgggaggatcacttgagcccaggatttggagactagcctgggcaacatagcgagaccccttctctaaaaaagcaaacaggcaaaacttcatgagaatcttgatcatgttaaaattttatgtccttcgatttctccctacacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatggggagggggaaatggggtggcctcagcatctccctaagtcccagcctttaagtcctcctgttgcagttcgtcgcctgcagcttcgagaggagttggatcgatcttcttgtggaaacgtcctcttcaatggttacctgccgccaccaggtaggcactcccaatggaatggaggggcgcggaggtgggccaaagactacatttcccataaggctgcagctctcgggtgcctgtgctgtgcgtcctgagatacagtgggaggtgtagttccctatcagatgcttgggctgatgcttggaaaggaagktggacacagcatttcccatgagacaatgggccagctaactcttgaggctcagaaggatgtcctggagccccatgggagttgtagtccgggtttggtttctttgtagggggggctttggaagacctgggattcttcgtatggaggggagaaatattaataggaagttattgacagtaatgcccatgatagccagcccactggccatggaaggtatgccccagtggttattggaactaggcttttctgattggtagaagkaacagagtagggaaatttcatctacagctttatttccctaactgcagtcagcacctgctaccttcatgaaagttgccagatataaagatctgtagtagtacttttccaacttagttttatcctgttttccgaaaaacaatcatttatttatttatttatttatttaattttatgagacagggtctggctttgtcacccaggctggagtgcagtggtgcgatcttggctcactgcaacctctgcctctcagattcaagccatccttccacctcagctctgccactgagtagctgagactacaagcactcgccaccatgcccggctaattaaaaaaataataatcattttaaatgcaagctttatattataaatacaaagtaaacatgaaaataaaacccaaacatagcagtgttattaaactctggcctgtagcagtggctcacacctgtaatcctagcagtttggaggccgagacaggtggattacttgagacctggagtttgagaccagcccaggtgacacagcaagacctcatctctactaaaaataaaaaaaaattagccaggtgtggtggtatgcacctgtggtcccagctacttaggatgctggagtgcgaggatcgcttgagcccaggaggtcaaggctgcagtgaactatgatcactcattacaccccagcctgggtgacagagcgagatgctgtctcaaaacaaaacaaaacgaaaaacaactctggctagatgctattgcttgccaagggtgcagtcttccatttattaaaagtgaaaattagggccaggcacattggctcatgcctgtaatcccagcactttgggaggctgaggtgggtggatcacctgaggtcaggagttcgagaccagcctggccaacatggtgaaaccttatctctgccaaaaatataaaagattagccatgtgtcgtggtgggtgcttgtaatctcagctacttgggaggctgaggcaggagaatcacttgaacccaggaggcagaggttgcagtgagccaagattgtgccattgcactccagcctgtgcaacgagcgaaactccaactcaaaaaaaaaaaaaaaaaaaaaaacggaaaattaggtaatactgcagattcattaatatcacagcagcactaaactcrgtcttcctctgtgctgggctcaagggaactgaaagggaagtaacttgctatgtggttcagtgtcatttcatgctgtgtcactgcaccacttaaaatcttcacccggagactatgtcccacacatggggaaatcaatcaccgtcatattttaagtgcttgctgtgtgacagccacgattacaatgactgttactctacctcttattctcactgtagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggtacgtttctatctcgtggaaggttggrgcagctgtggggtccctgtgaccctcttctgatccctactcttcccctcaaggacaacctgaggagccggggatggtgcgcctggtgtgtggacaccataattggatcgctgtggcctatacccagtttctagtctgctacaggtgcttggggagggagtggcaggaggtcccagccctgttgatgggaagggcatgcggtgagggttggtgatgtcccctcgatcctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggtatgaccccaagccttttccagaaccctctgtcctttaaattctactgcctgttaaaatgacccaccccataaaatcctcaaacccataagaattctctgctctattagatctgtttgtgtcattagaatgctccagcccttcagaattctgtatcctgttagaattccctggcttcctagaaaaatccacccacatacaattctccctccatcagaattccctgccctgttagatctcttggttttgttagaatgcgctattctgtgtggccatgagaaatgtctgacttggcccggtgcggtggctcatgcttgtaatcccagcactttgggaggctgaggcgggcagatcacttgaggtcaggagttcgagacccccttggccaacagggtgaaacccagtctttatttcaaaaatacaaaaaaattagctgggtgtggtggcacgtgcctgtaatcccagctactcaggaggttaaggcaggagaatcactggaacctgggaggcagatgttgcagtgagctgagatcgcaccactgcattccagcctgagcgacagagtggacagagtgagacaccatctcaaaaaaaaaaaaaaaacaaaaaaagaaatctctgacttatggctgggcacagtaactcacatctgtagttccagcactttgggaggccatggcaggaggattgcttgaggccaggagttcgaggctgccgtgagctatgtaagccatgattgcaccactgcactccagcctggacaacagagcaagaccctgtctcaaagccacagcaacaaatctcggacttattaatctgtccccaaataaatctcagccctcgtaagaatcccctgccaccagtggaggtttttttgccttattgcaaatctcagtgctgttagaattccagaccgttttagaatcccataccccatcagaaatcttctggcccattttatcttctctaattcctgctggaatcttcactttttttttttttgaaatggagtcattctctgttgcccagattggagtacagtggtatgatctcggctcactgcaacctctgcctcctggggtcacgcaattctccttcctcaacctcccaagtagctggggctacagttgtgtgctaccacactcagctaatttttatattttttagtagagatggagtttcatcatgttggccaggctggtctcaaactcctggcctcaaatgatccgcccacctgagcctctcaaagtgttgggattacaggtgtgagccactgtgcccagcccctgatggaatcttctatccttcaaggattctgtggtcccactgaaccctctggtccttggagttcttcctcccacctctcctcctccatgaggcagggttccagctgagccctttttgcccactgcaggggtctttcatctgggggtgcctgtggaggccttgttcttcgtcgggaaccagctcattgctacaagccacacagggcgcatcggggtgtggaatgccgtcaccaagcactggcaggtcagagttctggccagcctggctgcccccttcccagttttccagactgtacagacccaggaaggggttcacgtctgcccccacccccaccccctaagcctggaggaagccagagaaccagcagctggccagagcctggggatgtctgtgataaaggcctaaggagcaccagggaagccttcctggaggaggtgctgcagagcccacatgaagcatgaatgggtttgaaaaggagtagggaggattgtcttgggactgggtgagagagcaggttaggggggatgctgtagaagacaagaactggcttggctcggtggctcacacttgtaatcccagcactttgggaggctgaggtgggaggatggctttgggagaaagacagacagaggcagagaaagagacagagaggcagaaaaccaggcaaatagaaatagaaaatcagaaagaggtgacagagaagggtagacagagtcaaaccagactgaaccactgtggcagatgggggaactcagagagataaatggagatgaattagagtcatgtcagaagtacatagtggaggccgggtgcagtgactcccgcccgtaatcccagcactttgggaggccgaggcaagaggatggcttgagcccaggagtttgacgccagcctgggaaacataataagactctgtctctacaaaaaatttaaaaaattaaaactttaaaaagtacagagtccaggagaggccaagagtcagacagacagatgcatcaaagggaggaagggagggaacaagacagggacaaaggcaggcctggggtggacggggctggggagcagtgggtgggttctggaggtggaggagagggcccatcctctgtgaggggtcaccacggaaggaaaggaatggaagggctccyggctgcagcctgtcctgccccacccccaggtccaggaggtgcagcccatcaccagttatgacgcggcaggctccttcctcctcctgggctgcaacaacggctccatttactacgtsggtgagcagcagcctgtgtcccgggtgcccgagaccctcccctgggagaggggaagggagggagagaggctggggcacttggaacaaacccgctccaccctccctgcccaccccagatgtgcagaagttccccttgcgcatgaaagacaacgacctccttgtcagcgagctctatcgggacccagcggaggatggggtcaccgccctcagtgtctacctcacccccaagaccagtaagctatgacccggcttcccctgctgctgtcacctgccagccccagccccagcctgcagctgtcccccaacttgtgtagcatgacccagaggggtttatcgaggggcggcagattcaactctctctcatttttttttctgagacagastctcattctgttgcccaggctggagtgcagtggtgcaatcttggctcactgcaacctccacctcctgagttcaagcgattctcctgcctcagcctcccaagtagctaggattacaggcgcccactgccacgcctggctaatttttgtagttttagtagagatggggtttcaccatgttggccaggctggtcttgaactcctgacctcagatgatcctcccgcctcagccccccaaagtactgggattacagacgtgagccaccgcgcccagccagattcaactctcatccagtcattcaacaaatatttactgagtatccctgtatataagcacgttctaggtgctagatggtggccaccctctccactaggggcagaatggaccattaggagttaatctttgtgtttctttcccacctttgtgattaaggcatgatgttcacatgttcataaaacaacacagatgcaggttttacagcagatgaasctgagttctcttacttgagacagttttttgttttgttttcttgacatcaaatgcagaatgggttaatttttgagacgtaattctcataccataaaatttcccatttgaacgtgcacaattcagcggattttagtatattcacaaggttgtacaactatcaccatgaacaaattccagagtatgttcatcacccccgtaagaaaccccctgatctttagcagtaactccacatttctcacttctgataccctctagaaatcactaatatgctttctctttttgtttgagacaaggtctcgctctgctgcccaggctggagtgcagtggcatgatctcagctcactgcaatctctgcctcttgggttcaagcgattctcatgcctcagcttcctgagtaggggaggattacaggtgtgcatcaccatgcctggctaatttttctactttaagtagagactgggttacgccacgttggccaggctcaatatgcttcctatacctatggatttgcctgttctggacaattcctgtaaatgggatcatacattatatggtcttttgtgtctgcatttttcacttagcatatttttttaaatggttagtgttttctgggtcttaagatatccttacctattctaggttacaaagatcttctcctgaatttcttctagaagatttacagtttagtttttacatggaagtctgttctatcagaaattaaattttatgtatggtgtgaagcagggattattcttttttaaaaaaaaatagagacagggtcttgctctgttgcccaggctagagtgcagtggcatgatgtsagttctctgccacctccgccactcgggctcaagcgattcttctacctcaacctcctgaacagcrgaaccacaggcatgcatcaccacacctgtctaatttttgtatttttttgtagagacagggttttgccatgttgcccaggctactcttgaactcctgggctcaagtgatcctcacactttggcctccaaagtgctggaaatacagacttgwgtcactgtgcttggccatagctgctgctgctgcttttcttttttttttaaagcagaaataagttaataatacacctaacttcatgacacattatcacctttcttctttgtaaggcccttttcttatttcttttttttctttctttctttttttttttttttgtcttttcctgagacagagtatcgctctgtcattcaacccaggctggagtgcaatggcgcaatctcagctcactacaacctctgcctcctgggttcaagcaattctccagactcagcctcccaagtagctgggattacgggtgcctgccaccatgcccagctaatttttgtgtttttagtagaggcagggttttgccacgttggctaagcaagttttgaactcctgggattctcctctcgtcgtctcccaaagtgctggaattacaggcatgggctgctgcacccggcctctttcttatttcacttacttactcatttcctcctcatctcccttcccgccacatgccactattatgtcatttttstttgttttttgagacagtctcgcttcgtcacctaggctggagtgcagtggcgcaatcatagctcactgcagcctcaccccctgggctcaagtgatcctcctacttcagcctcttgagtagctgggatcataggtgaatgccatcacacccaactagttttttaaaaatcttttgtagagatgagggtctcactatgttgcccaggctggcctcaaacgcctggcctcaagcaatcttcctgcctcggcctctgttctctgttttactttctctttcctctcttatttgctgtttcactgttacaatttctgtctctgggcctctcctcctttgacctgtgcctttgtctccctgttcctccatttcccacatctcatcaccatctttttgtgtccttccctctctccttgctttctgactgtgtctctgttctgtgtctctttctttctttctttctttttttttttttgagacagagtcacattctgtcatgcaggctggagtgcagtggcgtggtcttggctcattgcaacctctgcctcctgggttcaagcaattctcatgcctcagccttctgagtagctgggattacaggtgcgtactaccaccaccagctaatttttgtatttttastagagacagggtttcagcacgttggccaggctggtcttgaacgcctgacctcaagcgatccacccgcctcagcttcccaaagtgatgggattacggcgtgagccaccgtgcccggcctctccttgctttctgactgtgtctctgttctgtgcctgtttctttctccctgccctggtttctgtctctgtggcccaggccctctcctcatccttggcccctcaccaggtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcaggtgascctctgtggggtgctccagtgctgggagagasagctcagatgggagtgtggagacaggaggatgagaatttccactggggagggacattgtgtaggaagagagctctggcggagaggattgacctgggatgggactgtaattgcagaagtgagagaataccataggggatcagtctggggaagagtgaatctgtgtgtgtttgggaatccatcaattcagcaacgatttacggggcacccaccatgtgccaggcataggggatacagtgatgaacaagacaggccaagtccctgccctcgtggagctgacattctagcagsgatggcagacaataaatctataaaaatggacatcaatggccagctgcggtggctcacacctataatcccagaactttgggaggccaaggcgggtagattacttgaggtcaggagttcgagaccagcctggccaacatggtgaaaccccacctctaccaaaaatataaaaaattagccaggtgtggtggcacgtgcctgtaatccccgctactcgggaggccgagggaggagaattgcttgaacctgggaggcggagattgcagagagcccagatcatgctactgcactccagcctaggcaacagagcgagactccatctcaaaaataaatagataaaaatgcaaatcaggctgggcactgtggctcatgcctataatcccagcactttgggaggccaaggtgggaggattgcttgaggctaggagtgtgagaccaacctggacaacaaagtgagacattgtttctacaaaaaatttttaaaaaattagccaagtatggtggcatgcacctggggtcccagcttcttgggaggctgaggtggagggatcacttgagcccaagagtcaggggctgcaatcagctatgattgcacccctgcactccagcccaggcaacaaagcaagactctatctcataaaatattaataaaataatctaaatcaacaccaggcaatgataagggctatgaataaacatgaagctgtgtgtggctagagagtgtcaagtcgctggagaggggtcattcagggaaggcctgaggaaggacctttgagcagaaataacagaatgagcagtgcagattggtagggacaagcattcaggccgagggaacaggcattgcaaaggctctgaggtgagaggatgcctgaggaagtgcagggagccacttgtgcctggaacagagtaaatgagggggagaatgggaggagatgagggtatggaggtgacaagggcaggagccacagagggctccgagcaggggagggacatgactagcttcaggtgttcacaggctccacctggctgcccgtgggagcacactactgggataggacaggagcagggacctctgggaggggcgtgctgatacggtccaggcaggtgacgaaatggaccaggaccggtgtggggcagaggatagggcaaggtgagatcaggctctggaacagttttggaggcagaggcaacagggtttttaacatttggaattctggggaggaaaggattctctgaaagggaagaactcagcaagggctgaccctcctgaaacggggctgtcctgaggctctggacgggcaggcagcattgatgcctgcaccaggcctgacttcctgctctccttgtgcccctcagtctgtgccgacaacaaccacgtgcggacatggtctgtgactcgcttccgcggcatgatttccacccagccyggctccaccccactcgcttcctttaagatcctggctctggagtcggcagatgggcatggcggctgcagtgctggcaatgacattggtgcctactggctcctggccttcccaccccactgacccccttacctgacccctgttgacctccgctgattcccacttgcrgccacctgacccaggagcctgcaacgattggggtgtcctgatccttgaggcacctgagctccactgactgccncaaccccccagccctctctggccctgcccaactctaacaacctggggatgggactggggtcttggggtggtgggtttcatcagtggggaaggaagtctgaggctgagggaatcccagctggccctgacccctgcccctgcctggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtcccagccaaggagcattgaaggagcaaaggctgggagggaggacaggcctggtaggtttgtcttctggtatcaaaggtgtgacaggtgttggtgggastgacctggcgcagtgccagcccagtgcaggcagggccaggttgaaggcacagggggtggggtcagggtgggatggggggcccaggcggagggggaggggtgggatgggggcccagggggagaggtcggggtgggatggggggaccrgggggaggggttggggtgggatagggggaccaggggcaggggtcgggatgggatggaggagacccagggagctgtaggagccttgcttcagctgggaaaggggcctcggaggatgttctggatgaagggactctgagcagagacctagaggacaagtaggaaggagcagaagaaagaaggcaggggaagggggccccagcctgagggaactgtatgtgcagaggctgagaagggccaaatagggtcacatgggaaggacacgtgggctcctgggctggagcacagaacaggaggtgaggatggggtgcagatgcgggcgggccttgtcaggctgtggaagggctgaggctttgtcctgtgcggggagccgtggccactgcangggggatgaaaggaggcttgatgggaggccaggagcccagggaggaggccaggaggctgataggaggtgggggagcagctgggacgggcctcaggtcttccctgcagtgggagcagggaagagcagaagctctgggagactccctgggtgtttggggctgcggtgtccaagagctgctggacccttgggactggaactcaaaagcaggctagggatggataaagattgggatggcccctggagaggcaggaactgcagccacagtggtggggactgggacgaggaagggtgagaaagcgagggtgaccacctcccccactgcaccccccagggtgtgctccgtgcgctcygtggacggctcacccacgacngccttcacagtgctggagtgcgagggctcccggcggctcggctctcggccccggcgctacctgctcactggccaggccaacggcagcttggccatgtgggacctaaccaccgccatggacggcctcggccaggcccctggtactccctgccccaccccaatcccgtcccaagccccacagcctcacccagaaccactctccactgccaactgcttgatctctctcccaggcccttgccctctgaccccttttcctttgaccccctctctgctccccatcccttcctgcccttgtttttcaacccctgtctcagcctctggcccccatgcattgatctctgcttcctctctcctgtcctgaccctcggtgcttgcactgcaatgcaacccaggcccttgccctatgacccctgtcttgccccctgaccctgcttccgtgccccccagcaggtggcctgacggagcaagagctgatggaacagctggaacactgtgagctggccccgccggctccttcagctccctcatggggctgtctccccagcccctcaccccgcatctccctcaccaggtagccacaactccactgccccttctgtgcaatgaggggagaggggacagcatggtgttcccggggacagagtggcccagctgccccgtgatgacgtgcacttactgtccttacttcctcagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccmcccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttytggaagccaaagtcascctccccaataaagtcctcactgccaacatcttgcttattcttagcaggtttgggactccccaggaaaggggtggggaagatgtgggacccaacccgatatatgcaaaatcaggaacatctacctctcttgtttaagcaaagggaggccaggcatggtggctcacatctataatcctggcactttgggaggccagtttgcttgtgctcagaagtttcagactagcctgggcaacataacaaaaccccatctctacaaaaaaatacaaaaattaagcaggcatggtggtgcatgcctgtggtcccagcttcttgggaggctgaggtgggaggatcgcttgagcctaggaggccaaggctacagtgagccatgatcacaccactgcactccagcctgagtgacagagtgagatcctgtctcaaaaacaaaacaaaacaaaaaaggtgttgcaggggaggaatgtgttggcttttactctgccttcaggcatggctggatccggggcttcaaacactaattcagaatatctttttttcttttttcttttcttttttaaagtctcactctgtcatccaggctggagtgtagtggtatgatctcagctcactgcaacctccacctcccgggttcaagcaatcgcaatcctcctgcatcagcctcccgagtagctgggattacaggtgtgcaccaccatgcccagctaatttttttatttttagtagagacagagtttcaccatattggccaggctggtctcgaactcctgacctcaggtgatctgcccacctcagcctcccaaagtgctgggattacaggcgagagccactgtgtccggcccagaatatctttttatctcctaacttcacttacctctggaatacatcttcaatcaggttttctctctgtggcaaggtgactctaagcagctgcttagcaactctttcttccctagcaacagcaaaaatcacaagactgattttcattggcttgaattaagtcaggtggccattcctgaaccaattactgtggccagtgtgatgaaggccttccattattgcagcctggatcatgtgtcctgctgtatttttagtagaggcagggtttcaccatgttggccaggctggtctcaaactcctgacctcagatgatccacctaactcggcctcccagagtgctgggattacaggcgtgagccacctttcctggctggccttgggattttttttccccaaataatgcccgttcctacggcacttccttgaggagattttctgcatcttttttccttgtgccaataaaaaagggacagaaagtggggacagactaggagtagagaatactagaacatgctaattctagaattccatagtttctggaatgccagagcttctgaaacatagtagagaggggtctcgaacattaggacatctcggacacaaggatattctggagtgctcatggattaacaatattagagttctcccctgcttatcagagaatccagaatatagaagtttctgacaaaaaggacctgaaaaatcactgattctagaataggggagtgtcaaggggagttcatacccatgaatctccaccggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaaggtgagtgcctctgaaaccggggtgttctgaaatagctgtgcacctcaaaccctaattttgtttttgtttgtttgtttttgagacagggtcttgctttgttgcccgggctagggtgcagtggtgcaatcatggctcactgcagcctcggccttctgggctcaagtgatcctcctgcctcagcctcctgagtatttgggactacaggtgtgtgccaccacagccagctactttttaagtttttttgtagagacattgtctcactatgttgcccaggctggtctcaaactcctgggctcaagccattctcctgccttagcctcccaaagtgctgggattacaggtgtgagctaccatgcccagcctcacactctagaaaattttttacatgccaggatattcagaatattgggggatattggcatgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttcttttttttgagacagggtctttctctgttgcccgggttggagtgcagtggtgtgatctcagctcacctcaacctctgcctcccgggttcaagtgatcctcccaccttagcctcttgagtagccgggattacaggcgtgcgccaccatgcctggataatttttgtattcttagtagagacagggtttcactgtgttggccaggctggcctgaaactcctgacctcaagtgatctgccctcccacctcggcctcccaaagtgctgggattacagacgtgagccggccttattctgggggagggggtggggggggagagagagagagggagagagagaggagaatttgggatgttagcaaatctagaacactgaagagctgggttttttaaatgctagagatagtattatcctagtatagtattaactctgtgtgtttttgtgcgtgagagggcatggggggaggggtggaagattctggaatgcggggggactagaactctgagggattctgaagggttgagatgagttaggattcaagaggtgacatagacacgatcctgggagatagtgacactgatgggagggatggggagctggggactccaaattctagggggaggggaggctaacgccggaagttgcagtggtgagccagaggatgttgcctagcaacaagcattgaagatgcgctggatcccggacagaagggagaaatttcagcagcgcccccagcaaatgctccagccacagggtaggaggtggtgaggggggaagcgggtagggatatgctgtcctgcagggtcatgtgagcaggggtcttgggggttatacaaaaacagggtcatggagtacagtcatggggcagagccgggctctgggacagcccacgaatagctgtgaatggagtgtgagtgccgtcgtcacctgccccagggactgtgtgtccctggacggtgctggacccagatttctgggtgtcagtgtgggatggaggcatggattgctgtaggtggcagtaatggtgtgtagccgtgtgagtcagcctgtgtgtctcacagtgagcgggggtgaagggcttccccgtcagtcctgcacaccctcctggattggaagaaggagcaggagtggggggtggggggtgcaactggatcagttgccattcttggtctggggtgggctctgtggtcacggcgtgtggcctagtaccctgtgtgggtggagcctgggatccacgaggtgggggcggggctaacgctacagaactgggaagcttaagaatccaactgctttgggatatggggcctggaaccccaaagcgaagcaaacatgaaaggggtgggcttgggatcctacatgtggtcacgtcccagttttctgtgggaaagggtgtggcctgaaactctggaaaaagaggtgattaggggcagagtgaagctctgagggtggtgccttagggagagaaggggcttgtatttcagagaatatagggtggagccttgaatttataatgatcttctcaaagaattgatcccttctcaaggccctaggcttcaggggttccaggctcaccatctgcaaaagcttgctccccgaagctctgtccctcagtgaacccagccaggctctgcccctgacccacaggatctgctcccaggggggtcctgggggctcctggctctgccccctcctgcacctcacttattgccatccccagagggtatcagacccccttccttgcctgagtctttgaatgctcccaagagctttgagtctcaagctgggcttgagaccctgagtttgaaggcttgaagcctggaaccccggtgtggacggggtttaagggcccctgtggcttgcagctcctagtggtggagactcttaggcaaggaagggatcggtactctcttttatatagttttatgtatttatttattattgagatagggtctcactctatcgtccaggctggagtgcagtgcagtgcagtggtgccatctcaactcactgcagcctccacttaccaggctcaagtgatcctcctacctcatcctcccgagtagctgggactactggctcatgccaccatacccggctaatttttggatttttttttttttttttttttttttttttttttgagacagagtcttgctctgtcgcccaggctagagtgcagtggtgtgatcttggctcactgcaacctccacctcctgggttcaaacgattctcctgcctcagcctcccgagtcgctgggattacaggcgcccaccactgcacccagctaatttttgtattttttagtagagatggggtttcaccatcttggccaggctggtctcgaactcctgacctcatgatccacccgcctcggcctcccaaagtgctgggattacaggcatgagccaccgcgcccggcctaatttttggatttttaatagagatggggtcctatgttgtactatgttgctcaggctcacctcaaactcctggactcaagcgatccacctcggccttccaaagtgctgggattacaggcccgcgccagggcacctagccggaactgggaactctctaaggagaaagtctgcaattctgggtggtgggaggctgctcttgggagcattcaaagactcaggcaaggaagggggtctgataccctctgggggcggcgataagtggggtgcaggagggggcagagccaggagcaccctgggagcagagtttgtggatcaggggcagagcctggctgggttcactgagggacagagcttcggggagcaagcttttgcagatggtgagcctggaatccctgaagcccagggtcttgagaagagatcaattctttgagaagatccaatgtgaacttgggaccctcagaggggcaggacctgggggctggtgcagggttggtgctccatttgcagaatcctcagtctctctcgtggaaaggggtacccgtggggggcttccagcttctacgccagcgagggagctaaattctgaccgaattctcccagaactgggagcagagagctgaggactgccagatggagtccagcttaggggaccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttg

SEQ ID NO: 10832 - DNA, 59247 bp, Homo sapiens
tcccacaccacagataactcctacacataatgtgtatcatgggaaaatacatgcagtaggaatttgctgtacaggaagcttaaaaaccagcaaaactaactgaggtttgttttggggagatatagatatacttattgcacaaatctttgaaggaatacaaaggaatacgtatcagaagactcaggatggagtctcctgccgagaccagctcggtcaggaagaccctaacccagtggtgctagaggacttaaagacacacacacagaaatatagaggtgtgaagtgggaaatcgggggtctcacagtcttcagagctgagagccccaaacagatatttacccacatatttattaacagcaaaccggtcattagtgttgtttctataggtattaaattaactaaaagtatcccttataggaagcaaagggatgggccgaattaaaggaataggttgggctagttaactgcagcaggaacacacccttaagacacagatcgctcatgctattgtttgtggcttaagaatgcctttaagcggttttccgccctgggcaggccaggtgttcctttccctcattcttgtaaacccgcaaccttccagcttggacattagggccattatgaacatgttacggtgctgcagagattttgtttatggccagtcttggggccagtttatggccagattttgggggacttgctcccaacggtctccttctagggggtgactgggtagcagcccagggtagctttacaggcttgtgttttacaccagtgctgggcaccctcgtagatacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagccatgtgacagagaggaccaggatgccatgaaaatggcattggctacaaataggtcatttgatccttggctccctggcatctctctagattttcaatgatacaatgttcaatctgctgtgcaagataatttcatcttccaaagatttgatgttacattttaccacacattaaactgaaataaacttttacagattggaaatgcacatcattgatcaaaataaatgaaacatgaaaagagtagggaggaatacccagtgatggaatagcaaatatgaatggaaaacagaataggactgctaaaaagaaaaaaaaattcagaagcatgtaatagcagcgctatttagaatcatagtggtgtccaaatcacttctatcacatctcattcaataccacaacaaaagatgttaagtttattatagaatgcccatcaaatagccagtttttgaaaaaaacttgtttctcaattagaactaaccatttcgggctacagcatcaagccaaaattattggcatcatgctaataatttttactaaagtaaaataaagttgactgaagtatgagattcacatttttgtaaatgaaaagcaatttgattaggcatttttttctgcacagcaaaagaaactatcatcaatcacagtgaacagacatcctacagaatgggagaaaaattttgcagtctatccatctgacaaaagtctagtattcagaatccacaaagaacttaagcaaatttacatgaaaaaaaaacttcattaaaaagtagacaaagaacttgaacagacacttctaaagaagacatacatgtggccaacaaaaatatgaaaaaaagctcaacatcgctgatcattagagaaatgcaaatcaaaaccacaaatgagataccacctcatgtcagtcagaatggcaattattaaaaagtcaagaaacaacagatgctggcgaggttgcagagaaataggaatgcttttacactgttggtggaaaagtaaatggttaatccattgtggaagacagtgacagtgtggtgattcctcagagatttagaatcagaaataccatttgatccagcaatcgcattacagggtatatacccaaaggaatacaaatcattctattataaagatatatgcatgtttacattcatggcagcactattcacaatagcaaacacatggaatcaacccaaatgcccatcaatgatgaactggataaagaaaatgtggtacatatacaccatggaatattatgcagccataaaaaggaatgagatcaagtcctttgcagggatatggatgaagctggaagccattatcctcagcaaactcacacaggaacggaaaaccaaacaccacatgttctcatttataattgggaactgagtaatgagaacacatggacacagggagaggaacaacacacactggggcctattggggcagggtggtggtgggaggatcattagcaaaaatagctaatgcatgccagggttaatacctaggtgatgagttgacaggtgcagcaaaccaacatggcacatgtttacctatgtaacaaacctgcacatcctgcacgtgtaccctggaacttaaaaaaaattaaattaaaagacaagcttaaagaaaaagacaagctgaaagagttaatgaaaaataattagataaaagaagtctttgattttcaaaaacctgaaacaatagttataattttgcttttaacatatattcaaaacatttgatactgttcccttccagaggtgcatcttaattccctctcctgagtgtggcttggacttaatgaggcacttctgatatggcctggttctgtgttcccacccaaatctcatcttgaattgttatgcgaattgtaatcgctacctattgggggagggaccacatgggaggtgattggataatgggggcggtgcccccatgctgttctcgtgatactgagggaattctcatgagatctgatggttttataaggggcttttccctgcttcattctgcacttctctctcctgtcatcatgtgaagaaggatgtgtttgcttccacttctgtcatgactgtaagtttcctggggcaggctcctcagccatgcagaactgtgagtcaattaaacctctttcctttataaattacccagtctcaggtatttcttcatagcagtgtgagaatggactaatataacttctaacttatagaataatgctgacataatggtttgtaactctgggtgtagaacctaaaactcactgcggcttccaccttctctctctctgtctctgggatcatgagctctgggggaagccagctgctgtgccacaagcagccctgcaggaaggtccatgtggctgagaactgaggccttccgggaccagacaacaaagaactaggccttttccaacagccatgtgactgatccatgtttcatgtgaatcctcagccccagtgaagccctcagatgatgcagcccttggctgacaattggactgcaaccttgtgagaggcccggagcaagaagcactcagggaaacctctcctggactcctgaccattggaaactgtggcagatgaggaatatttgttgttttaagctaagttttacataatttgttatgcaatagtaaataaataacacattttcacaagagaggatgtattattacacattaaattgcatttgctttaaatgtatcatcgtcatcattattatttttgagacatggtctcgctctgtcacccaggctggagtgcagtggcatgatcaccatgcactgcagtgtcgacctcctgggttcaagggacccactgatctcagcctcctgagtagctgggactaccatcatgaactactatgcctggctaattttctaattttttgtatagatgggggttttgcccaggctgatcttgaacttctggagtcaacaaatctgccttcctctgccttccacagtgctaggatggcaggcgtgagccaccatacctggcgtaaattaattataagatattaaacatgtaacttagttttaaaaggtaaggagaatttccatggctgaagaggatgtattttatgaccattcacaatgatcactttacttgaacttcaatttccaactgtgtccgaagtaaacacaaaaggaagatccaacccttgctaggctgattctattatgccctcaacaaccagctcctggtcattcaccatcctccagttattcaatcaactctaatgtaggtgctgctgtgaagggagttagtggatataattaagggtctcaattagttgactttaggctgggtttatcctgcttggactgtcctaatcaggtgagaccttgaaaggactgggttcttcctgagcatagagactcacagtgtgagagggactcagcatgaggggtttcctccagcatgggctttgaaaatgaaagggctgtgggccgggtgcggtgcctcacgcctgtaatcccagcactttgggaggctgaggcgggcggatcatgaggtcaggagatcgagaccatcctggctaacatggtgaaaccctgtctctactaagaatacaaaaaaaaaaaaaaaaattagccaagcgtagtggcgggtgcctgtagtcccagctgcttgggaggctgagacaggagaatggcgtgaacctgggagccatagctggcagtgagccgagatccggccactgcacccaagcctgggctacagagcaagactccatctccaaaaaataaataaataaaataaaaaatgaaggggctgtgtaggaaagaatgctggtgaggaccaggaatcgagcacagccctccctgttctctacattgacagccagcaaggaacagggacctcagtcttacaactgccagaaactgcattctgccacctctgtataagcctgaaggaggattcaaaatgaaaacacagcttttggaagcccagaagagagattccatccacaattttgcccagatttctgatcaaggaactataagcagataaatgggtgttgtttcgccaggcatggtagtgcacgaatgaattgatgaattgatatgcacactagttacataaaataaaaattttctgaactttttccgtgttttgcactttataattatctgtaatgcaatttaatacactcatatttcattcattcagtcgacaaaaattaatttagtccctacgataaaccagatatcccctcatatgctcacgtgcctgacactccagaagtttctcaagaccgaggtggagacactggagtgttttaagtggagagatgacacactccgactcccaggagcaggaccactgtgaaaagaacagtcacgtaacaggtcatgggacagtgctagtgtcacaactcacaagtgacagtgtggtggggactaaggggacaggagggcctgaaggatgaaaaggacggagagaagggctggagaagcaggaggtgaagaaaaggagcagaggaaagaattcgaaagcagcagaattcttaggtttaaatacattgttttatggattttaatacatccatctacagagcctagcagggtgtccttggcagttggcctttaatacctcatgtgggtctgcctaaaaactaattttttaatgttaatcaggtttaaaaattactaagtgttcctataaaatatacacaacacttagcagtggatacttcctaaaaacaggcagtgcatgagcactagtgaggggcattgtgactacattgaacagttgcaactttgaggtgaataaagcctgtactgactcctggttgcaacgtacctggttgcaaagtacacagtgtgctactttgtattgaggagatatcctggactcacacagaaactcagagctatggaatgatggcaaatttaaaatatgacaagcgggagtcacaggtacactgcaaaagtgaaacttagaagctttgtgagtcctgttgtaacgcttttgggcacatttatacatcatggggccaaagtcacattttttaccgattagattcctgatcattcaggggttaccaaggttctgctatccaatgtatttaataaacaaataaataaataaactggtctctattctgtctcatgcactcaggcacaacttttcccaataaaaaaaaaaaaaaaaaggaaaacaaaaaacagtttctacacctccattcccagagcaagctcactctctgtcaccaaactccgtgggtgrcttttcttctagaagagtccaggtggacagggagtccagttcagggacggagattcctggatgaaaagtgaagggagagggacagggcccatgccgagggtttcttcctggtttctcagacagctcctgggccaagactcagggaaacactgagacagagcgcttggcacaggaggagcggggtcagggcgaagtcccagggccccaggcgtggctctcagggtctcaggccccgaaggcggtgtatggattggggaggccccgccttggggattcgccacctccgcagtttctcttcttctcacaacctgcgacgggtcctttttcctggatactcasgaagcgggcacagttctcattcccactaggtgtcgggtttctagagaagccaatcggtgccgccgcggtcccggttctaaagtccccacgcacccaccgggactcagattctccccagacgccgaggatggtgctcatggcgccccgaaccctcctcctgctgctctcaggggccctggccctgacccagacctgggcgcgtgagtgcagggtctgcagggaaatggtcgggaggagcgaggggcccgcccggcgggggcgcaggacccagggagccgcgcagggaggagggtcgggcgggtctcagctcctcctcgctcccaggctcccactccatgaggtatttctacaccaccatgtcccggcccggccgcggggagccccgcttcatctccgtcggctacgtggacgatacgcagttcgtgcggttcgacagcgacgccgcgagccagaggatggagccgcgggcgccgtggatggagcgggaggggccggagtattgggaccggaacacacagatctgcaaggcccaggcacagactgaacgagagaacctgcggatcgcgctccgctactacaaccagagcgagggcggtgagtgaccccggcccggggcgcaggtcacgacccctccccatcccccacggagggccgggtcgcctcgagtctctgggtccgagatcctccccgaaaccgcgggaccccgagacccttgacctgggagaggcccaggcgcctttacccggtttcattttcagtttaggccaaaatccccgcgggttggtcggggcagggcggggctcgggggaccgggctgaccgcgggggcggggccaggttctcacaccatgcaggtgatgtatggctgcgacgtggggcccgacgggcgcttcctccgcgggtatgaacagcacgcctacgacggcaaggattacatcgctctgaacgaggacctgcgctcctggaccgcggcggacatggcagctcagatcaccaagcgcaagtgggaggcggcccgtcgggcggagcagctgagagcctacctggagggcgagttcgtggagtggctccgcagatacctggagaacgggaaggagacgctgcagcgcgcgggtaccaggggccacagggcgcctcccggatggcctgtagatctccggggctggcctcccacaagaaagggagacaaatgggaccaacactataatatcgccctccctctggtcctgagggagaagaatcctcctgggtttccagagagtgactctgagggtccgccgtgctctctgacacaattaagggatgaaatctctgaggaaatgaagggaagacaatccctggaatactgatgagtggttcyctttgacactggcagcagccttgggccccgtgacttttcctctcaggccttgttctctgcttcacactcaatgtgystgggggtctgagtccagctcttctgagtccctcagcctccactcaggtcaggaccagaagtcgctgttccctcctcagggactagarttttccacggaataggagattatcccaggtgcctgtgtccaggctgttgtctgggttctgtgctcccttccccaccccaggcgtcctgtccattctcaagatggccacatgcgtgctggtggagtgtcccatgacagatgcaaaatgcctgaattttctgactcttcccgtcagacccccccaagacacatatgacccacyaccccatctctgaccatgaggccaccctgaggtgctgggccctgggcttctaccctgcggagatcacactgacctggcagcgggatggggaggaccagacccacacacggagctcgtggagaccaggcctgcaggggatggaaccttccagaagtgggcggctgtggtggtgccttctggagaggagcagagatacacctgccatgtgcagcatgagggtctgccagagcccctcaccctgagatggggtaaggagggagatgggggtgtcatgtcccttagggaaagccggagcctctctggagagctttagcagggtcagggtccctcaccttccccccttttcccagagccatcttcccagcccaccatccccatcgtgggcatcgttgctggcctggttctacttgtagctgtggtcactggagctgtggtcgctgctgtaatgtggaggaagaagagctcaggtaaggaaggggtgaggagtgtggtctgagatttcttgtctcactgagagttccaagccccaggtagaagtgccctgcctggttactgggaagcaccatccacactcatgggcctacccagcctgggccctgtgtgccagcacttactcttttgtaaagcacctgttacaatgagggacagatttatcaccttgatgactgtggtgatgggacctgatcccagcagtcacaagtcacaggggaaggtccccgaggacagacctcagaagggcggttggtccaggacccacatctgctttcctcatgtttcctgatcccgccctgggtctgcagttgcacatttctggaaacttctctggggtccaagacttggaggttcctctaggaccttatggccctggcttctttctggcatctcacaggacattttcttcccacagatagaaaaggagggagctactctcaggctgcaagtaagtatgaaggaggctgatccctgaaatcctttggatattgtgtttgggagcccatgggggagctcacccaccccacaattcttcctctagccacatctactgtgggatctgaccaggtcctgtttttattctactccaggcggcaacagtgcccagggctctgatgtgtctctcacrgcgtgaaaggtgagaccttggggggcctgatgtgtggggggtgttgggggggaacagtggacacagctgtgctatggggttctttgaatttgatgttttgagcatgcgatgggctgccaaagtgtcatccattactgggacagatatgaatttgttcatgaatattttttctatagtgtgagacagctgccttgtgtgggactgagaggcaagatttgttcacaccttccctttgtgacttgaagaaccctgactttctgcaaaggcacctgaatgtgtctgtgttcctgtaggcataatgtgtggaggaggggagaccaacccaccctcatgtccaccatgaccctcttccccacgctgatctgtgttccctccccaatcatctttcctgttccagagaggcggggctgagatgtctccatctttttctcaactttatgtgcactgagctgtaacttcttacttccctcttaaaattagaatctgagtaaacatttactttttcaaattcttgccatgagaggttgatgacttaattaaaggagaagattcctaaaatttgagagacaaaataaatggaacmcatgagaaccttccagagtccatgtgtttcttgtgctgatttgttgcaggggaggagaatagatggggctgtgcctagtgggtgctcaggccagtatggactttatgtggtcactgctcagctgggtcatctttgctccttcattctccttggcccttcagtagaaccttgtcccaccaccacctgtgatcacagggacttggatgtcacctacggtggtccctgcatacaaatctcattgtggtatcaagagactaattttcagacctgtccagctcttgccctcctcccagggctctttcctggattgtagttttcatcttgtctccaatctttttaaaggaagcagattctgaaatttgcagagaggaggggtcccatagtttctcatcatagtgaactttctgttggagctcctcttctgctctcctactcttcttcctgccctgagttgtagtaatcctagtgctggctccaatccaaactcatggatttacaaagcagagtctaatttagattcatacgtggttggaaaattgtacccataagcctagggttatctttcctgaagagaaaaatatggttgtgtgctgcagtgtgcaggagggttggtgtgggaggaggtagggagggagggaggacacacaagcactcctggtgagaaaagcactggcggcatcgatgtccacatgagatgatgttgttctttagctgccacaaaacagcatttgccctgaggctaccttaacaaagatattggctttagaatagagaagtgctctacagtgatcattcattcaactgacatttgttgtctgctagggatatgactgcttttgcgtttagaaagcatcattaaggtgaaaacagaaaaatttctggtgttgtggtacatatgttctagatgctagcttgtctaacccgtagctcgcaggctgaatgtggcccaggacagttttgaatgtgaggagtttttgcttttctgtggcggacctgagacctggagtgagtgcacccacctccctcaggatcaggagtgaatgctttaggaaccctcctttgcagtgacctgcaaaagatagagggcacggttactgtgagaacccagagtagcagccaaaggggctcaaccttcatggagttttgggaaaggttagtaaaaggtggtgtcccagcgtcagaacagatgggcagccagcgagggcactgcttcatatctatgatgggaatgcaagaattgaggagcaggagactgagggtgtttgatcaaatacaaagtcatgatcccagtctcaattcctagacttcagccaagcttcagattcagaatctacagtggggcttaaggaggccaggaaataaacctggacacattatggcccactgtgggaccactgggttcataaacccagtcctggttatctccccattctccacatgcataattggccttgatgcactggcaaagggagtcacccccacactacatccctagtctggagagtaagggctatcattgtgctgaagcccaaagggaatcatctaaaacttccctcatcccagccaagccagaagcaatattgcgccccaggtgggacttcaggagggtactgcaggtattgtaggggtggcactgccattagagagctgaaggatggggggtggtgttgggattgcctattatctccatataattcagcagtctgtccctgaagaagcctgataaagaatgaatggaattactccagacttgaccaagtaggagtcctgattgcagctgccatgctggctggatatcactgcttggggagattaataaggcctcaggcacatggcaaacagccatgcatttggtgagtgcattctttcccattccatttagaaaatggatatggaatgattcacattcacatgggatttataatacatttattgatagcttgcctcagggctactttaactcctcaaccttctataaatatcaccttaagagatctggacaaatcagacatctcacagaatactaaatctcttcatttcattggcaatatcacatagattgggatggatgagtaagaggaggaaagtacgctgaattctttggcaaaacgtgtgcactacagaaggtgaagattaaccttacagagcttcaagagtggccactgcagtgaagtgttatgggtccagtggttaggggcatgcagggctgtcccctccaaagtaaaagacaaacttgcatcttgcatcctcaacagaaggaaggaagcacactatttggtgagcttctctgggtcctggcaacaccacattccacatctaagtatattgtttggcccactgtctgggtataatataggaagaggtcagctttgagtgcggactagacaggaaaggacactgcagcagatccaggcggtggtgtaccaggtcatcaactctcagtcccctggtgctgggggtgacagcgtggggaaagatgctagatggagctgaaccaagcagctgagatcaagtgagctgagatcccgcccctacactccagcctgagcaacaagagtgaaactccatctcaaaaagaaaaaaaaattaaaaggataagcaccctcccacatcagagataactccccaacacataatatacatgcggtgtgagttctctgtatggggaagttaaaaaaatacaggtcaaactgtgatttgggtattattgtaaaaatcttcagtgacaatgccaaggaatagcaaatacaagactcaagacataggttccttttaggggataggattggacaacagcctagggtggcttcataggttctgtttcttatgccaggaggggatatccaggtagttagttacttgatcataaaactttatttatttatttatttatatattttgagtctcgctcttgttgcccaggctggagtacagtggcatgatctcagttcactgcaacctccgcctcccaggttcaagggattctcctgcctcagcctcctgagcagctgggattgcaggcaaatgccaccactcccagctaatttttgtatttttagtagagacgggcttcaccatgttgaccaggttggtctggaactcctgacctcaggtgatccacccacttcagcctaccaaattgctgagattacaggcatgagccaccactcctggcccacaaatctttaaagtggtatttttcaaaatgcaccttgtgtgccattcctgattgattatttggaaatgaaagagaaaagaaaatgccaaagttcatcacaagcatcctttgcgataactactcgtagtaaaacaaagccgcagctggccgggcacggtggctcacttctgtgatcctagcactttgggaagtcgaggcctgtggatcacgagatcaggagttcgagaccagcctgaccaacatggtgaaacctcgtctttactaaaaatacaaaaattagctgggcgtgttggtgcgtgtctgtaatccaagctactcagaaggctgatgcaggagaatcgcttgaacctggaaggcagaagttgcagtgagctgagatcctgccatcgcactccagcctgggtgacagagccatactccatctcaaaacaaacaaacaaacaaccacaaaaaacaagccacagccaattttaaggagccatgtgagaggaccaggatgccatgaaaaacagccttggctacaaataggtcatttgatccttggctagttggcaactctctacattttctgatacacagtgttcaatctgataggtaaggcaatagtatcttgcaaagaatttgagaatttgatatgttgctcacattttaccacacatacaagtgaattaaacttttacagaatagaaaaaaagcattgttgagcaaaataaattaaatgaaaagacataaatgaataactagtgatgaaatagcaataagaatggaaaacacgaaagagctgcttttaaagcaacattagaagcacaaaataacagtgtttttcagaatcatactggagtccaaatcacttctaccacatctaattaaaaaccacagtgaaagatgttaaactgatcacaggatgcccactgaatagccagttactgaaaaatcttgttcctagattgaatttaaccatttccacctaccacatcaaaccaaatcattgtcatgatgctaagccagttgtacagacaaagatgtgagactcacatttttctaattgcaaagcaccctgattaggcaaatatttttgtagatgcttgagtcagaaaattgtcattttgggcattctttttttttttttttttttttttgccttcaagcatctgtttaacaaagcacatcttgcaccgcccttaatccatttaaccctgagtggacacagcacatgtttcagagagcacggggttgcgggtaaggttatagattaacagcatcccaaggcagaagaatttttcttagtacagaacaaaatggagtctcctatgtctgcttctttctacacagacacagcaacaatctgatttctctgtcttttccccacatttcccccctttctattcgacaaaaccgccatcgtcatcatggccccttctcaatgagctgttgggtacacctcccagacggggtggcggccgggcagaggggctcctcacttcccagacggggtggccgggcagaggcgccccccacctcctggacgaggtggctggccgggcgggggctgccccccacctccctcctggacggggcggctgccgggcagagacactcctcacttcccagacggggtggctgctgggcggaggggctcctcacctctcagacggggcggccggggagagacgctccttacctcccagacggggtggctgctgggcggaggggctcctcacatcccagacagggcggcggggcagaggcgctccccacatctcagatgatgggcggccgggcagagacgctcctcacttcctagaccggatggcggccgggcagaggctgcgatcttggcactttgggaggccaaggcaggcagctgggaggcagaggttgtagcgagccgagatcacgccactgcactccagcctgggcaacattgagcactgagtgagagagactccgtctgcaatcccggcacctcaggaggccaaggctggcagatcactcccagttaggagctggagaccagcctggccaacacagtgaaaccccgtctccaccaaaaaaatacgaaaaccagtcaggcatggtggtgcgcgcctgcaatcccaggcactctgcagactctaaattattcaacgcctcagacactaactttccaaggaataggagattatcccaggtgcctgtggccaggaggtgtctgggttctgtgctcccttccccaccccagatgtcctatccattctcaggatggtcacatgggtgctgctggagtgtcccatgaggaatgcaaagtgcctcaattttcttactcttcccttcagaatcccagaatacatgtgtgatccactaccccatctcggaccatgaggccgccctgaggtgctgggtcccgggcttctaccatgtggaaatcacagtgacccaactgtgggatggggaggaccaaatttaggacgcagagcttgtggggaccagacctgcagggtatagaaccttccagaagtgggcagctgtgatgctgtcttctagagacaagtagagatacacatgccatgtgcagcaggaggcactgccagagcccctcacactgagatgggctaaggagatgaatgaggggccatgtctcttctcagggaaagcaggagcccttctggaggccttcagcagggtcagggctgaggcctgggggtcaggacccctcacgttcccctcctttcttagggccatcttcccagcccacattcctcatcatgggcatcgttaccgtcctggttgttctaggtgctgtggtcactgctgtgatgtggaagaataagaccccaggtaggaaaggggtgagttccaagatttcttcttccattcgtggatttcaagctccagatggaagttggctcatttcctgcctagttgtgagacaccatctccacacacatttaccctgttcagatgccctgtcaactctcactcttttgtaaagcacctgtgaaattgaaggacaaatttatcaccttgattgtgatcatgggaacctgactcccagcagtcacaagtcaggagaatgttcctgctgaggacagatgtcaaaaggacatttggttcagcttcaacacatcctcttccctcgggttttctgatcctgacctgggtctgcagtcacagttctggaaactcctctaggatctcatggccctgcctcttccctggcctctcacagtttgttttctttcctcatatggaaaaggagtcagctatgctcaggcttcaagtaagtgtggtaggggtgggagagtgattcctgagatccttggaatagtgtagacaggagcccatgggggaggtcaccaccccacaattcctcctttagtcacatcacctgtgggctctgaccagactttgtttttgttccaccccaaacaggaacagtacccagggctctgatgtgtctctcaagtcttgtaaaagtgacaccttagagggcctgaagtgaaggaggagttggggcagatgggacacaactaggctctagagagtctttgatttggaatttttcaatgtgtggtgggctgttcagtgtcaccacttaccatgactgacttgaatttgttcacgactattttctttccaagactgccttgtgagggactgagatgcaagatttgttcatggctccactttgagacttcaagggcctctgttttctctttctgccaaggcatctgaatgtgtctatgtccctggtaacatgtgagaagtggagagaccagcccaccctcatgtccaccatgacccctgatattgtttggatctgtgtccccacccaaatctcatgctcacttgtaatccctaatgttggaggtggtgcttggtgggacgtgattggctcatgaggatggatgattcatgaatggtttagaatcatctctttcatgctgttcttgtgatagttcttggaggcattgtgccacctccctagggatctgtggaactttaaacttgagagtgatgattaagggtatctgatggaagaaatttctcagtagcatagaattcaggatttggtctggctgcctgtaatagcctatgtgcatatgtgtgagcaaagaaatgacccgaaactggaactgatatttaaatggggaaatttaatacccaggaaaattcttagcggagctgcagcaacaggacccctgccaggactactaaatggtagagccactggctatgtgcaacctcagcctggaaaagccataggcattcaattttctcccatgacagcagctatatgggttatgttcagcaaagccataaatgtggagctgcaaatggcattaggagcccagcagttgcaccagccactgtgctctggattcaaaatatagagtcaaaggagattcttttagacctttaagttttaatgtctgccatgatgagtttcaatcttatgaggaaactgcattcatttcttttggcccatttatataccttttggaatggaaatgtacaagaaatgtctcttccactgttttattaatattttagatgcaaataacattttttaaaaaaattttacaggctcaaagctataagaatttaccttgcgtctcagatgagactctagaattttgagttgatgctggaacaacctaacacatttgggacaattgggagtagattattatattttgcaatgtgagaagaacatgacctttggctggctagggaggggatgcaatgatataaacatttatcccctgatacctcatgttaaaatctaacgcccactgtgggacttggggcctaatggccaccatttgggtcatggtgaccaatcttttatgaatcgagagatactgccctctctcgggaatgaatgaattgttgctctattattttccaagagagctagttgttaaaaagaccctggcaacttcctactctctgtgttcctctgttaccatgtgatctctgcatataccagctcccctttgtcttctgccatgagtggaagcagcctgaggccctcactaaatgcgcaaacatttccagacatcagaatcttgagccacatgaacctcgtttatataaattagtcagtctcagacatttctttatagcaacacaaaatggaaaaagataaccctcgcatcacaggtatgtgtctctggcagctagccaccgttcttaagatatccaggatccactcagccaagagtcttctcatcagtactctaaagacactcttatcactcaagagagtctaaggtttttaggagaaaccagggacaaagactaaatgtttttgtgataactcagattgcccacttttctttgaccacatatcttttacaggaaaaaggattgtaacagtaaagaggtattggcatattatcagagtctcatccattcattcaaaattaggccagtttatcatcctcttgtatgaatatgtctcccagaatgaaatcactcagctttgctgacaacactcaatcttaccaggttccaaaaacaaggatggtctcagggacatacagcttcactcttttaggcatcccgtataattgacctaagtgacaatatcttctcttgctcacaccacctttgaggagttaagctaatattgaatttttctcattatataaccctttgatttattcacttaccctcagccactattcctccctctgtccctttatatcagttgtttccaggtttgggagtgacattaggtttgtctgctgggctggcctagactgcaggcagcaatagtattctagcatgtcttccctcagtctagtcttgatcatagagggtaggttatataggtaaggaactagtgggggctatcagaccaccaggctatataactctacttactgttaatcctaacttttcagatgaaatgaatacttgagaattcttacataaaggtgtaaaaatatagttatggtttttcgcttagggataattcctgtttctggcacttttatttacatccctattcctggtactatggcataacatatgaaaaaataaatttgaggtgaagtgtagtctttattccagcatcctctccccttcagaagaattgtatgtatcgtcgtaacagcatcgtcctgatccatcaggtaaaagagaggatgctacctagtggagttattcttgcagccccactcatgttgacagcgagcacattcatgaagatataaaagccagtccttcatgtttatattgcccaacaattagattggcagtttttagacaaacaatgtttcaattgaccatttcaattttctatcaaattttcccctgaggaggacatgtccctctgcattgttggccgtttgaggctgtaaagtgtgttttcttgtgtaaagaagtgtgactcggcagtccaaattggtgcaacctcttcttttctggtccttgtatagcccttgaagcattgacatctacccctggttgagcatagcccaatccagagtcagtgattttcctgtcaagatccattggcagctcctttggggttgctggcatcattctggcttgccaggtattatgatcaaagccttcccactagagaatctgtcacatctccatctgctgcctctgtctgttttcttgaccaacagtgaaaaaagagattatgagaaataagataaattaccaaaattgtgaacaaaagagattatcactaatgacccttaggaagttaaaaaacattataagtgaatactctgaaaaacctgaagccaataagttagaccacttagataaaaaggaccaattcgtgcagagatagaaattgccaaaactgacccaaattaactggaaaacctgaagagaactgtgaactaagtcagaaattgaaaaaccttctcaaaaagaaatgccaaagcccagatatcttcactggtgaattctatcaaatattttgaaagctctttcagacaagaagagaggagggaagactttccagcccatttacagaactggcattaccctcatatcaaagtcacagcaagactcacaggaaaagagtgccatacaccagtgtcaccaataaacataaatgaaaacatccttaacaaacattggcagataatacaaagccacataaaaaaggattacactccatgaccaatgggattcatcccaggaacatatggttggattaacatttgaaaatcaattcatggaatgcactgtattaatggaaaaaaagacataattatctcaaaagatgcagaagaaacagttgacaaaaatgttaacatcactcatgttcataagtttcaacaaaataggaatggaggagaccttcttcactctgataaagggcatctataaaaaacccacagctaaaatcaaacttaatgaagaaagactgaagactgaatgcttttctcctaagatggggatcaatgcaaggatgtccaatcccaccacttttatttaatattatactggagattgtagccagtgcaataaggcagaaaattaaaaattaaaggcatccagataaaaaggaaaacatacaattctattcacagataacatgaccctgtctgtagaattcacaagcagataaaaactggctagcactaataaatgaatccagaagggcccataggatatcaaatcaatataaaaattaattattaacatatttctctatagaagcaatgaaaatctcaactttcctatcacagtagttaccagaagagcgaaataggaataaatttaggaagacagcagtgtttgttcactgaaaataaaaaaacattcctcagagaaattaaaggtctaaataaatggagagatgcgagttggaaagctcgataatactgttaagatggcaattctcccccagtagatctataggttcaacacaatccctatcaaaatcccagcagggattttatagaaaattgacaaaataggccgggcgcggtggctcatgccggtaatcccagcactttgggaggctgaggcaggcggatcatgaggtcaggagatccagaccatcctggctaacacggtgaaaccccatctctactaaaaatacaaaaaactagccgggcgtggtggcgggctcctcgggaggctgaggcagaaaaatggcatgaacccggtaggcggaggttgcagtgagcggagatcatgccactgcactccagcctgggtgacagagcgagactccgtctcaaaaaaaaaaaaaaaaagaaaaaaagaaaagaaaattgacaaaataatcctaaaaatgtatattaaaatgcagaggatgcagaagggccaacacaaatttgaaaaaaaaaatggaatgtcatatgaaactacaataatccagacagtgtgaaactgagagacatagagatcaatgaacagaagtgagaatctagaaagatattcttactttctttgtcaattgattttcaatgaagttgcataggtaacacaatgttacatttaacaccatataaaatatcagctcaaacaaattagagacctaaacagctaaaatttatgagttaaaactataaaatttctaaaagaaaacacaggagaaaatttttattactttgggtagttaggcaaaagattcttagataaaataccaaaagcatgatctacaaataaaaaaaaaagagagagagaaattgggcttagttaaaatttaaaacttgagtgctccaaaagacattgagagaatgagaagacaagccatagacagggagaaaatatttcacaatttatcacaaattacatttgtgttgaagaacatgtttccagaataatgtggcaagttcttaaactcaatgtgtaagaagatgagcaactcaactgaaaatgagcaaaacacacaaatatgctcaactgacatttacaaaagcacaaacacaattcaatgaaggaaggagagctttcccaacaaatggtgctggagcaactggacaaccacagtggaaaaaaaataggctgagcccaaacctcacgctttatacaaaaaaaaaaaaactcaaaatgaatcacaggctttaatgtaaaacacacagttaaaattacaaacattgagccaggtgtggtgtcacaggcctgtactctcacctactcaggagactgaggtgggaggatcccttgagcccaggagttcaaggccagcctaggcaagatttttttttaaataaataacaaatacattaaaaaattaaaattacaaatcttttaacaaaaagccatcagaactaagactagacaaagagttcttacacataacaccaaaagtatgatctgtaaaagaaaaagttactaaactggatcttatcaaaattaaaactgttgctctgtgagagacctatgaagagcataaaaagacaagctacagaatgagagaagatatttgcaaaccacatattcaataaagacttgcattcacaatatatgaagaaatgtaaaaactcaacagtaaaaatgaaatccaaataaacaataggcaatgagcaagacatgaacagacgtttcactgaagaggataaacaccaggctaacaagcagatgaaaagacactcaacatcactatccagtaggaaaatacaaattaaaactgcagtgatgagaatggctgaaatacaaaataaaggtagcaacagatgctggcaaggttacagagaaactggatcattcatattgctggtaggaatggattttaaaatggtacagccactctggaaatggatattgcagttttcttcaaactgaacatgcaatttaccatatgactagaaattgccctcctaggcacttatttcaaacaagggaaaactttatgttcatgaaaaacctgtatacaaatactcttgcagctttattcataatactcctggaagtaattattcataattacttccataaactggaaataatgcaattgtctttcagtgggtgaaggagatctgctggttgaactcataactgagtctacacaagtgccctttctcaagactactatcctgcttctctttgcatatctcccattttctcacaaagaatattaaagacatgtactcaaggatcaaaatttaatgaacataaatattttactgctccatcaaaggcattcttaaatgggactgcagtttggagccactgccttggttctgctaaggtgctgggtgtgctaccgaccttggcatttgcagcattaatggaaaagtcaacataatgaaacaggcaaatggcatcttggtattactgtgaaaacaggtttccctccaggactctctgaaggcagctcagggggccacactttcaaaatggcagagatcaattatagttcctagtgagacccaacccctagcctattcagattcagcactctctctcgctcttttttttccctcattcttccaacttataattgtatatattttcaaatgtgcaaagaagctgaaagaatagtgcagtaaaattcaagttatcactctgatatatctgattaatatctctttatatgcatgaaagcagcgtgtggaatgatagacaatagagacccagaagggtaagagtggttggcagtgggtgtatcgtagaggagtttcttgttggggtcaatgtatctgtctccagtggtggatgcactgaaggccctgactttaccacaactcaatatagcaatgtagcaaaactgcacctgtgccccatgaatatatacgaatttaaaaatttaaaaataaaataacatctctctttgtagatacaggtagacatgtttgcatagcatgtgtgtgaatgtgtgtgtatgtgtgtgtagagaggcagcaggaatgaagagattaagattttgtgactgagccattctaaagtaacaaacataaaacacgcatggataaatgtctatgtgacaacaaacctgaatataaacatgaaagaacatgtctataaacatatctctggctagataacctatgaaagaattccctaccccagctcccttactggttaccctgcgaacacaggcaggcagggaacaggacccaactaggttccctcatcctcttgcttccaggcaggtcctgcatccactcctgctgcacagagggctcccatctctgccttggtcggtttcacaggtgctcccctaactctctctgccaccactgccttacctgggtggagctgaggctgccttgaccaagaacagcaccacccatctgtgtgccccaagaccaggaagttaggaggaaccacgcaacagagtcaataactatcccacctccccagtcagtctgaactgatggcgggagatgctgatgcttgcttatcctcattccccgtttatttattcttcgttaattcagtccaaactcccctcagtctgaactgatggcgggagatgctgatgcttgcttatactcattccctgtttatttattcttcattaattcaatccaaactcccctcagtctgaactgatggtgggagatgctgatgcttgcttatcctcattccccgtttatttattcttcattaattcaatccaatctccccagcagtcacttcacccaggaagcagactgacctctgctcttcataatcaggaaaccccaaagcactctccatcacctccctgatatcacccttcagctctacatcatcacatgtgggctctaactctgaaggcaggtgtcctcccacagggtcaacccctgaacattggccccagatgtctccccatctcttcccagccctttcagtactgctgtgaatctgtccctcactgagaactggcggggcgatgtgggggaggaggggaaatttcttggtgctgtgtcaaagcatcaagacagacctctccttctctcctgaacctcacactctatctcttcccagacacttgaaataaaacgcagaccagaaatgtctatttaagagtcaacacaatttctttttctagacaagtttctcttattctcagggctcagctatgactgtgggtgaccaaacaactattcacaaaggacagaactcgcttcaatgccagcttatgaatccacaccttgccacctgcagaggtggaaaaaggcacctaaatccacgatccaatagttcttcctgcccttaactcctcacacacatctggacacttggagagtgtggagggcacccagggtgcagggtggcagtggaggccttgggaaaactggccaggaagccaagatatgcacctcaggtgactaaatttttttactgttctgcacttgctggagaatgaccccaaaagataagatcaatttgttgactaccaacttatttggctgagccatggacatggagcagatgagcattgcctttacctatgacatgcatgaggattctgagacctacctgcagcagttaagccccacacccagagggacacccactctcccacctccttactttctgtatcttttcacactttacatcctcatccttccctctgagagtcttccctctttgggtcttctagtcctatcctaccctctatccccttccaggtggcacagggcttgaccatcacatttgtgtcaggtgacaataatgccaggatcctcagtatgggcagcatcgctttgaggtcagtgatagtgagctgcctgatgagacagacatctcctccacagtgagtgctgatgtcatgaagccctttagttcttcctagttccttaatatgtttgtcttcaatcctgtcatgggcacctgatgcataatggacacttggctgcttcatgcaccctggtctttgatgccgtgttgggatgtttttctgaccgttatgtggggtatctgttttctttcatcatattacatctcttcccccactcccaagtctgtcctctgaacccacacagtacaccagcatctgcatgtgtgccgtgtgctcctgcctcactttttccttttcatgccttattctcaccatgccacattttccccttagttgaacagacacagtaggggactagcccattctggcatgtgaccacgcttcaggaggagactgcaggttgggggtgaaggagactctactgaccccacccctgacatcctcttcccccaccccctggcttctgtcctctgcctcagcaccactcctgaacccccattcctgattgtcagaatttttaacataactaaaaatgaaacacaagtgcatctgcattatgtgtgggtgctctctccctttattttatttggggtgaggttattttagggcatggcccagggtaaattcctgtaaggccttggtgccctgctgtgaggtcaaagagggatgggactaagactgcagagccctggctcccccactacctgccaattgccagccctttgtggggtctcttctgctttctctggcctgggagatgctggggtgtttctgatcctggggctcctgggggtggtgcacattagttccaggcatggagggtgctgtgggcactgctgggaagcttgggtgtcccctcccaggctctctcctcccaggctctctcagtgcctcctcatctgtttctttagcttttggatcttgagcaccagggcctgggcccccaccgactccttcccttccaggagggcctggtccagctccagctgctgtgcaagcaactcctcagcttgggccagctcagctgtgtggggggctcagggccctggtcagagggagtggaggagggagcatcagccagggtagaggggttgaggcccttggaacctgtgttgcaagatctcatggtaagtgaggaattcgacctcgttttctctttttccagcccattagcttaagtccacctgtagtgagaatcccagggagcaacctgtcttgggcataggcctctggagggcagatacagatccctggctcaggggctatatctggatgccttgaatgaggatatggggtcaccggaaagagacaaccagatgtctgtccccactaataaatgattaactgttagatgagggggaattcctgttcaaggactctggactgtgctgctctgggcagagggagggctggagagagggagccctgagggctgggctggggtgggggtggaaggagctgagagttggaaataggcaaaaagctgcagaggtgagggtaatgcagggtgggattgagagaatttcccccgactactgtactgatcccttcatctcctccacccgagcacttggagccacatagcgggtggcctcatcttcccactgtcccagaagctgttctgcccttccatacttgccttggagttttgggagcagcatgtttatgagccctggggtgccagggaccaggagggcaggaggaggtgaagaaaacagcaccgagagagccaggggagtgggaggactgtggcaggtgaggcaaggagctgtctgagccgctcagcagccttcaggaggctctctccaggcctgtcttcactccagtgcctggccctacccaggcccccactcccgctctgctctcaagctggccccagacaggatcccaaacaactcctgttcctaatgtgaaaaatgtttctgccgctttaggcagaacttgctttagagcactggcacagccttccgcaggtcgtgtgtctgattctcttggcactgtgccttttttcacttattcttctgcaaggaaggaattatatcactggttgggtgaggcaactggctcagaggggttcactgagcactcacccactgggcaagtgtctgtcagggccagctatggccaagatgtgtccaaggctctatagctagctggtggaaaggcctggagggttcatattcaggtccacctaacttgaaaacttatattgaccttacttaagtactgattccccctttataatccatgccgcaaacttcattgtcttattttaagaagttgccataagagcctttagcaaccaccctcctgatcagccagcagtcatcaacattgaggcaagaccctgccccagcaaaaagattaagattagctgaagcctcagatgatccttagcatttttgagcaatagagtaattttaaattaaggtatatacatagttcttttatacataatgctatcatacacttaataggctacagtagagtgtgaatataacttttctatgcactggaaaaacaaaaatttgtgtgacttgtttgttgccatggtctgaaaccaaatctgcagtgtctctgaggtacgtctgtagtttccctttccctcttcctgctggcccggaatgaccttgtttcttgcccctgtctagccctgcatgctgcaggggtttgccttctctggtaggtctgggaactttgcatccttgtaaccttggctcctggcatatgacactggtaccaagctctgttggactagtgagcctcctccccacacacctcctgaactagaaccaaagctctgtgcatgcaccgtgcatgtgtgagccaatgacaagatgttgtcttcctgcgagtgttctgaaggagtgttctgttgtgactggaggacacagccacgggccccccaggcagaggtggctcagaagggagtggatggccccggttttgatcatctggggacaagaaggtcctgagataaaaacccatgttttggaaaacaaaactgcccgagactgaaaagtggctaaccaattcgctatctgggacatcactgcacactgggagggaagatggcttctgccatggtgtagggtcccggacctagacaaagaggccttcctatggctcagtgcttctgaagcacctttaaatgaggccaaagacctcatgttcatgattagctgactagttcccactcagtggaaaaaaaaacccagaacttttgcaaaattttaggagagagggatttccctcttgtctcttagtgctacggttatgcatgactcatacttgaattgcagtgtgtacacagcttaaggacttaactattagaatacaagaggcccaaactactgttgttatagatatgtaaaactatatggtataaggttaaacaacccacaactaattaacagtgaagataaattaactacattgcaaatttaaaacaagattagcagccctttagaaaaaaaacaaaacacatgggaggttgcaaaggcaatctaaatgatactctaataaaaatccttcatgaaaatgacatttcaaccatctgagtttctgctttaagttatgaactccaaaatggactaacacccaataatttacagtagggaggtctaagccaccaagaaaggtgtcagggcagacctgaaacctggaatgaacacgccccctctctcagggtaatgagtaaatcctctaagacccgttctatctcagacagaccatccactcataaggaggtcaaaagaaagttccacacagcactgagacccaaccacctcattgtcctcacctccacggacagagcccaggtgagagccacccctgctcctcctccctcatctcccacagcctcagcaccattgtctgcgccgagtccaccaggactcagctcatcatgtcctttccctgtttgtgtcagtgacactgggtcccccacatactctgcactcacatccccacaaggctctgcacaccactattctgtctccccaacctcccgaaccacagaaatcttcccagtgcaccccctggaatctcagtcaatgatcaacaaaacctccacaccctctctcaggatgttcctgcacctcccagctccagcagcaacctggtctccctgaggacatgaccccctctgaagtcctcccacataggggagtttcccccatggacttgtacccctgggttcagaggtgaggtggggaccttgctcctcactgtggttctcagaactttctgcctccctcctccctaaaacccctaggctgtcatcagattagacccccattcccctcattgtagccattccctgtgggcccctggcctttcctctcaatcctgactcttgtagctcttggttcactgtcaccctctccagcagtctccttgactgttggtgacttcaacatgtggtgggctgagtaatggtcccgaaagaggtccagtcttagtccttggaacctgtgaacaggttgcattacatggcaaaagggactttactcatgtaatgatgattaaggaccttaaaatagggagattctcctggacaatctgtgtggccccattcaaatcaaatgagccactaaaagcagagaacctgccctggctggagtcagattctgcagaggaggaaggcagaggagacatagaagaggggaggtcagacgttccaagcaggaggattggatgtgccttaggcaccatgtgtgagtagctgaaagaagattctaggagctaagcgtggctcttaacaaggaagtggaaacctctgttctatgtgcaaggaagtgaattcagacaagaacctgaatgagcttggaaatggattcttccccagagtctccaggagggaacacagacctgcccataccttgatcttagccccataagactgtgtggacttgcaacctacaggactgtaacatgataattaggtgctgtttaaagccacttggtttgtggtaattcttatggcagcaatagacacctatacagcagagaagatgcccttgctccctggactctcagatcctggaactcctctcctccatgaccttctcctctctctgcctgaatctcatgcccctgtcatcccctaggcctcatcatgcccaagaaccccagcccttccatactctcaatttcacacttcccactctctggccatctttccactcatcccatgcaaggtggccacaggctctgaggacacagactctatcattttatcatatgctgtgaggtaatatcagtgactactcattgcatatgtgcctgcattccaggcttgaagtccaccctttagcacatcaattccaacaatccttcgacccccaccctgggaataccaatccagtgattccaccatctactcactgtccctcatcgttggtgtcttctctaacttcatgacccaaaccacatggggagcccccaccagggccagcaatcaccctctccctgcatggctcaccctcagcctcctcctggcctgggtgacccttacacaccttctctctgtgctcacacatccaaccctccttccccattcttatctcagctgacaaccttggttcctacctcactgagaaaactgaacacattagaagacagattccatcaccatctgctcatgcatttgcagctgcaacacatgtcaggtgttttaccatgttggggactgttgtgggtaaaccattctgctcccatcagagccagtccctcttctggtgcccaaaatgtcatcccttatcatctacttaaaggtgtcagttcatcaattaatacctttttttctctttatcatcaacctttttcctctctccccactggatcattgtggcagtcatgagaatgcacatcccagcccctcagctagagtaagcagaattgatagtggcctcaacttttgaatcctgaaacctattgccacatttgctctgagaccacacctgccccctgtcttttcctgccaatgactgaggaaagcagggcagaaactaaggcaggaacatttcttctctgaaggctgactgaagctctagggcttcctgccacgcttactgaacttctgttagcctgcacagggtctaggatgcttccagctgaccttcctgcactgtttacctcactggggctcagagttgctttgtggtctgatgacattcccagcattttccgtctgtgtcctgaatttctctcataactatttcctctaataaatccttgcacattgaatactgtattggggtccgctcctcaggggaccctaactaacacaagtagtatgaagggtgatccatgaaaacaggcaaaaatgagaatttgaaaaaagcttgcccactgcctggcaggccaagaggatgccaccagggttgtgggagacacagaaattccatagcacaagatgcagccgagctgctatgggtctcaccagtgctgagctgagaggatgccctggttaggggaagctatggcaggtggggtgatagaatgccctgcacaataatgacggggttagggggaaacctacaaagacagtggagttggctggttactgctcagctgcaatgatgccctgtgaaagtatcatgagaatctgcagattgttaacagctgtcactggctacatgtgacagcctctgcagtgtctcatgcacaggtctttatctcttgtagcgaaagggcagataccgtggaatggtagctgaagacatcactatgagggccacagtgctccagagaggtttgccactcagccaaggcaggcctgttacaggaaagtcaggaccctggtggggaaacctgagattctgcaaacaggaacagggttatccgatgggtgccctccaggatcctctgggcatgcataggaggctcacccttctctagtaatggttcccacttcctatgctggaagatgctacagaagtctcacccccatgatacagcaggaatcccactgaagagctttgcaggaactagctggcacgtccccataggaggccgaggagcacttctgggattggaatttgagggtgtttgatcaaggaaccagaatttcaagctggaagaataaaaatcctttggcttggaggcactttctcaaggcatgggtttatcaaacaccccaggactttgataaggggggggccaaacccaccgctggggtgaatccatatagactagaaaaaatgatgcctaactctcaacaaggtagacgtgacttagttgccctggaacttgcacaggatggaataacaaggctgagggaagtgggcatggtgaaggcccaccagtaccatgctccacaagacggtccaaaggaaacaccttccaccagagcctcagaaacgtgatggtgagagggacctgcatcattaagaaatgtcggggtgttgtcctctgcaggctggatgtgatggtagtaaagatgacccagagttgcatttattaatatccctggggagagtgtggccctgaagagacaaagaccaaatggtggcagtgacctgaaaaagccagagggcagagttactatggcaaactaaaaggagtagccaataggactcaagctgcagggaatgtggggaaggatagtagagggtggtgtcccaggattaggacaggaagccaacaagggcgctgcttgatatctatgataagaaagcaagaattgagaagcaggagggtgaaggtgtttgacccaatacaaagtcatgatcccatcctcaatgcctagacctcagccaaagttcagattcagatcccagtgacagaggaggagtccatatccctaggaggaataccctgcaactccgtggaagtaaatgctggcacaattccctcagtccttcagcaaaggaacctatagccatttactcaggagattgtacactggcgaaaggaaagatgcagaactggtcagattattgacactgagtgagagctgacattgatgcccagatgcccacagcactatcatgtctcccatcacagtggggcttacggaggtcagggagtaaacctggacacattacggcccacaatggaactactggatccatagacccagccctggttatcttccaattccctgagtgcataattaacactgatgcactgttaagtggagtcacccccacactgggtccctagtctgtggagtcaggactctcattgtgctgaaagccaaagggaaacctctgacgctgcccacatcctggcaaaaaaaaaaaaaaaaaaaatcatagtgtgtcccagggtgtgtcttgaggaagacactgaaagtaatgtgggggtcacaccaccattagagagctgaaggatgtgggatggtgttggggttgtctattgtctctacataatccagcaacctgtccctgaggaagcctgatgaggactaaagaatgaatgagattactccaggcctggccaagcaggaattataattgcagcttttatgttgtctggatatcactgcagagcagaataataaagcctcgggcacacagcgtgcagctatggatttggtgagtgcatttctttccactccaattagaaaggggatatggagcgattcacatccatgtgggatccacaacacatttatttatagttttttctcagggctattgtaactcccctgccctatatagtatggtctaaagacaatactagacatactggatattctataggatattaaatcagctcatttcactgacaacttcatgttgactgcggtgaatgagcagcaggtagaaagtgcactggagtcattggcaaaacacacgcactccagtatgtgaagataaaccttacagagcttcaagagtggccactgaagtgaagttttatgggttaacaagtgccaagtgtttaggggaatgcaggtgtgttccccccaaggtaaaagacaaactgtttcatcttgcatcctcaccagaaggaaggaagcacactgcctgatgagcctctttgagttctgacaacaccacattccacatctaggtacgtgctttggcaaacactctaggtgacataggaggaggccagcttcaagtagggcctacacaggaaaggaccctgcagcagatccaggccatggtgcaagcagccagcgtccctcagaccccctggggctggtggtgccagtggtggggaaagatgcaggatggagcagaaccaagcaccagtgggagagtcacagtgaagggcctgggattctggagtaagatcatgtcatccacagcagagacatatgccccctgttagaagcaacttttagtgttccttgtactgatttgatagaaagcttgaccacaggacaccaggcaactatgtggttccaagtgcctttgtgacccacaacatcataaattgcacaggcccaacagcattcatcatgaagtgaaaatggtccacctggattgagcttgaatcccacgtttacacccacagaaaacacccaagtctgatgtggcactgaacaaccaaacagacaaatggcagttagccagccttcaccatgggtcagcccaggcctggtaggatgagtgcatgaatggagcaaccacagtggcaggcatgagtgccagcagcactgacttccccctaccaaggcagatccagctgctgccacctctgaatgtccaactcatcagcattttaggcccatgatgtgccctagtggggcactatttctttaggtgactagtcattaactaagaagttgactacatttacctacttccatcctggaaggaccagaggttcatcttcacagggttaggtacctattctagggggggttttctgtcctgctctcagacacagccagtaccactctctgggtgctgttgacattcctggtctgcaggctaggcagtgctcctagcccattatctgcctgaaggatccacttggcaagggaaagattcagtgtttccatggctgttgcttccactaaccctatcaccagctactctccccaggggctgccagccacaaggaatgccccatatgtagcctcacacctgccactgtggttgttccattcatgtgcccatcctatcatgcatgggctgacccatagtgaaggctggctagcttccatttgtctgtttcgttgtttaatgacacttcagacttggctgttttctgtgggtgtcaacatgggattcaagctcaacccaggtggatcattttcacctcatgatgaatgctgtttggcctgtgcaatctatgactttctgggtcacacaggcacttggaaccacatagttgcttggagtcccgtgatcttccacaggcacaactaagtgccagcctggaggaagcactctgagggttgcgtgccatctttcaggacatggtgcgttgtttaaatcagagtcgtctctacagttctgtgttcgcaagaggaagaacatgtgggtccagaaatcaaacggtggaagcaggtatggctccatgtctaatctcttagattcacctaatggggtatttgacatgttttatctcagaacactgggctgtgcagggtacgaggtcctggtttgcaaaggagggtacccttaaaagcagacaaaagacagcccactgaactacacattaagtttgtcaccagagaagtgtggacagtatatgcccagagaccacctggtgagaagaggagtctcctcctctccaggcccaggtaatagatcctcatccccaggaggaggcatggctactttcacacaataaaggcagaagtgtggaaaccagagatccacctgggggccttctgttttccctcaccccattgcaagtgagagtagaattatccagcaattcagcctgagaggatttgatttccaagggcccagacccatcagggcagaaggtttgagtcacactcctgggtaatcctccaaggccgtgctcctgtgctctgacatcctcagtggcattggtgctgaggccctgcttcccatggactattcccaaccagtgatgggtcacaccagtgacactaaggcaggacattcctggaagacaggggactcctctgatggccagctgtggctggaggactcctccatagccttgctcaactctccttagattgcctgtggtctaggacatgttaagtaatccttccttccttctttccatcactgggggtcacacttgcatcttattctattgcctttcccagggtaacctacctccctcaccatatcgtctgacaggtgtgtcccctaataaaatgctgtaactttaatcctatgatggcacttgctttttggagcatttggactacaaaatcattttcgtctgcacaccagtgacctcttacttattccaacgtgtaaaatctttttgtttattcaacttcttctacctgcattggctccattttgctggtatttgtattatgtttttgagttcaccaatgtttgttgctgtaagtcactaaatttgggggtagtgttttacacagcaacagataactaatgaagccttcttacatttccgttattcgatagaggttaactacgtctattttatttcctcctattttgataatattagccatacagagggtttccagttcccaacgcctattcttttctttattttagtttcttttctcctttgttccttctttttctctttccttctgtccctccttccctctttaattccattcaatctctcgccctccttctcccttcctcctttccgtcctttttcttccccttccccttccttcttttcttctttcactccttcctcaattcctccttctttctctcccttcctccattttttcctttttattatgaaattttcctaacatattaaataacccctacgtgattgtgttatcagtaagcattttctgaatctatatgtcaaaagtataataccatggtatatgagaaacaagtaaacaacaggaagttattaacagagtctgaataaaaatgcctgctataattctgcagccaagacagtggcttttaactcaattccttcaactaggtgttttcagaacacatgagtttaagttgacacaatcaccttggaaatcatattatcattatctagtatggttaaagtccatacaacatatcgtccaaccctcccactcctaaccatacactctagcgggctttcttgcctatgtgcccaggagacaggcacactgatgtttatggcaaaaactggaatcagccacatatacatcaataggaaatatacatcaataggaaattgtggcataaaatgtaaaccttcagcagtgaaaatgaatgaatgacagcctcccacaccacagataactcctgtacgtaatgtgcatcatgggaaaataaatgcagtaggaatttgctgtacaggaagcttaaaaaccagcagaagtaaataattttttttggatatatatgtgtgtatatatatatatatatacacacacacacacacacacacacacacacacacacacacacatatatatatatatatatatatatatatatatatatatactcattgtgcaaatctttaaagaaatacaaaggaataaggatcacaagactcaggatggagtctctctctgggggatgtgactgggcagcagcccaggggagctttacaggtttgtgttttacaccagtgctgggcatctttttagttacatgattgtaatttgttaaacagagttttcaaattaaaatatacctggtatttataaaaatgaaagagaaaagaataccaaagttcattgcaaggatccttaacaagaactacttacattgaaagaaaaccacagagaaatgtaagcagccatgtgacagagaggaccaggatgtgatgaaaatggccttggttaataataggtcatttgatccttagctcactggcatctctctggattttcaagtatacaatgttcaatctgatgtgcaaggtaattccttcttgcaaaggatttggtgttacattttaccacacatacaactgaattaaactttcacagaattggaaatacacatcactgatcaaaataaatgaaacaagaaaagagtagaaaggaacaaccagtgatggaatagcaaatatgaatggaaagcaaaataagacagctaaaaaaaaaaaaaaaagaaagcttcagaagcacataatagcagtgctatttagaactgtagtagtgtccaaatcacttctaccacatctcatgcaataccacacccaaaaatgttaagtttacaatagaatgcccctgagccgtttttggaaaaaatttgattctcaattcgagttaagcattttgggctactgcatcaaaccaaagttactggcattatgctaagctagatgtgttgactgaagtatgagattcccatttttgtaaatgagaagcaatctgattatgcaattttttctaagtgaaagcaagtttattagagaagtaaagaaacaaaagaatggctactccatagacagagcagtgtgtgtgtattttttttttaagtgtaggcaaatgttttctgaagatgatatgtcaataagaaaattggcacttggggcatacttccactaaatttgagacatcttagacaaaacaaagacttattttcaaggcatcattcttatggcactgaagtcttggaactatttgatctagttactctatgttctcaactgtgttaacttattgaagaacattgttattaaaggtatttacaagagaaacgcagagatactgttgtttctcctttctctgtctcaaactgttttccctgcagcacccaaggctctgtcatgtctcaaacatttaatcattaatttaaaaagagaagcttatcacagaattagaaaaaaaaatttgaaaattcatatggatccaaaaaagaggttgtgtagccaggagaatgctaagcaaaaagaataaagctggaggcatcaggctatcctacttaaaactatactataaggctaaagtaaccaaaacagcatggtactggtagaaaaacaagcatatagaccaacagaacagaatagaaaactcagaaataagacctcacatctacaaccatgtgatcttcaacaaacctgacaaaaacaagcaatggggaaaggaaacgctatttaataaatggtgctgggaaaactggctagccatatgcagaaaattgaaactggaccccttctttacaccttacacaaaaattaactcaagatggattaaagacttaaatgtaaaacccaaaactagaaaaaccctgaaagaaaatctaggcaataccattcaggacataggcatgggcaaagattttatgatgaaattgccaaaagcaactgccacagaagcaaaaattgacaaatgggatctaattaaacaaaagagcttctgcacaggaaaagaaactatcatcagagcgaaaaggagacaacctacagaatgggagaaaatttatgcaatctattgatctgacaaaggtctaatattcataatctaaaaagaacttaagcaaatttacatgaaaaaaacaacttcattaagaagtggacaaagcacatgaacagacacttctcaaaagaagacatacaggtggccaaaaaacatattttaaaaagctcaatatcactgatcgttagagaaatgcaaatcaaaaccacaataagataccatctcatgccagtcagaatggcaattattaaaaagttaagaaacaacagattctggcgaggttgtaaagaaataggaatgcttttacactgttggtggaaatgtaaattggttcaaccaatgaggaaggcagtgtggtgattcctcaaagatttagaaccagaaataccatttgacccagcaatcccattgcagggtatatacccaaaggaatataaatcattctattataaagatatgtgcatgtgtttgttcattgcagcacaattcacaacagcaaagacatggaatcaacccaaatgcccaccaatgagggactagataaagaaaatatgatacatatatgccatggaatattatgcagccataaaaaggaatgagatcaaatcctttgcagggatatggatgaagctggaagccattatcctcagcaaactaacacaggaacagaaaaccaaacaccgcatgttctcacttataattgtgagctgaacaatgagaacacatggacacagggagaggaacaacacacactggggcctgttgggggagggcggtggtggggggagcattaggaaaaatggctaatgcatgcaggggttaatacctaggttatgggttgattggtgcagcaaactgccgtggaacccgtttacctgtgtaacaaacctgcacatcctgcatatgtaccctggaacttaaaattaaactaaattaaattaaaggacaagattaaaatgttaaggaaaaataattagattaaaagcctttaacttaaaaatcctgaaataatagtttgaattttgcttttaacatatatgcaaatcctttaatactgctcccttccagaggtgcagcttaattccctctcttgagtgtggcttggacttaatgatgcacttctgatatggcctggttctgtgttcccacccaaatctcatcttcaattgtcatgcgaattgtaatccccagtattgaaggagggacctcatgggaggtgattggatcatgctgttctaatgatagtgagtgaattctcatgagatctgatggttttataaggggcttttccccgcttccctctgcatttctctctcctgccaccatgtgaagaaggacaggttttcttccacttctgccatgattgtaagtttcctggggcggcctcctcagccatgcagaactgggagtcagttaaacctctttcctttataaattacccagtctcaggtatttctttatagcagtgtgagaacagactaatacaacttctaactgatagagcaatgccgacgtaacagcttgtgactctgggtgtagaacctaaaactccctgtggcttccaccttctctctctctgtctctgggatcatgagctctggggaaagtcagctgctgtgccatgagcagccctgcaggaaggtccatctggctaagaactgaggccttctgggactcaattacaacgaactaggccttttccaacagccatgtgactgatccatgtttcatgtgaatcctcagccccagtgaagccctcagatgatgcaggcctagactgacaactggactgcaaccttgtgagaggcccttagcaagaagcactcagggaaacttctcctggattcctgacaattggaaactgtgggagatgatcaatatttgttgttttgaaatggtacattttacataatttgttatgcaatagtaaataactaatacattttcacaagacaggatgtattattacatgttaatttgcatttgctctaaatttatcatcatcattattattatttttgagacagggtctcactctgtcacccaggctggagtgcagtggcatgatcaccatgcactgcagtgtagacctcctgggctcaagggaccctctgacctcagcctcttgagtagctgggagtacaatcatgaaccaccatgcctggctaattttctaattttttgtagagatgggggtttccccatgttgcccaggctgatcttgaacttctggagtcaacaaatctgccttcctctgccttccacaatgctaggattgcaggtgcgagccaccaaatctggcctaaattaattaaaagatataaatatgtaacttagttttaaaaggtaaggagaattttcgtggctgaaaaggatgtattttattaccgttcacaatgattactttacttgaacttcaatttgcaactgtgtcccaagtgaacacaaaaagaagatccagcccttgctaggctgattctatgatggcctcaacaacaagctcctggtcattcaccttccccccattattcaaccaactctaatataggtgctgctgtgaagggatttagcagatataattaagggcctcaattagttgactttaggctgggtttatgctgcttggactgtcctaatcaggtgagtccttgaaaggactgggttcttcctgagcatagagattcacagtgtgagagggattcagcatgaggggtttcctccactgtgggctttgaaaatgaaggggctgtacagggaagaacgctggtgggcatcaggaattgagcgcagccctccctgttctctacattgacagccagcaaggaacgcggacctcagtcttacaactgcaagaaactgcattctgccacctctgtataagcctgaaggaggattcaaaatgaaaacacagctttgggaagcccggaacagagattccatccacatcatgcccagatttctgactaaggtactataaacagataaatgggtgttgtttggccaggcgtggtaatgcacacctgcaatcctaacatctgaggagttgacacaggaggatcacttgcatccaggagtttgagaccagccaagatcaaacagtgagacactcatctctacaatttctttttaattagctgggagtggtggcacttgcctgcagtcctagctactctgaagactgaggcaggaagatcccttgagcccaggagtttgaggctgcagtgagccatgatcatgtgactgcacttcaccctggatgacagagggagactctgtctctaaaaacaaataaatcaacaataattgggtgttgtttaaagtcaatgtttgtgataatttgttatgcaatcttataaaattcatacacaggctcaacagactcggatgaattgatatgcacactagttacataagataaaatatttcttaatttttcagtgttttacattttataactttctgtgatgcaatttaatacattcatatttcattcattcagtcaacaaaaattaatttagtgcctaagatgaaccaggtatgccctcatatgctcacgtgcctgacattctagaagcttcacaagaccgaggtggagccactggagtgttttaggtgaggaaatgacacactctgactcacaggagcaggaccactgtggagagaacagtcacgtagcaggtaatgggacaatgctagagccacaatttagaagtgacagggtggtggggactaaggggagaggagggcctgagggatgaaagggacagagggaagggctggagaagcaggaggttaggaaaaggagcagagggaaggaattggaaagcagtagaattcttaggtttaaacacattgttttatagatttttattacatccatctacagagcctcgctcagtgttctttgcagttggcctttaatacctaatgtaggactgcctaaaaactaatgttttttatgttaataaggtttaaaaaatacttagtgttccttctttgcagttggcctttaatactatatttgggactgcctagaaactaattttttttaattaatcaggttttaaaaatactaagtgttcctataagatatacacaccacttagacgtgaatacttcctaaaaacaggcagcacatgagcactgctgaggggcattgtgactgcattgaacacttgcaactgtgaggtgaataaagtctgtactggctcccggttgcaacatatagtaacgcagtgtgctactttatattgaggagatgtcttggactcacccagtaactcagggctgtggaatgaaggtaaatgtaaaaaacaagcgggagtcacagatacattgtctgcgaaagtcaaacttagtagctttgtgagtcctgttgtaatgctttcagacacatttatatatcaaggggccaaagttacattttttaccgattagattcctgatcatttaggggttgccaagattctgctacccactgtagttaataaacaaagagaaaacttgtctctatgctgtctcatgtactcaggcacaacttttccggatttaaagaaaaaaaaaacaaaaacctgtctctacgcctccattcccagggcgagctctgcctctctggcggcgagctccctctctgtcaccaagctccctggggtgagtttttttctagaagagttcagggaaataggtaaggagtgggaggcagggagtccagttctgggacggggattccgggatgaaaaatgaagagggacggggcccatgacgagggtttctccctggtttctcagacagctcttgggccaagactcagggagacattgagacagagcgcttggcacaggaggagcggggtcagggcgaagtcctatggccccaggcgtggctctcagggtttcaggccccgaaggcgatgtattgattggggaggcccagggttggggattccccatctccgcagtttctcttctccctctcccaacttatgtagggtccttcttcctggacactcaggatgtggactcagttctcacccccatttggtgtcgggtttctagcgaagccaatcggcgtcgctggggtccctgttccagaagtccccgcgaacccattgggactcagattctccccagacgccgaggatggggtcatggcgtcccgaaccctcctcctgctgctcttgggggccctggccctgaccgagacctgggcgggtgagtgcgggatccggagggaaatggcctctgcggggaggagctaggggcccgcgcactggggcgcaggacccggggagcagcgcaaggaggagggtcggacgggtctcagcccctcctcgcccccaggtacccactccataaggtatttcagcaccgccgtgtcccggccgggtcgcggggagccccggtacatcgcagtgggctacgtggacgacacgcagttcgtgcggttcgacagcgacgcggcgactccgaggatgtagccgcaggcgccgtggttggagcaggagggaccggagtattgggaccggagcacacggaacatcaggcccgcgcacagactgacaagagtgaacctgcccatgccgcgccgctactaccaccagagctaggccggtgaatgaccccggcctggggcgaaggtcacgacccctcctcatcccccacggacgtcccgggtcccccccgcgagtctccggctccgagatccaccccgaggctgcgggacccgccagatcctcgacccgggagaggcccaggcgcctttaccaggtttcattttccgtttaggccaaaatccccgcgggttggtcggggcgggggcggggctcggtgggcggggctgacagcgggggcggggccagggtctaacaccctccagataatgtatggctgcgacttggggctggaagggcgcctcctccgcgggtatgaacagcacgccaacgatggcaaggattacatagcccggaactaggacctgcgctcctggaccgcggcggacatggcggctcagatcaccaagcgcaagtgggaggcagaagaatttgcagagcagatcagggcctacctggagggcacgtgcgtggagaggctcgcagacacctggagaacgggaaggagatgctgcagctcacgggtaccagggaacacaagacgtctccctgatcgcctgtagatctcctgggctggcttcccacaaagagagaaggaaaatgggaccaacactagaatgtcgtcctctctctggtcctgagggagaggaatcctcctgggtttccagatcctgtacaagagagtgactctgagggtctgccctgctctctgatacaattaagggatgaaatctctgaggaaatgaagggaagacaatccctggaatactgatgaggggttccctttgacactggcagcagccttgggccccgttacttttcctctcaggccttgctctctgctttacactcaatgtgtgtgggggtctgagtccagctcttctgagtccctcagcctccactcaggtcaggaccagaagacactgttccctcctcagggactagaattttccacggataggagattatcccaggtacctgtgtccaggttggcgtctgggttctgtgctcccttccccaccccaggtgtcctgtccattctcaggatggccacatgcgtgctgctggagtgtctcatgagagatgcaaagtgcctgaattttctgactcttcctgttagacccccccaccaagacacatatgatccaccattccatctctgactataaggccaccctgaggtgctgggccctgggcttctaccctgtggagatcacactgacctggcagcaggatggagaggaccagactcgggacatggagcttgtagagaccaggcctgcaggggatggaaacttccagaagtgggcagctgtggtggtgccttctggagaggaacagagatacatgtgccatgtgcagcatgaggggttgcccaagcccctcaccctgagatggagttaggcaggagatgagtggagggggggtcatgtctcttagggaaagcaggagcctctctggagaacttcagcagggtcggtgctgggggctgagggtcagggacgctcaccttccccttttttcccagagcagtcttctcagcccaccatccccatcgtgggtatcgttgctggcctggttctccttggagctgtagtcactggagctgtggtttctgctgtgatgtgcaggaagaagaactcaggtaaggaatggatgaggagtggggtctgagatttcttgtcccactgagggtttcaagccccagttagaagtgtgtcctgcctggttactgggaagcaccatccacactcatgggcctacccagcctgggccctgtgtgccagcacttactcttttgtaaagcacctgtgacaatgaaggacagatttatcaccttgatgattatgatgatggggacctgatcccagcagtcacaagtcacaggggaaggtccctgctgaggacagacctcaggagggcagttggtccaggacccacacctgctttcctcatgtttcctgatcctgtcctagatcagcagttacactttcaggaaacttctctgggatcaaaggctagggggtttgtttagggccgtatggccctgactcctttctggcctctcataggacattttcttcccacagatagagtgagctactctgaagctgcaagtaagtatgaagtgggctgatccctgagatccttgggatattgtggtcgggagcccatgggggagctcacccaaccccagattcctcctctagccgcatctcctctgggctctgaccaagtcctgtttttgttctaccccaggcagcgaccatgcgcagggttctgatgtgtctctcacggcttgtaaaggtgagacgctgggggacctgatgtgtggggggtgttgggggcaatagtggatgcagctgtgctatggggtttctttgaattggatgtattgaacatgtgatgggctgtttaaagtgtcatccctcactgtgacggatatgaatttgttcatgaatattttattttatagtgtgagacagctgccttgtgtgggactgagaggcaagatttgttcacgccttccctttgtgacttcaaaaaccctgactctctttctgcaaaggcacctgaatgtgcctgtgttcctgtaggcataatatgaggaggtggggagaccaacccacccccatgtccaccatgaccctcttccctcatgctgacctgtgttccgtctccaataattaatcattcctgctccatagaggtgaggctgagatgtctccatctctgtctcaactttatgtgcactgagctgtaacttcttacttccctattaaaattagaatctgagtataaatttactttttcaaattcttgccatgagaggttgatgggttaattaaaggagaagattcctaaaatttgagagacaaaataaatggaagacatgagaaccttccagagtccacatgtttcttatgctgatttgttgcatgagaggagagtagatggggctgtgcccagtgggtgctcaggccaccgtgcgctttatgtggtcactgctcagctgggtcatctttgctgctccgttgtccttggctgtatgatccagccctacggggcttagcgggttttctccccgtgtgcggagatgagagattgtaataaataaaagcacaagacaaagagataaagagaaaacagctgggcccgggggaccactaccatcaagatgcggagaccggtagtggccccgaacagctgggctcgctgatatttattgcatacaagacaaggggcagggtaaggaaggtgaatcttctaactgattgacaaggtgaagcaagtcacgtgattacaggatagggggcccttcccttttaggtagcatatgtcaccattttcttttctgcacttaagatcaaagactttaagactttcactatttcttctaccattatctactacgaaattcaaagaggaaccaggagtacaggaggagcatgaaagtggacaaggagcatgaccactgaagcacagcaccacagggaggggtttaggcctctggatgactgcgggtagctctggataatatccagccttctacaagaagctggtggagcagagtgttccccgactcctccaagaaagggagactccctttcatggtctgctaagtaacaggtgccttcccagacattggcattgccacttgaccaaggatccctcaagcggcccttatgcgggcgtgacagaaggctcatctcttgccttctaggtcacttctcacaatgtcccttcagcacctgaccctatgcccgccagttattcctaggttatcttagtaatgcaacaaagagtaatattaaaagctaatgattaataatgtttataataatgattgataatttttcatgatcatctctatatctaatttgtattatgactattcttattctaactattttctttattatactaaaacagtttgtgccttcagtctcttgcctcggcacctgagtaatcctccacccacacttggcccttcagtagaaccttgtcccaccatgacctgtgatcacagggacttggatgtcacctatggcagtccctgcataccagggtccttgtggtatcaagagacaaattttcagatctttcaagctcttgccctcttcccagggctctttcctcattgtattttccatcttttctgcaatctttttaaaggaaccagattctgaaatttgccaagaggcagggtcccatagtttctcatcataggtaactttctgttggaactcctcttctgcactcctactcttcttcctgccctgagttgtagtaatcctagtgctggctccaatagaaactcatcaatttataaagcagagtctagtttagattcatatgtggttggaaaattggacccataagcctagggttatctttcctgaagagaaaaatatggttgtgtgctgcagtgtgcaggagagttggtgtggggggagggagggagggagggaggacacacaagcagccctggtgagaaaagctccagtggcactgatgtcagtgtgagatgatgttgttctgtagctgccacaaaaataaagcatttgtcctgaggctacattaataaagatattgcctctagaatagagtggttctctatgatcattccttcaactgacatttgtttctgctaggtatataactgtttttgcatttagaaagcatcattaaagtaaaaacagaaaaatttcgggccttgtggtgcatatgttctagatgcaagcttgtccaacccgcggctcgtgggctgcatgtggcccaggacaattttgaatgtgaggacttttttgcttatctgtggtgcacctgagtcccggagtgagtgcacccacctccctcagggtcaggagtgaatgctttaggaaccctccttttcagtgacctgaaaaagatagagggcacacttactgtgataacccagagtatcagtcaagggggcttgaccttcaaggagttatgggaaagcttaataaagggtggtgtcccagggtcagaaaagatgggcagacagcaagagcactgcttgatatctatgataagcatgtaagaattgaggagccctctccctctccctctccctctccctctccctctccctctgcctctccctctccctctgccacggtctccctctccctctctttccacggtctccctctgatgccgagccgaagctggactgtactgctgccatctcggctcactgcaacctccctgcccgattctcctgcctcagcctgccgagtgcctgcgattgcaggcgcgcgccgccacgcctgactggttttcatatttttttggtggagaaggggtttcgctgtgttggccgggctggtctccagctcctaaccgcgagcgatccgccagcctcggcctcccgaggtgccaggattgcagacggagtctcgttcactcagtgctcaatggtgcccaggctggagtgcagtggcgtgatctcggctcactacaacctccacctcccagccgcctgccttggcctcccaaagtgccaagattgcagcctctgcccggccgccaccctgtctgggatgtgaggagcccctctgcctgactgcccagtctggaaagtgaggagcatctctgcctggccgccatcccatctaggaagtgaggagcgtttctgcccggccgcccatcatctgagatgtggggagtgcctctgccccgccgccccatctgggatgtgaggagcgcctctgcccggccgtgaccccgtctgggaggtgaggagcgtctctgcccggccgccctgtctgagaagtgaggagcccctccgcccggcagccaccccgtctgggaagtgaggagcgtctccgcccggcagccacccactccgggagggagttggggggtcagccccccgcccagccagcctccccgtccgggaggtgaggggcgcctctgcccggccgcccctactgggaagtgaggagcccctctgcccggccagccgccccatccgggagggaggttggggggtcagccccccgcccggccagcctccccgtccgggaggtgaggggcgcctctgcccggccgcccctactgggaagtgaggagcccctctgcccggccagccgccccgtccgggagggaggtggggggggtcagccccccgcctggccagccgctccatccgggagggaggtgggggggtcagccccccgcccagccagccaccccgtccgggaggtgaggggcacctctgcccggctgcccctactgggaagtgaggagcccctctgcccggccaccaccccgtctgggaggtgtacccaacagctcattgagaacgggccatgatgacaatggcggtttagtggaatagaaaggggggaaaggtggggaaaagattgagaaatcggatggttgccctgtctgtgtagaaagaagtagacatgggagacttttcattttgttctgtactaaggaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaatgatcaataaaaaaaaaaaaaagaattgaggagcaagcttcacattcagaatccagtggctgaggaagtatccatatccctaagagaaagaaccttgggacaccatgactgttacatgctgggacaattccatcagcccttctgcaaaggagcctatagccatttaatcaggagatgggataagtgttaacattgggtgtgagctaacattgctgcccagattcccacagcaccattatgtccctatcacagtggggcttacagaggccagggaataaacctggacaaattatgccccacggtggaatcactgggtccataaatcctgtcctggttatctccccattctctgtaaaaaggattctctgtaaaaagattacatcgccctaaaccaggacctgagctcttggactgcggcggccatggcggctcagattacccagcgcaagtgggaggcggcccatgaggcggagcagcagacagcctacctggagggcaggtgcgtggagtggctccgcagatacctggagaacaggaaggagacactgcagcacacctgtaccagggaccacgggcgcctccctgatcgcctgtaatctcccgggctggcctcccacaaggatgggagacagatgggaccaacactagaatatcaccctccctctggtcctgagggagaagaatcctcctcagtttccagatcctgtaccagagagtgactctgaggttccacactgctctctgacacaattaagggataaaatctctgaggcaatgacgggaagacgcaattaagggataaaatctctgagggaatgacgggaacacgatccctcatttagtgatcccaagtcactaaatttgggagtagtttgttacacagcaatggataactaatgaagccctcttacatttccattattctctagaggttaactacatctgttttattttctcctattttgataatattagccacacataggtttctagtttctcaacacctattcttttctttattttagtttcttttctcctttgttccatcctttttttttcttttttcttttcttttctttttttttttttttttttttgagacaaagtctcgttctgtcgcccaggctggagtgcagtggctcgatctcggctcactgcaagctctgcctcccaggttcatgccattctcctgcctcagctttccaagtagctgggactacaggcacctgccaccatgcccggctaattttttgtatttttagtagagacagggtttcaccatgttagccaggatggtctctatctcctgacctcgtgatctgcctgcctcggcctcccaaagactgggattacaggcatgagccactgtgcctgacctcttccttccctttctccttccttctagccctccctccatctctttcttctctatttccattcaaactatcgccttccctccttctttctccctttccttcccctccccttccttcttttcttcttttgctttttcctccattcctccttctttctctctcttcctccattttttcctttttattatgaaattttcctaatatataaaataactctatgtgattgggctgtaagtaagcattttctgaatctatatgtcaaaaatataatgtcatgtatatgagaaacaagtaaacaacaggaagttattaacagagtctgaataaaaatgcctgctataattctacagccaagacagtggcttttaactcaattccttcaacacagtgttttcagaacacatcatcaacatcaagtattacacatttattgtaaaagtttaagtagccacaatcactttggaatttgtattatcattatctagtatggttaaagtccatacaacgtatcatccaaccaacccattcctaatcatccactctggggggctttcttgcctatgtgcacaggagacatgcacactaatatttatggcaaaaactggaatcagccacatatacatcaataggaaactagtgaaattgtggtataaccatatgtaagccttcagcagtaaaaatgaatgaatgacagtctcccacaccacagataactcctacacataatgtgcatcatgggaaaataaaggcagtaggaacttgctgtacaggaagcttaaaaaccagcaaaacaaactgatatttgttttggggatatatatatatacacacatacatatatatatgtgtgtgtgtatatatacacatacatatacacatatatacatatatgtgtatatatacacatatatacatatatggatacatatatgtgtatatatacacatatatacatatatggatacatatatgtgtatatatacacatatatacacatatatgtatatatatacacatatatacacatatatgtgtatatatatacttattgcacaaatctttgaagaaatacaaaggaataagtatcacaagactcagcatggagtcttctgctgagaccagctcggtcagggagatcctaacccagcggtgctagaggaattaaagacacacacacagaaatatagaggtgtgaagtgggaaatcaggggtctcacagccttcagagctgagccccaaacagagatttacccacatatttattacagtcattagcattgtttctataaatattaaattagttaaaatatcccttatgggaaacgaagggatgggccgaattaaaggaataggttgggctagttaactgcagcaggaacatgcccttaagacacagatcactcatgctattgtttgtggcttaagaatgcctttaagtggttttccaccctgggcgggccaggtgtcccttgccctcattcccgtaaacccacaaccttccagcttgggtgctagggccattatgaacatgttatggtgctgcagaaattttgtttatggccagtctcggggccagtttatgaccagattttgggggacttgctcccaacagtctccttctggaggatgactgggtagcagcccagggtagttttacagttttgtgttttacaccagtgctgggccccctggtagttacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagctatgtgacagagaggaccaggatgccatgaaaacggccttggctacatataggtcattcgatccttggctcactggcatctctctagattttcaataatacaatgttcaatatgctgtgcaaggtaatttcatcttgcaaagattctatgttacattttaccacacatacaactgaattaaacttttacagaattggaaatgcacatcactgatcaaaataaatgaaacatgaaaagagtaggaaggaatacccagtgatggaatagcaaatatgaatggaaacagaataggactgctaaaaagaaaaaaaattcagaagcacataatagcagtgctatttagaatcatagtggtgtccaaatcacttctatcacatctcattcaataccacaacaaaagatgttaagtgtgttatagaatgcccatcggatagccagtttttgaaaataacttgtctctcaattcgagctaaccatttcgggctacagcatcaagccaaaattattggcatcatgctaagctagatgtgttaactgaagtatgagattctcatttttgtaaatgaaaagcaatcagattaggcaatttttttctgcacagcaaaagaaactatcatcaatcagagtgaacagacatgctacagaatgggagaaaaattttgccatctgttcatctgacaaaagtctagtattcagaatccacaaagaacttaagcaaatttacatgaaaaaaaacttcattaaatagtggacaaagaacatgaacagacacttctaaagaagacatacatgtggccaacaaaaatatgaaaaagaaagctcccatcactgatcattagagaaatgcaaatcaaaacgacaaatgagataccattttatgccagtcagaatggcaattattaaatagtcaagaaacaacagatgctggcaaggttgcagagaaataggaatgcttttacactgttggtggaaaagtaaatggttaatccattgtggaagacagtgacagtgtggcgattcctcaaagatttagaaccagaaataccatttgacccagcaatcccattgcagggtatatacccaaaggaatataaatcattctattataaagacatatgcatgtttacattcatggcagcactattcacaatagcaaagacatggaatcaacccaaatgcccatcaatgatggtctggataaagaaaatatggtacatatacaccatggaatattatgcagccataaaaaggaaggagatcaagtcctttgcagggatatggatgaagctggaagccattatcctcagcaaactcacacaggaacagaaaaccaaacaccacatgttctcatatataactgggaactgagcaatgagaacacatggacacagggagaggaacaacacacactggggcctgttgggggagggtggtgatgggaggatcattagcaaaaatagctaatgcatgccagggttaatacctaggtgatgagttgacaggtgcagcaaaccaacatggcacacatttatgtaacaaacctgcacatcctacacacatgtaccctggaacttaaaaaaaaattaaattaaaagacaagcttaaagagttaatgaaaactaattagatacaagaagactttgattttcagaaacctgaaacaatagttataattttgcttttaacatatattcaaatcctttgatactgttcctttctagaggtgcagcttaattccctctcttgagtgtggcttggacttaatgaggcacttctgaaatggcctggttctgtgctcccacccaaatctcatcttgaattgttatgcaaattgtaatccctacctattgggggagggacctcatgggaggtgattggataatgggggcggtgcccccatgctgttctcctgatgctgagggaattctcatgagatctgatggttttataaggggcttttccctgcttcattgtgcatttctctctcctgtcaccacgtgaagaaggacgggtttgcttccacttctgccatgactgtaagtttcctggggcagccgcctcagtcatgcagaactgtgagtcaattaaacctctttcctttataaattacccagtctcaggtatttctttatggcagtgtgagaatggactaatacttctaacttatagaatagtgccaacataacagtttgtgactctgggtgtagaacataaaactaactgcggcttccaccttctctctctctctgaatctgggatcatgagctctgggggaagccagccactgtgccataagcagccctgcaggaaggtccacatgactgagaactgaggccttctgggaacagacaacaaggaaccaggccttttccaacagccatgtgactgatccatgtttcttgtgaattcccagccccagagaagccctcagatgctgcagcccctggctgacaactggagtgcaaccttgtgagcggccctgagcaggaagcactcagggaaacctctcctggattcctgacgattggaaactgtgggagatgagaaacatttgttgtttcgagctaagttttacgtaatttgttatgcaacagtaaataatatattttcacaagagaggatgtattattacacatcaaattgcatttgctctaaatgtgtcatcatcatcattattatttttgagacagggtcttgctctgtcacccaggctggaatgcagtggcatgatcaccatgcactgcagtgtcgaactcctggggtcaagggactctctgacctcagcctcctgagtagctgcgactaccatcatgaactaccatgcctggctaattttctaattttttgtatagatggaggttttgcccaggctgatcttgaacttctggagtcaacaaatctccattcctctgccttccacagtgctaggatgacagacgtgagccaccacacctggcctaaattaattataagatattaaacatgtaacttagttttaaaaagtaaggacaatttccatggctgaagaggatgtattttatgaccattcacaatgatcacgttacttgaacttcactttccaactgtgtcccaattaaacacaaaaggaagatccaacccttgctaggctgattctatgatggcctcaacaagcagctcctggtcagtcaccttcctccagttattcaaccaactctaatgtaggtgctgctgtgaagggatttagcagatataattaagggtctcaattagttgactttatgctgggtttatcctgcttggactgtcctaatcaggtgagcccttgaaaggactgggttcttcatgagcacagagacttacagtgtgagagggactcagcatgaggggttt

SEQ ID NO: 10833 - DNA, 13761 bp, Homo sapiens
gaagttgtcaatgatatgagctgatttaatatcctattggatatccagtatgtttagtatagtcttaagactatactatagaggtcaggggagttacaatagccctgagacaaatgataaatcaatgttttgaggatcccacatgaatgtgaatcactccatatccactttctaattggagtggaaagaaatgcagtcaccaaatccacagctgcatgctctgtgtccaagggtttattaatctgctctaccagtgatatccagacagcacaaaagctgcaattataactcctacttggccagacctggagtaatctagttcattctttaggcttcatcaggcttcttcagggacaggttgctggattacgtagagacaatagacagccccaacaccatcccacatccttcagctctgtaatggtgatgtgatccccacaatacttgaagtatcttacacaagacccaccctgggacacactatgatttttgatttggccaggatgggggcagtgtcagaggtttccctttggctttcagcacaatgaaagtccttactccacagactagggacccagggtgggggtaactccacttagcagtgcatcagtgtcaattatgcactcagggtataggaagataaccagggctgggtctatggatccagtagttccattgtgggccataatgtgtccaggtttactccctgagctccataagccccactgtgatgagagacatgatagtgctgtgggcatctgagcatcaatgtcagttcacacccagtgtcaataatccccccagttctgcctgtttcctttccccagtgtacaatctcctgagtaaatggctatatggtcctttgccgaaggactgagggaattgtcccagcatatacttccacggggttgcagagtattccgcctagagatatggactcttcctctgtcactgagatctgaatctgcatcttggctgaggtctaggcattgaggatgggatcatgattttgtattgagtcaaacaccttcaccctcctgcttctcaattcttgctttcttatcatagatatcaaccagctgcctgtcctaaccctgggacaccaccctctattatacttccccacattccctgcagcttgagtcctcttggcttctcctccgaggttgccatagtaaccgtgccctctggcttttgcaagtcactgccaccacttggtctttgtctcttcagggccacactctccccagtgatattagaaatgaaactctgggactatctttactaccatcacccccagcctacaaaggacaataccctgacacttcttagtgatgcaggtccctctcaccatcaagttcctgaggctctggtggaaggtgtgtcctctgggccctcttgtagagcatggttttggtaggccttcaccaagcccactcccctcagcttgttattccatcctctacatgttccagggcaactaagacatgtctaccttgttgagagttgggcatgtttttttctagactatgtggatacaccccagcagtgggtttactccacttatcaaagtcctggagtgtttgataaatccatgccctgagaaagtgtcttcaagccaaaggattatattcatccagcctgaaattctggttccttgatcaaacaccctcaaattccaatcccagaagtagtccctgggctcctatggggacgtgctggctagttcctgcaaacctcctgagtgggattcccgcggcatcataggggtgaggattgtgtagcatcttccagcagtgaaagtgggaaccattactagagaagggtgagcctcctctgcatgcccagaagatcctggagggcacgcatcgcataatcctgttccagtttgcagaatctcaggtttccccaccaaagccctgactttcctgtaacaggcctgccttggctgagtgtcaaacatctctggagcactgtggccctcatagtgatgtagagctaacattccttgctatctgcccttttgctacaggagataaagacctgtccatgagacactgccgagggtgtcaaatgtagccagtcatagctgtcaacaatccgcagattctcattatctttttacacagcatcgatgcagctgagaagtaactagccaaagccactgtctttgtaggtttcttccaaccctgtccttattatgcagggcattctatcactgcatgtgccatagcactccctaaccaaggcaacttctcagctcagcactggtgagacccccagctgctcagctgcaccttgtgccatggactttctgtgtctgccaccaacccgggtggcatcctcttggcctgccaggcagtgggaagcttatttcaaattcccatttttgcctgttttcatggatcacccttcatgccacttgtgttagttagggtcccctgagaagcggaccccaatacagtagtaaacatgtaaggatttattaggggaaatacttgtgagagaaattcatgagacagaaaatgctgggaaagccactggaccacaaagcaactctgagcctcagtgatgtagagagtgcaggaaggtcagctggaagcatcctagaccctgtgcaggctaagggaagttcagtaagggtggcagggagccctggagcttcagtcagccttcagaagaggaatgtcctgccttagtttctgccctactttcctcaatcattggctggaaaaagccaggggtgggcatagtctcagagcaaatgtggcaatagatttcagacttcaagagctggggccatcatcaattctgcttcttctagatgaggggctgggatgtgcattctcatgactgccacaatgatccagtggggagagaggaaaaaggttgacgataaagataaaaatggtattaattgatgaactgacacctttaagtagatgataagggatggcaattggggcaccagaagagggtctggctctggctgggagcagaagggttaacccacaacagtccctcacatggtaaaacgcctgacatgtggtgcagctgcaaatgcatgagcagacagtggtggaatctgtgaagttgtcttctaatgtgttcagttttctcagtgaagtgggaagcaaggtcatcagctgaagtaagaatggggaaggcaggttggatgtgtgagcacaaagaaaaagtgtgtaagagtcacccaggccaggaggaggctgagggtgagccatgcagggagagggtgattgctggccatggtagggacttcctatgtggtttggaatcctaaattttaagagaccagtcagcgtactgtgtgctgctctccagcctcctgcagctcatgggggcaggctcagcataggcagaggtggaacccaccagctgtgtagttttgccaggtgagtgtgacaattcaagggagagggaagggagggatggaaattatttaccatagaattcaaaatgggtgaggagggaggacaggacacccagggtgagggacagtgagtagatggcaggatcactggattgggaatcccaggagggtggaacgattgttggaattgatgtactacagggtagactccaagcgtggaaagcaagcacatatgcaatgagtggtccactgatattacatcacagcatatgataaaatgatagtatctgtgtcctcagagcctgtggccaccttgcaaggggatgagtggaaagatggtcagagagtgggaagtgtgagatagagagtatggaagggctggggttcttagccatgatgaggcctaggggataacaagggcatgagattcaggcagacaggagaagatcatggaggagaggagttccaggatctgagaggccaggaagcgagggcatcttctctgctgtgtgggtgtctattgctgccataaaaattaccacaaaccaaatggctttaaacagcacctatgtatcatggcacagtcgtgtggattgcaagtccacccagtctcatggggctaagatcaacatacgggaaggtctgcattcctttccatagactctggggaagaatccacttccaagctcattcaggttcttgcctgaattcacttccttgcagatagaaaagaggtttccacttccttgttaagagccacccttagctcctagagccttctctcagatactcacacacggtgcctaaggcacattcaatcctcctgcttggaacttctgacctcccctctccagcttctcctctgccttcctcctctgcagaatctgactccaaccagggcaggctctctgcttttaatggctcttgtgatttgattgggcccacacagagagtccagcagaatctccctattttaaggtccttaatcttcattacatgagtaatatcccttttgccacgcaatgcaacctgttcacaggttccaacgattaagactggacatctttggggaccattactcagcccaccacatctgcgtatgttgaagtcaccaagagtcaaggagacagcaatgctggagagggtgacagtgaaccaggagctacaagactcaggattgagaagaacagcctggggcccacagggaatggttacagtgaggcaaatggggctctaatctgatgacagcctaggggttttagggaggagggaggcagaaagttctgagaaccacaatgaggagcaaggaccccacctcacctctgaacccaggggtacaagtccctggggaaactcccccatgtgggaggacttcggagggggtcatgtcctcagggagacccaggttgctgctggagctgcgagatgcaggaacatcctgagagaggctgaggaggttttgctgatgtggactgagaaatccagggggtgcactgggaagatttctgtggctggggaggtcggggagacagaatagaggtgtgcagagccttgtggggatgcaagtgcagagtatgtgggggacccagtgtgactgacacaaacagggacagagcatgatgagctcagtccaggtgcactccaggccgacgatggtgctgagcctgtgggagatgcgggaggaggagcaggggtggctttcacctgggctctgtccatggaggtgaggacagtgaggtggttgggtcttagtgctgtggggaacttttcttgacctcctgatgactggatggagtgtctgagggaggaagggtcttacaggattgactcatgaccctgagggatgtgctcactccaggtctcaggtctgtcctgacacctttatttgtggcttagagctccctactgtaaattattgggagttagttcattttggagtttataacttaaagcagaaattcagatggttgaaatgtcattttcatgaaggtttgttattagtgtatcatttagattgttttgcaaaagtctcattttttttctaaagggttgccaatcttgttttaaatttacaaaggttgttaatttatcttcactgttaattggttgtgggttgtttaaacttatactgtgtagttttacatatctgtaacagcagtagtttgggcctcttatattctaataattaagactttcagctgagtacacactgtaattcaagcacgagtcatgcataaccctagcactaagagacaagaggggaatccctctctctgaaaattttgcaaaattctgggttctttttccactgagtgggcacaagtcggctaatcatgaacatgaggtatttgtcctcatttaaaggtgcttcagaagcactgacccctaggaaggcctccttgtctgggtcaggcaccctacaccatggcagaggccatcttccctcccagtgtacagtgatatcccagatagcttactggttagctgctgtccactcttgggcagttttgtcttctaaaacatgggtttttatctgagaatcttcctgttcccagatgatcaaaactggggccatccattccattctgagccacttctgcccaggggcccatggctatttcctccagtcacaacagaacaccccttcagaacagcctgcaggaaggcaccgtctcctcacaggctcacacatgcacggtgtgtgcacagagcttttgctctagttcaggaggtgtgtrgggagcctcactagtccaacagagcttggtaccagtgtcatatgccaggaaccaaggttataagggatacaatgtccccagacctaccagagaaggcaaactcatacagcttgcaggaccagacaaggacaagaaacaagttcaaaagagggaaagggaaactacagacgtacctcagagatactgcagatttggtttcagaccatggcaacaaacaagtcacacaaatttttgtttttccagtacatataaaagttatattcacactctactgtagcctattaagtatacaatagcattatgtatgaaagaactatgtacataccttaatttaaaattactctattgctaaaaaatgctaacggtcgtctgaggcttcagctaattttaatctttttgctgggcagggtcttgcctcaatgttgatgactgccggctgttcaagagggtggttgctaaaggctgctgtggcaatttcttaaaataagacaatgaagtttatggcatggattataaagggggaatcagtacttaagtaaggtcaatatgagttttcaagtcaggtggacttgaatatgaaccctccaggcctttccaccaactagctatagagccttgggcacatctggcccagagctggccccgacagacacttkcccagtgggtgagtgctcaatgaacccatctgagccaattgtctcatccaaccagtgatataattccttccttgcagaagaataagtgagaaaagacacagtgccaagaaattcagacacaagacctgcggaagtctgcgccagtgctctaaagcaagttctgcctaaagcggcagaaacatttttcacattaggaacaggagttgtttgggatcctgtctggggccaggttgagagcagagtgggagtgggggcctgggcaggaccaggcactggagtgaagacaggcctggagagagctgactcctggaggctgctgagcggctcagacagctccttgcctcacctgccacagtcctccctctcccctggcctccaagtacccgggagtgcgagcctgggccccgggaaccggcaccttgagggctggagagggaccccgcccgctccctgtctccctgacgcgctctctccgcctccccgcggggacccagcctcccgggctccctcctgcctaccgcccggccctggagccgcttacctgggagcttcttacggtgtagggggagctggggaggggacagagggacagggaccacgggagggtggcgtggggcggcgtacttggagatatgacctgaggagtctgcagaccccagaccggggcagaagagccgtgggaggagctgctgagctctccaggccgccctttacctcctgcctccccagcccagttcatcttgatcctctcctcactagcccaggtctccccaaggtcagggctcatagagcagcaggagttgggttccgggacgcgggatccggcttctctgggaatcttggattccaggaaggatcctggagatctcccactttatgaagcccaatctccactcactstgatggcgtctttagaccccactggaaaccagatacgacgccctcatcggccctggggaaaaaacaagagcaaagtatgagaggtggccatgaggtcagggaaactcctgcagaattctcaggaaaggaaactcttccgagctgggcccttggcttagtttgtcttccctgcccagccacctgtcccagagctggagacgcccaggtttaagccagagactttggatactttccttgatggtgacataatttttgtcttcttctctcctggaagagaagccccagaaccatcagagtgatccagtctgcccactcttcttattattctgtctctccaatcactctccctgagctggactctccacccaccctcacattctggatagtgcagagatgtgagcatggccctggggcaggattgtctgcgtgcaagcccagctccaccacgacttgtaggcgaccttctttcctattgtatcacctgaaaacggaaaattagcaggcacaccccatagttgtatagtgacaattaaatgaattcatattttgaaagtgctaaggacacagattaacacatagcaccatgacagtgtatgatattatcgctgttggttttttttttttttttttttagatggagttttgctctcgttgcccatgctggagtgcagtggcaccatctcggctcactgcaacctccacctcctgagttcaagcgattctcctgcctcagcctccagagtagctgagattacaggcgcccgctactacgcccagctaattttttgtatttttagtagaaacggagtttccccatgttgggcagtctggtcttgaactcctgacctcaggtgatccaccctcttcggcctcccaaagtgctgggattacaggtgtgagccaccatgccccgccgttgttgctatttctttcatcctttttgcttgagcctcttctcttctttctaggttcccagggaaattctctgttggaagattatgcctgcaagaggcctccacctgggaaatgctggcccatggggggatctcccttttattaaatggaatgattgttggtgaagtgacagctagtgagccagtgacagtacggttcatgtaaaaaagaccacatacctaggattacctccattttaataaagacacatcccacacattataagtccaatgtgatttgtgaggagattgctttgatttgctcacgaaaaatattactctactttctttgagagagttttgcaacacatttcaaatctctgcttctcatttcacactatctggctcatgagtgaaggtgataagtgtcgtactatgctctcaggtttgtctgtcagagtcatagtcatgtattacacataaagattattttcttgttatcatttatttatatatattatactcatgggatatagatagatattattacagtgcttaaatggctactactgatatctatacattttctctcttggtatatgatattaacacatagaattgtatactgttactttggtttccagcaattgctgattaggtcatttggaccacttctcccattgagtacaactggaaaaatgggaggaaaatacatatttgaaaagtctggttgaatttatagatgggctagcaaagcagtgaagatttgcttggccaggaaccaggaagaggcagaaatccagaagagcatcttgagctatggggctgcttttttggatcagatgcagtgacacctgcctcccaggcaagaagccaacttctgggattcagaactaaagtgtcccaatatttagaaggtctcttggtctctctagagttcagtgctcattggccagggctatgatactcacactcattccttggaggagccaagcttcgggtttggctgcctctgggacatttcatgctagaaaaaccccaacatgtgtagataaatggtatagaggacaccagccacccttcgatggagctctgcccagtagtgtcccctcacttccactcagagacaacatgcccatttcactaaattcatgaggacatggccaacataagtaagagaacaccgggaggtaccttggacagagttccatgcagtcacagcttttgcgtctctgtgtcttttcccttcatctcaaccagagagcatttgccgaggccgaagaacaaaaaacttcaaatattggagcggaatctaagaccactgatccattgtgatcaggaggctggagccatgtggtccaggaataatgaagtctgtgaggccttggtcaccccaaggctctctcccattaggagctgcctctcactgctatcagggaggacccaggagctggacatggctttttttttttttttttttcatttctgatgagaacctggagaggtcccagagcatatagaccttgattgaaatggggccagagtggagtcaggcaaaaaactctaatgactcagaggcacctaagtataaaataaaatctcaactcagagcttccatcagagcatcaggctcagtatctcctgtgtttgcactgtgagtactggagcttgatgagaagaaaaatagctacatgtgcagaaaaacatatgtagttagaaagctgggtcatggttcaaggtaagagggacccttgtcttttccgtggtagatagtggggctttctgccatcttagttctgatggaccaagtgcagaagataaactttcctgctttcagcttagtgactggtaatagaagctggagttaagagaatcagtggcagcctctctctccatgccccagcccagtaaatctaagccaggacttggggctctggcactttcttctcactgtgcgtcctccttctctggctcaaaagagaaccacatgtaacagaaaccaagggctacaattctcatagaacccagaaaactggactaggggcctagagagtcatgtgcctgccattgttccaccgcttacgtgctgtgtgacctcaggagaagctctctgctctttgaatcatctgtgaatcatggacaaacacctccatgctagcaacattactgaaatgcagggaggaacaagtgattcaattgggaggaaaaaaagcaaagtgatgacatttactcctagacaaaactttttaggaaaatgtatcttaaaagtaggagaaaaacatataatacctgcaatcccctgcaaaagaagcctctttagcttactacttgttcatcgtctttctgtgaaatttgggcaaaactagctccctcattatctcaaataaattaatgcagttggcgattctatgtcagtttaggtctacaacttttgctttgtgtgaaactgaaagggaatgggaacatcttcatttttctgtggtggccaggggacactcagaggcttggaaatgaccctatatcatctattttcaattgcctcactctatcttttgaaatctcaggtaattcatactcctaaaaaaatctcatgttcatacataggacaaggtagaaaaggtaatattcctgttttaatttgctagggctgccataacaaagtaccaaaggctgggtgacttaaataataaatatgtgttgtctcacagttccagaggccacaggtgcaaggtcaaggtgctgcagggttgatctcttctgaggcctctttcctttgcttgtagatggccacttcttctgccttctcaacatagggcttcaacatgtggattttggtggcgtaggaacacaattcctcttgtaacagtctggatcgtctttgacaatggatgttctaaaaaataaaagagagtaatagacagtacaaccctttggctgaaatctttctcttggttttctaaaattttggtcttgcaatagaaaaaacaagaaagagaaccaaagtttagttcttcccggaaggtgaggcctcctccctaagtctgtgtaatcccagacactaagacatggtgctgtgcagttctccaaagtcctactcactccagtgattctgtttctgtctttttaactgagcagaagagtctctttcaggagagcaacttcttctgatgctttatgggctttattctccttaaacttatggaatgaaaaagatcttaataaaaaggaaaatatttgccaaatttttatcatgctcataatttttgtacctttttaaatgccccatattgtgttgtttattttttaaattttttaaaattggtacataatatttgtacatatttatgggatacatgtgacattttgatacatgcatagaatgtgtgtatcagtcaagatatttagggtatccatgacctcaagcatttatcatttctttctgttgagaacattttaaattcactcttttttgttttgttttgttttttgagatggagtctcacaccatcacccagactggagtgcagtggcacgatctcggctcactgcaagcttcgcctcccgggttcacaccattctcctgcctcagcctcccgagtagctgggactacaggcacccaccaccacgcccggctaatttttttttttttttttgtatttttagtagagacggggtttcaccatgttagccaggatggtctcgatctcctgacctcatgatccaccctcctcggcctcccaaagtgctgggatcacaggcatgagccaccacgcccagccaaatccactcttatagctattttgaaatatacatttttgttaactttagtcagtctgctgtgctatcaaacattagaacttattttctctatataattggacatttgcatccattaacctgcatctctatattttcccacccctacattcttcccagtttctgggaactgtcattctactctctctacctccctaagattaacctttttggctcgcacatattagtgacaacatgtggtatttgtctttccttgcttggcttatttcacctaacgtaatgacctttggttacatccatgtttctgcaactgacaggatttcattcttttttatggctgaattgcattccattgtgtatatatataccaccatttattcattcacccattgatgaattcacccattgatttcataacttcgctactgtgaatagtgcttcaataaacctgggggtgcaggtagtcttttgatatattgatttcttttcctttatataaatacccatgagtggagttgttggatccaatagtagttctattttttgttttttgagaaatcattatactgatttccataattgctgtacttactttcccaagagtgtacaacagttcccatttctccacatgctcaccactatccattattttttatttcctattagtagccattctaaataggataagatgatatttcattatagttttgatttgcattttcctgatatttaataaggttgagtgtttttcgtatacctgttgaccatttgtatgtctccttttgagaaacatctattcagacactttgtccattttttaattggattatttgtgtttttactgctgagttttttaagttccttgtatattctagatgttagttccttgctggatgaatacatagcaaatattttctctattcaacaggttgcctcttcattctgttgattgtttcatttgctgtgctgaagctatttagtttaatatagtcccacttgtctattttatttttgttgcctgtgcttttgaggtcttagccataaagtctttgcctagacccatgtctggagtgtttcctgtaagcattcttctagtagttttatagttttgggacttacatttaaatctttaatccattttgagttgatttctgtatatggtgagagacggttctagtggtattcttctgcatctggtagcattttcccagctccatttattctccattgttgcttttgttctttctccattgtatattctcagttcctttaccaaaaatgagttggctatcaatgcatggatttattgtgagttctcttttgtattccattagtctatgtgtctgtttttatgctagcaccatgctgatttggttactataactttatattgtatcctgaattc

SEQ ID NO: 10834 - DNA, 28591 bp, Homo sapiens
  misc_feature (1)...(28591): n = A,T,C or G, or insertion/deletion polymorphism (see Tables 1-2)
tgatcgtgccactgtactccagcctgggcaacagagtgagaactgtctcaaaaataaataggccaggcacagtggctcatgcctgtaatctcaacactttgggaggccaaggcgggcagatcacctgaggtcaggagtttgagaccagcctggccaacatggtgaaaccctgtttctactaaaaatacaaaaattagctgggcgtagtggcgcatgcctgtaatcccagctactcaggaagcagaggcaggagaatcgcttgaactcaggaggcggagattgcagtgggccgagatcacaccactgcattccagtctgggcaacgagagggagactccgtctcaaaaattgaataaataaataaataaaagtaatgaggggactgggcatgatggctcacacctgtaatcccagtgctttgggaggccaaggcaggaggattgcttgagtccaggagttccagaccagcctgggcaacatggcaagacatcatttctgcaagaaattaaaaaattagcccagtgagtggagtgcatctatagtaccagctactcagaaggctgaggcaggaggaccacttgagcccaggaggttgagactgcaatgagttatgattgtgccactgcactttagcctgggtgacagagtgagaccctgtcttaaaaaaaaaaaaaagtaatgagggtggggaggagtggaaagggagtgggaaagtgggacccaagcacatgagtggaaccaagctaagtctcatggagggctggggtactgacaccttcatatttgtccaccgttggttaaggcctgggggcgggctgggggagtgggagggtggtggcatgtgaggatgtgggagagaaaaatttccaagtgcttccagctctctgcccctggaaaaggtcccagcagaggcataggcggggctgttgggagtgatttagcactctgggagtccgtaggcacaaaaatggtaaaggggttcaagaagaaatgcgtagaacacagtccctgccccacaaggttcatggcctgggaagggaagacagacatgaataaatcattgccatagggtgactggggtgaagggcgttgggggtcgggtggggtgcgggaaggagtggtgtaggcagaggcatccctgaggagaaatgcagctggtttgggagaggacggccattccagacatagggaacagcacacacgaaggctgatgcacatacgcgcaagggctggtccctagagctggtggttctggccacgagagctcatcacctgggggcagcttctgtacctgcaccctgtatgaggctccgggtctgcccttcctggtccatcctccagacacactgcctgttcttctctcaggtcccgctccgggccctcctcccagaagcctcccctgactagtccagctcaccgtgactcttctgaactcacggcgtttactgccaaggctattacgttggcgctcgctcatgtcattattaggaaatatgcatttttactgtctttgatgttatttaaacttgcctgtaaattctgtctctctcaattttaagttctgagtagaaactacatatttttattatttatattcttatattctcccatggcacccggcattcgtggacacattgaggaagtaagataatgaatgaatgaatgggtgaatccagtccagcttggggcctatttaattctactaggctcaacctacaattcttatgtgttctcagattattcctaaaccctaagcttagttttgtttcattcggaccacatgtagtttttttttgttttttgttttctgagacggggtcttgctctgtcgcccaggctgcagtgcagtggcacgatcttggctcaccgcaacctctgcctcccaggttcaatggattctcctgcctcagcctcctgagaagctgggattacaggcgcccgccaccatgcccagctaatttttttgtatttttagtagagacagggattcaccatgttggtgaggctggtctcgaactcctgacctcaggtaatccacccgcctcagcctcccaaagtgctaggattacaggtgtgagccaccacgcctgatctcatgtgtagttttttggttttttatttgtttgtttttttgagatggagtctcgctctgtcgcccaggctggagtgcagtggcacaatctcggctcactgcaagctccacctcccaggttcacgccattctcctgtctcagcctcccgagtagctgggactacaggcgccggccaccatgcccagctaattttttttgtattttttagtagagactgggtttcaccatgttagccaggatggtctcgatctcctgacctcgtgattcgcccgccttggcctcccgaagtgctgggattacaggcgtgagccaccgcgcccggcctctcatatgtagtttttaatgagagttaccacataagcaaactgggttctaagtggtgaaatttaaggttatgcaacctcagtttcttttaacccctcttcatccctaaccctggtcggatacttgattgacagtagaccattgggatctctgagctcctgtccttctaacctgattgcctctttaaaggattttgaaaaactatgtcccttgcacatttgtattgttttgagacacggtctcactctgttgcccagactggagtgcagtggtgccatcttggctcactacagcctcaacctcccagggtcaagcaatcttcccacctcagcctcctgagtagctgggactacaggtgcgggccaccacatctggctaatttcttaaattttctgtagaaacagttttgccatgttgcctaggctggtctcaaactcctggccacaagcaatccacccgattcggcctcccgaagtgctggtattacaggcatgagccacctcgcccagccccttgcacatttttaagtcaacatttaacatttgtaataatttaatagcattccaaagggtaggcttttcagggaattgcaaatacatgttaaaaatcacatcactatttatgtatttatttatttatttattatttttgagatggagtctcactctgtctcccaggctggagtgcagtggtgcgatctcggctcactgcaacctctgcctcccaggttcaagcaatcctcatgccctagcttcccgagtagctgggatgcccagctaagttttttgtatttttagtagagacagagtttcaccattgtccaggctggtcttgaattgctgacctcaagtgatctgcctacctcagcctcccaaatgctgggattacagtcgtgagccaccatgcctggccatgtcagtttttaaaattaaaaacaatttgttgtgctcagtctgtcggagactgcacgtcactctaagtgtagcaaattgaatataatgccatagaactttcatatctgttagcatccttttaaaaaatacgtgaacaagcccttgaacaagtgttagaaacagttattctatttgtattgcaattattgcagttaaccaaaactaggaatattcacaaggattaaacataaaaagttggtcaggcgcggtggctcgtgcctgtaatctcagcactttgggaggccaagatgggccgatcacttgagctctggagtttgagacaagcccgggcaacacggtaaaaccccatctctaaaaacgaaacaaaactaaactaaacaaatacaaaaaattagtcaggggtggtgcacctgtagtctcagctacgccagaggctgagataggaggattgcttgagcccaggaggttgaagctatacgagccatgatcgtgccactgcactccagcctggatgacagatggagaccctgtctcaaacaaacacacaaaaagacatgaaaagtaacttattgaaaatgcatctcttggccaggcgtggtggtttacacctgtaatcctagcactttgggaggccaaggcaagcagatcccatgagatcaggaattcgagaccagcctggccaacatggcaaaatcccatctctactaaaaatagaaaacttatctgggtgtggtggcacacacctgtaatcccagctactcgggaggttgaggcaggagaatcacttgaatccaggaggcgaagcttgcagtgagctgatatctgtcgtgccactgcactccagcctgggcgacagagagataatacgtctcaaaaaaaaaaaaaaagaaaagaaagaaaatgaatctcttaatgagatgggaaaggttgatttgtttcctattgacctttggcggctctgggaagggcactctggtcaggcccaggacaagcaggagattcattctagcggggggcacatattaatctggaaactgattcccttaaaactggtcctgccgacacacccctgggaaggtttgcatataccactaggggtatccaagccataggccattaaacagagatgaaacttgccttcccattctttaatatagtgttctcagaaagggagaaatgtgggcctgaatgttattgtgacttgcatagtgacatttccaaccctcctcctgctaagccccagagccttacatgctggacatgggcaagataggaactcaagttacttccaggtctccgtaagtttaggactgtgaagagggcatcctaatagtcaaaaacataagtgttggccgggcacggtggctcacgcctgtaatcccagccctttgggaggccgaggcggggagatcacgatgtcaggagttcgagaccagcctggccaacatggtgaaaccccatctctactaaaatacaaaaattagccgggcatggtggtgcgcacctgtaatcccagctactcagaaggctgaggcaggagaatggcttgaacccgggagccggaggttgcagtgagccgagatcgtgccattgcactccagcctgggcatagagtgagactccatctaaaaaaaaaagaaagaaaaagaagaaagaagccgggcgctgtggctcacgcgtgtaatcccagcactttgggaggcccaggcgggcagatcacgaggtcaggagatcgagaccactctggctaacacggtgaaaccccgcctctactaaaaaatacaaaaaattagcctggcgtggtggcgggcgcctgtagtcccagctactcgggaggctgaggcagaatagcgtgaacccgggaggcggagcttgcagtgagccgagatcgtgccactgtactccagcctgggcgacagagcgagacttcgtctcaaaaaaagaaaaaaacaaataaataaaaataaatgaaaaagaccctaagtgttagttaaagcagcagcctagattcagaattaagaaaacatgatttttatttttccgtttcatggaagcagcagctgtctactgatagttcctgccgccggccaccaggtggcagaagggaacacagtaccatagccctgccccagcgatcgcgcgggcaggaagaccgggtgggaggtaggtggggccgaggcctggaggcgaggtaggagagtaggcttaggctgtcagaggaaaaaacgggcgatgtgaggactaagtatggatctcaggaggggacaggaaatattgagaacaccaccttacgggttcagaataaaaccgagggaatgaggaagaggtttaaggagataggctaaattgggaagaattcacggggaatcagagggtggagagggcgtgggtgcctggagatgcctgggaacagaacggctgaggggactccattatctgtactcttcccggggtgggtctaggtctggctcctcctgaggtcggttgtccacctcaggggcaggaggccaggggttttctgggggctggggtcctgccggccaagggtcgtcaggccggggaggttgaggaggatccgttctaggcggttcagggggccagactccagtttcaggcaggtctctccagggacgactggggcgggtaggcggaggatcttcaaagagagggggtgcccctggccaagggtcaccggggactggggggccctgaggcaatgttggggagcctgcctcctctcggtcctctgcgggtgggtgagaggggtggccctcgctgcctgagatgcctgtaaaggaggaaggagaaaggtaagaggtggtgagggcttctctccccagccccacccagccccagccccaggaggaggagcctgtctggatggacgcagcctgaactgacccacaaacagaccaaaaaagtcactctcaaagagctctcggtaggtttgtaaatacttaactgatggtaaartgtcatgaacccctacccccgatggatctgaaccgttcacttgacccactttaaactgaccagacttctccaaataagctccatccacccctggttggggtaccccactagctttgtcctcaggccaacctgcaacccaargtgggttacaccttggcccccaggcacacagaccccagctttacaaggaccccagctccttaacacagatcccagctccraggaaactcgtcccccccacgttaatcctgaccgactttgccacatggagccagcaaaccatttctggtgagagccaaatgcaccttctgcaccatgtcccccacccaatgtgtccwgaaagccatttctggtgagccagatgcaccttctgcrtcccctgaattcctgtccccaaccccatgcgtccagttcacctccgccatcttgagtatccctcatcaccccaaactgcagtccctgcctctgttcccacctcacctctggtgtgcaggcaaaggaccaggatccccaggagcttccagttgaggatcatggctatgtactggcccccaaagctggggtgggctgagtctgggtgcctgggaaccccaagaggctttataggggaggagtggaggagggrccagcccagtggcacaggaataccatcagaacagaactggtcaaacccgttgggaaggcctgggctgatgtgtcacccctgaaggtggcgtcccttattttagtcctccagcccaggacccagctgcctgctctcccyatcatgacccagagcctgcgtcaccccaccctggttttcacaccctccatccacaycctggagcagtcaatacccacttggcatctccgtaatcacagagatgtccaccttcatcccttgcaactattggaagccaaagaatgggagcaaaccacrcgaygggcgttgggaascaccrtaattacagggttgggaggcaggatgcctgcgctgrgggaggaggtgcytttcaaacctgggatgcagctgggacagtgtcagctactaccccagcctccccactcayccccgcactgaaagctccccctggggcttcgtgctttcctgggcacttcccttcccccatgggatccaggcatcctgctctccaccatgtccttcttcaggcatncaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaaygtttccctcaaggacctttctgcctggaagtctgttagcctttcagaagtaacatgtccaaaataaaatttgattcctcccaggttgttccctgcctggtccgctaccccacagtaaggaacaccttattatgcaatggcgtgatctcatctgttccctccagggctcacgcagaaaccttcgttacaytcctccaccatccacctgcaagcccctccacaccctgtccaaacccagcccatcatcctgagccaccatctcccctgagcctccccaacacccttctaattggcccccttgctcccactgtttatccctccccctcacacaaagcctgtcctccaccagcaaaagaggtcttaaaatatacatcacgcgggcctggtgtggtggctygcgcctgtaatcccagcactttgggaggccgaagcgggcrgatcacctgaggtcgggagttcaagaccagcctgaccaacatggagaaaccccgtctctactaaaaatacaaaaatattagccggacatggtggcacatgcctcttggtaatcccagctactcaagaggctgaggcaggagaatcgcttgaacccaggaggcagaggttgtggtgagctgagatcacaccattgcactccagcctgggcaacgagtgaaattccgtctcaaaaaaaaaaaaaacatatatatatatatcaggccaggcgtagtggctcatgccagcactttgggaagctgacacaggaggaccacttgagctcaggagttgtgtgcgctgcttcacctgcagcaagactgtgggcaacacgtgggaggcctacctggggctgctgcagtccaagtacgctgatggggacgccctgggcctgaagcrccacagccgctgcctgccgcatgctgctggcccacgtggacctgatgcggaaactgctcaattatgccctcctggggaagtgacctggttagacccacccatctgctgcgctgggtgccgggagcaatcgctgaccacagtgcgtggatatgtgtacctcactctggaagggaccatccagtaagtccctcaggaaaaaaaatgtacaccaaatcatgttgcgtcttccctttgtttggggagtgaggacaggttctcgctctcttaggctggggtgcagtggtgcgatcacagctcattgcagcctcaacctcttgggctcaaacaatcctcccaactcagcctctggagtaactaggaccatgggtgcacgccaccatgccctccaatgttttttatttttattttttatatagatggagtctccctatgttggctggtctcaaactcctgggctcaagcgatccgctcacctcggcctcccaaaaaagtgctgggattcagctactccggaggctgaggcaggagaattgcttgaacctgggaggtggaggttgcagtgagctgagattgtgccactgcactccagcctggcaacaagagcaaaactgtctcaaaaaaaaaaaagtgctgggattacaggcgggagccacaacaccgggcccccttccctgttttttttttttttttttaattcttcttctttttttgaggctgagtctcgctctgtcacccaggctggagtgcagtggcatgatcacggctcactgcaacctccacctcccgtgtccaagcaattctcctgtgtcagcctcctgagtagctgggactacaggctcacaccaccacaccyggctaattttttgtattttagtagagacgaagtttcaccatgttgcccaggctggtctcaaactcctgagctcaggtgatccgcgtgcctcagcctcccaaagtgtcaggattacaggcgtgagccaccacacctggctttcttccccgtttttaaagaagtactccaatggctttctattgacttacagtaaaatccaaacttggccacatctcggcctcgcagcagcatccttgagcattctctacagagacctcctggcctccacaggagcccacttcaggcaggcctctgcacaaggtcccctgctcagaggcctctccccagagtcagtttctatcatatcatcrtactgtactttctcttcaagcacttatttgaaacgatctcgttcatctgtttaggtcccatctgctcgctckctctcccactaggatgtaggctctcagggtccaagtggcccccaggctaatacagtgcctggcattgacattcctgttgaacgagtgaatgtttcatcttccccactcctagcatttatcatcttccagaagaaaagagttttaaaacaaaagttgagaataaagaaaagcaggagcttcccaaacatttccaaagctgcctagaaaaaggatttgaaaaggtgccacccatagagagagctatgggtgggaccacttctcacaatctccaagagagatggctgcagggagaattcccacagattcccagaaataacatttccaaacaatggctccttctgtagtcrtctttatttagagcagaattcagactcagctggtatcccccagggcaaccccaggatggggaagggctggtctgtccccacccacttctccaggatcctcccagcccccaggctggctttccctccaactgtcagctgcttagctgctcatctggggattgsagctggagcatctgtcaaggttgtctccttgacaaacagcttcctctttggaaatggcttcactcaggtcctgcaggtcatcgagcaggacagagagggaccctgggaaggaagacagcagatgagcaccagacaagggaaggtgctcgtggttacagaggaaacagggctggcacaggaaatgaggaatgggagagaggaggctctttggtccaagctgggcatcgctaaaagaggctaagggcctcgaaggaccgcagagaacaacactcatcatgcgagagtctgaagaggagattcctgaagtgcgcgcatttgtcccttgtccctttgtgcttggcccaagaccttttatggactccctggtgggcactgctgctgctacaggtgcagawgctgaacactctggaggcctggggctggacaccacagatttcttcttatccagtagggaaggaagaactgtcaacagtcgctgctgcttgtaacgggagaggagaccttcctgctgcaaggtggcctgggaaggagagggttaaacctagcccggatagagcctccctcaccatcctctttcyacacctctagcccaggaaccagcccaggatgggccctagtgtctgcctgtctgccctcctgtctcctaccagcatgaggttcttatccctctctagctcctgcaagcgccgggccagtcgcwgcccctcctccttccgggcctcctcctgcagacrcctgagttcctggctccgctccttttcctgggcggctctgcgctgaatmtggcgyaaggagaccactacagagaggccaaggcacagaggaggcaggtgtgagtcaggccagaggcagccaggcaccatgaagacaggaacaaacgctgggtcaccaactctgtggcttggggaggctgttctgctctgtggatctgtctcttctgtacagttggaggggtgggctgatgctctaggagcctgggaatctgaacctaagtatcttcctcatccctgaaccatcctggagttcctcaggggaaatctgaacatgaactgggttagattttgtgcaattagtgttcactgtcttaaagtgtgatgattgcagctatataggagaatttactggctttgggagatgcggctgaacaacttatgtttacaacttacttaggcgtggtggctcacgcctataatcccagcactttgggatgccaargcgggcggatcacgaggtcaggagctcgagaccatcctggccaacatggtgtaatcccgtctctactgmaaatacaaaaactagctgggcatggtggtgggcgcctgtaatcccagctacttgggaggctgagccaggagaatggcttgaacccgggaggcagaggtcacagtgagccaagatcatgccactgcactccagctggtgacagaggaagactctgtctcaaacaacaacaacaacaaaacattaaatgattacaacttaaagtgattcaaaagatgtacaaatatgtgtgtatatagataagagaccaaatgtggcaaatgttaactgctatatttagttagagaagatacattcattacacaattctttttttgacacatggtctttctctatcacccaggcttgagtgcagtggcacaatcttggctcactgcagcctcgacctcccgggttcatgtartcttcccacatcagcctcacaagtaagcttggkgtacaggtgcccaccaccaggcctagctaatttttgtatttttagtcgagacagggtttcgccatgttgtccaggctggcctcaaactcctgacctcaggtgatacacccacctcggcctcccaaagtgcttggattacaggcataagccaccgcgaccggccatatgctgtttcttaatctggtgctggctacatgggtgtgttcacgatgtgataattcatctgtgctactcctggataccttyattacttcctgtaatgaagctttgaacacactttgaggggaaaataataaccttatgtcttaacacttccttcttcctggaaggccctatccaccctggcaaggctcaccggccttggcatgctccctcygagcctcgttcagcctcctctctgtgtctgagagttgctcccgcagccgagtttccacttcagccaccttttcttgcagggctggggtgaaagtgcagacggggcatatcagcaggasctttgattcgcagttcccaccccaccctccaagggaagcacccatttccctctcgacaccttgcccgtagagttcctgctgctgggtcagctcctgccgcagactggcagcctcctctgtgctctcctgctggcmctggcgtgctacctccagctgcagccccaagctagccagggactcctgggtctgctgcagctcctgctccagctgctgggccaccytgctcagctgctgccgctctgcctcccctaaaaggagggggtgctgggtcaggcctctcccagcaccctagacactgggtttttcctcatcctctccaccctctggcaaccaggtgtaccttgctcccgagcccggcccacctcctgctggatgaggcgggcactcagctgcagttctgcatccaggcggttccgttcttcccgcarctgctgcaactcaaggctcacrtctgtgaccggtggtggtaggggacagctgrgacggggaagagaaagagtcagragaaatmacccagctgcctgatcccaaagcccccatcccacctcagtcctcatggttttgggggtcccagcagccaatgccctaaagccccatccacctcaaagtgcmcaaacttcacctctcctggcgcagctgagcaagggcaagctttcgagcaatcaggcctggrrgggaaaaagcagggagaaaaagagatgaagtttgcatgggagaaagtggrgacagggagtaagggaaaaagagatgcaaggactggtgaaaggaggaaggtgaatggatgtgggatcagagagagctgggtcaggaagaagaaagtccgagctggtggggtgggggcaggacgtggctcgcagttgtcctacgcaccccgaatggtgtggaccttgcggacagcatagctgagtcggttgttgaggctgggaagctgggcggcagccccttccaccttagccatggtggtctcgagccagatctgagagctggagagggcacaagtcactgatcctccatgcctcccctcattcccaaaggacttgctgtgccttgtatagacaactccctctaatcctgtcccattatacaagtacagaacgcacagcttccgtcaattatctaaaggacccttgccccaagaatgcattaaatgactatctttttaagcaacctgttaagcttatttctcacaactgtgttttgctcactatcgtgtatcaaagagtaaagttatcctctctggtcaggggcagtggctcctgcctgtaatcccagcactttgggaggccgaggcgggcggatcacctgaagtcaggaattggagactagcctggccaacayggtgaaactctctctacttaaaaacacaaaaattagccgggcatggtggctcatgcctgtaatcccagctactccagaggctgaggcacgagaatcacttgaacctaggaggtggaggttccagtgagccaagatcgcacccctgccctcaagactgggtgacagagcgagactccatctcaaaaaaacaaaagaaaacaaagttatcctctccaagcccaggagtgtcgatctagcaccartgacgggcaggtccacatgctttaccagctggctgtgccagaagtaggaccaacctggctcatgaaaactgagcagcttaaacaggccccaggaggaggccaaggagtgtctggggccgggctggggtttcctcaggagagtccaggtctgcacccacagaaaaacacatgatgatgaaggcttgcagctgcatccccagcagcacagcaaagttcactttgatctggaaattgttccagtagatgcttccaacacctaccacagctcttattaaagtctccaattacctagagacaatctaataaacccagcaacaatcagagtttggactgctttaagcctggaggactttcggcaaatgcatcattacacagaccatttctgtgatcacctggtaccaaagtcaaaccctgtccacagtgcatctttctgttctcctggaggtagggggcacccgcgatggattgaacctgggtggtaggtcattataactagtttaattccgtgcaagtttgaaatttttcataatttttaaagctaaattagtccctaaggtacaaacccaagagaaggaagtggtgggcaaggactcatcctgcatcttaatttcgctaaaccaaaaattatctttatctawattaacccatcaagaagagcctcacgataacaatmaacatttacaagccagagactgtgctaagaactacctgccggccgggcacggtggctcaagcctgtaatcccagcactttgggaggccgaggcgggcggatcacgaggtcagaagtttgagaccagcctggccaacacagtgaaaccctgtctctactaaaaatacaaaaaagtagccgggtgtggtggtgtgcacctgtaatcccagctactcaggaggctgaggcaggaaaatcgtgtgaacccgggaggcagaggttgcagtgagctgagatcgtgccattgcactccagcctgggtgacagtgcgagactctgtctcaaaaaaaaaagaactacytgccttgggtacctcagtgtctaaggctgaggggaagtcatcaccagcacaaagaagctttgctgttttcttagaggtttttctgaaggtcatacaacaattgtaggtaatgaaacaactaggaagttggtaggagagacaaaggctggcaattgatttagaaggaaactaactggcttacattttagatggaatagtaagcaagttaagtatataataagcaagtaagtatacagctttaaataaatagactaggccaggtgcagtggctcacacctataattccagcactttgggaggctgaggtgggtggatcacctgaggtcaggagttcaagaccagcctggccaacatggtgaaaccccgtccctactaaaaatgcaaaaattagccgggcgtagtggaggacactggtggaggatgcctgtaatccagctactcgggaggctgaggcaggagaatcacttgaaccagggaggtgaggttgcagtgrgccaagattgygccattgcactccagcctgggtgacagagcgagactttgtctcaaaataaataaataaatagactaaatttttctccagtgaaacggattgcccgtaaaattttagaaaaaaaaaggaagatgaagtgtctacactctccatccttgaacaatactgcaagtgaagatcctcccgggtgctctatttagctcaagccattactagactgaactgcaggaggaagcaaggcctcacctccagccaaacatgcaacgggaaattcataacaagcaatcaggtatgaatgcagaaggggcttccccaggaaaagaaacgaacacaggaacattgatagagctaaatctgcccagccctgtagcctccagtggccactttccagcccctcttgcctgaggatcctcagcaacaaggtgcccaggamcctgaggtrgcagaaacactactccacccacccctccatccctgatacctgctgacagcattgaccacaagcctcarctgctcctcrgctgaggctgtctgctgctgccacyracgcctggcctcctgagcacggctcagctccaactgcaggccctggggaggatgcagcaaaggacagggtccctccctaagtcctggctgcagccccggaacaggggctcccttgccctccccgagtctctagtaggctgacaccaaccttggcacccatacgctccacctccacctctgcggctttgtcctgcagggatcgctgcaggatggcctgctcctggctctgggatgtcactttttcctggagtgaggycacctgggggaggagagagagctrggcagggccctctagagctaaaagatgaggggggcactggaagcaaagtggcaggtgcagagatctctgtaagaatgccatgcaggggctggggggagggrgggcgggcgacgggggtgggtcgcagcacggtggctcacacctgtaatcccagcactttgggaggccgaggcagatggatcacttgaggtcaggggttcaagatcagcctggccaacatggtgaaagcctgtctctactaaaaatacaaaaattagctgagcgtgatggcatgtgcctgtaatcccagctactcgggaggctgaggcaggagaatcacttgaacctgggaggcggaggttgcagtgagctgagatcaggccactgcactccagcctgggtgacaagaacaagactccttctcaaaaaaaaaaaaaaaaagaaaagaaaagaaaaagaatgaatgccacgcagggagacagaagcttaggttctgaggatggaatctgagcccagtgttccatgttccacattccatgtgcccactcraagatgggaatagcccttgacmcaccccacaagacccaccaactgaccatgccactctcctcagatgctgtcacctcctcagagaggctgtctctgagcatcctacctgaggctgactcaccccacagtctctcygtcacattatcttttgaatttttcttactactttctttttttttgagaaaagatctcgctttgtcacccaggctagagtgcagtgatgggatcacagttcactgtggcctcgcctcgacctcccagcctcaggtgatcctcccacctcatcctccagagtagctgggactacaggaatgagccactatgcccggctaattttttgtatttttagtagagacgggatttcacatgttgcccaggctggtctcgaactcctgacctccagtgatccacctgcctcggtctcccaaactgttggcattacttgactgggcacggtggctcacacctgtaatcccatcactttgggaggctgaggcaggtgaatcacctgaggtcaggagttsragaccaaagtgatcgcattataggtgtgagccactgcaccyggcttcaatctttctatcgcacatataattacccaacattatctgtttacttgcgtgttctgtgtctctgttctagaatgcaagctccacattttagttttgttcagggctgtgtgcccagcatgtggcaaccactcaataaacactggttgaatggatgccaccttcatggaaggagcaaggtgctgggagggaataccgggagaaaagagagtgcagtgacctgtcccttcagctgcttaacagagtcactgtgttccagctcctgggcctttagctgcaccatgagggcaaacaccttctcccgccagcggttcagcagggactggcacttcctggtaaactcaggctccagggaatctgaaggttgaacctgagggagaaggagtgggagaaaagygtgggctcctgggggaggagaggaaggaggtggcatctttgtttctcctctgtcctgcctgggcaacatgagctacagcaagaggagttcacaggaaggagatctaagcaggttctggggcacattgacccctcctgcccacagggagggaggcaggggacagtagatgcaggatgcggctgagggtgaggggtctggggsttgggctgtaccttcctggtcagctcctcctcctgcagggcgaggatgtgtgtgaggctctgcacccgcacctgcagcagctccgcggtggcatgcaggctgtcccggtcctcctgcaagtgctgcgggcagaggaaagcagcccctctgtagggcctccatgccgccttaggtaccaccttctctcccggaggctgtgctctacacgctcctccaagggccacgcttgcctcccaacctgatccctaagtctgcacacagatacattcctgcaccctcacctgcatggtktccagaagcttctgtcgctccagttcccatgtctggctgtggacctcagaaggsacttgttccccaacatattttcttagattctcaaccagggtcacctgagcctccaagtcttcctgggtcttgctagggttggggtgggaatgggacagccatcagtggggcgccctgcagatccaccacatcactaattgctgggctcccgtcggcgtccgcccacctacctcagctgcttccgaagcagctcggcctccctctgagcctcggccagctccttggcttcccctgctcttctggtttccagactactcagagacttctccaagccctcagccttgctggtcaaactggaaagagcctcctcgtgagcctgtgtcaaagaggacwgctgcggaaagaagagggggctcagcagaggctcgaccccacayggaggccttccttgttcccttcactcccactttctgtgaccttagagaatgacccaaccaatcagccaactgtgcacagcaaatggagagctggcaactcactctcygcagctgccccacaacccatcaggagttcttgtccgatctcccccaaaacatatcttcacctctctgtctccgtctccactgccaccaaccctcatcttttgcctgggcaacagcgaccatctcctaactagtctttacaaaccctcagtggcttctcacagcattcacaacaaaacccaggtgtctctccacacctgcaggccaggggacccggcctctgcctacctcctgagctcaccctggaggctctcccactgctccccgctccggccacggggagtctgctgagaaccagacagcggcccctccttgctccacagaccccaggcratagcccctcctcagggtggcttcactgggccctctaatacygtccctccccaccctactctgccccatcagctgttcacgtcctcctgagcacttagcactgaccatatcttgcttatgtgtatgtgttactatctgtcggaccacactggaaggaaagctccaggaaaggaggaattttgtgtcttttgctcatggcacctcaaagkgttgcaggggtgtcagagccaccaagagtcatgggatggactggaaaggagggcaaagtgcccaccctgcttcctggtctgcctcctctagccctgtctccatacaacaataaaattaatttgggggacataaatgacaaaattttttagacataaaatacaaatctaatcatgttatttccctgcttaaaacctttcaacaggccgggcgcagtggctcattcctgtaattccagcactttgggaggccgaggtgggtggatcacaaggtcaggagatygagatcatcctggctaacacggtgaaaccccgtctctattaaaatacaaaaaattagctgggcgtggtggcgggcgcctgtagtcccagctactcggaagaatgacatgaacccgggaggcggagcttgcagtgagccaagatcgcgccactgcactccagcctgggcgacagagcgagactccatctcaaaaaaaaaaaaaaacaacctttcaacggttgcttattacttgaaaaaacaatttttttttgtttgtttttttggagatggagtttcactttgttgcctagactggagtgcaatggcacgatctcagctcactgcaaacgctgcctcccaggttcaagcgattctcctgcctcaccctccygagtagctgagattacaggcatgagccaccacgcccagctaatttttgtatttttagtagagatgaggttttaccatgttggccaggctggtctcgaactcctgacctcaagtgatccacccgcctcagcttcccaaagtgctaggattacacatgtgagcaaccatgcccagccctaatttcttccataaaatagagatgggggtctcgctttgttgcccaggctggtctcaaactcctgggctcaaatgatccttccaccttggcctcccaaagtgctaggattacaggtatgagccactgtgcccagcctgctcattgctcttatgggaaagtagcaagttctgaagtggccaaagccttgtgccctgggycctgggctctgcagcacactcagtgcccctcatctctgtgccccagccttctggcctcctgtccccgccttcacctgttgtcccaccaagtgtcttccagctaccactggacttcacacgcctcttcactggccaactcctattcagcacaaacggtagcttgttgtttttttagtctcgctctgctgcccaggctggagtgtgatgtcagctcactgtaacctctgtctcccaggttcaagcaattctcctgcctcagcctcccaagaagctgggggattacaggckcccacgactatacccggctaatttttgtatttttttgtagagttcttcatgttggccaggttggtctttaactcctggcctcaagtgatccgcccacctcggcctcccaaagtgctgggattacaggcatgagccactgtgcctggcctagcttcttgtttctaagtttctttcataaatctcctttgtccattttctgattggattgctggtctttcccttaccaatttctaggcacacattttatattagggatattacccttttcttgtgatctgagctataaatatagcttttttttttctttttggctattcctaatgttcatgttataaagtcaatggatcaattttttcctttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgattctcctgcctcggcctcccaagtagctgggattacaggtgcgcaccaccaygcctggtgaatttttktatttttagtagagacagggtttcgccatgttggccaggctggtcttgaactcctgaccttgtgatctgcytgcttcggcctcccaaaatgctgggattacaggcgtgagccactgcgcccagggctatggtttctttccttgacatgtcaactggttacagtggccttccctgaaccccagactaagttagtgctttctagtccttctccttcaaggcattcctcctgattgcaattaattatgattaaattaaatgtggatgtgtatatcccccacgaggctgtcagttccatccacgaaggcaggactcaggctaatttggtcactgagtcttagagatggcagagtaagtactgagtttgaggactgaataatctctctctcccagtccaccatagcccccttatacccmccttcctcactgccctccacaatacccctgatgaattggtacctggagtaaagtagggaggcaaactatttcctactagaaagggaagcagggcttcaagtggtgggaggccacctgagtcttgggggaaaagtgcaacctgaattaagataaaagtacccaaattctccatctttctagcccatgtgtgtttattttcaccaaaggtctcatcactctactactcactactcatggagggtcttttctgcaatacctgttctttgcttggaagctactgcccagctctccgttatgaatttgaatcctttctacccctgcattcacctgctcttggtgcagcctctgaacctcttccagctcccgctgsctcccctcttccaarttcttccggacaacctcagccccagccaaagcagcacgcaggccctcagcctcagctcggccggccttctccgcccrtgccagagcctctagctccatggcctgggcctctagcctcatcttctgctgcagcgaggtctcccgcaggagccrgacctcctcctccagccrcygcagctcttgcagctgccgaacgatcacctcagcctgctggctcagggcctgtgacccctccagcccccaggaccttcaaagacaggttagtgcaggtgagacttgtctccagtgctggaaggatagttgagggcataaacatagccaggagaaggaaaagaggacccctctgcttccgtgtggggaggtgaagggggtgctgaagctggggtatggggatgtctgcattgacatcatcatcattcatcaaagccctattgagcatgttgagtccagtgcctggactcacaggacctaaagtctggctgagatcgtggaacatgatctccctagagagagctacatacaggaggattcaacatcaaatgtgtatatcattaggccacacattctttttgttttttggtggtttttttgtcttatttatttttttatttttaggccacacattttaagtggaaaggttggaagaacacacagggacttctcaattctaatttaagggcaagaagtttgagggaggaatgggcatagagaggtcgtaagcttccagtatcaatatggtgaggccaggtgctagttaaaaggcatttattggctgggcgcggtggctcatgcctgtaatcccagcactttgggaggccgaggcgggcggatcacgaggtcaggagatcgagatcatcctggttaacacggtgaaaccccatctctactaaaaatataaaaaactagctgggcgtggtggcaggtgcctgtagtcccagctgcttgggaggctgaggcaggagaatggcgtcaacctgggaggcggagcttgcagtgagccaagatctccccagtgcactccagcctgggcgacagagtgagactccatctcaaaaaaaaaaaaaaaaaaaaaggcatttattgagtgttaggtatactttatgaggagtctgagagaacagtacataaataacacagtgccagcctttagagaaatcgtctaccaatgtcacgtgaagtttaatccagcttggaacatggctcctgaggcagctctctgagacccaggactataagagattgttgttgttgtcgtttttagagacagggtatcactgtgtcacccaggcctcaatgcagtggctggatcataggtcactgcagtcttcaacttctgagctcaaggggtcctaccaccttagcctcctgagtagctaggactacaaatgcatgccaccacagccagctaattattttctgtggagacggagtctcgctttgttgcccacgctggtcatgaactcctgggctcaagtgatcctcctgcctcagctcccaaagtgctaggattataggtgtgagccgccatatctggctcgctctttctttctttctttagtagcagcgatctgtaggctagggaaattaagtgacttgccaaatgtcctctagctggtagccaaactagaaatagagtctctgtctcctgacacccagtctagtattccttcttcatcatgctgcttcttctaatgtaatcctattctggagcaaaatggcagaatgatatcccagtacatctgggaaaagacacatgaaacaagaataagaatgtttacagataatacgacagcatggccagctcccacagcatgtcctctgtaaaggctttcttccatcagaatgaacccacactgccacagtgctgggtctctacctctagtttgcacttcttcatcttgcctcataccatgctttaccatcagctggtggtcaatctatctcccctcttaggattttagattccttattaattacaaatttaagtcaggatttgtcttattcactattgttatcctcatccctagcacttagcacactgctttattatttatgcactgtaggaactaattgcttacataaaaatgagtacgttctggaaactagggccgaaatagggtaaggagtttattccagtgaggaagggtcactagcaagcaagcctgagaaaacggcgtggatggatccctacctgcctctccgccctggctcctgcctgtcactggaaacatcccgttcccacatggtcacttgaggtctctgggtgtctagccgcctctctgagacatcttgatggcctgggggttggaccaggggaatgtctgagagccaggtgggagccattcttggcagagttgaaaggggccgagcttgaaagtgggaggggggaatcagcccagtggaacctgaagaattacaaaaacaaagatggtcagtttcccaggcagagacaaccaccactccccttgtctggtcccactgacctgaaggtggaaacatctccacattatttgaaggctctagattctgtcttcagccatctatgttcccctggacaagaggagaaacaaagacactccaattcaattttcaggccaccttccaaagagaaagcccctacaataacaaagtcataatccttgaattatagccaggtccacccgatgcttagctcttttcctacttccccaaagtaggagataccccaaattcacttgcttgtctcaacctggttcctcatggaacccaagcaactaactatcaagtggagagaatttactgaaagagacagactgagaggggctctgaggctttactcatactttcaggattctgggcagtgcctttaccctcctccttaagtttctatggtccctgctgctcctggccagaggtgagaaaggaggtacacagtgcaggggtcttgagcgccatctccagagttctctccatggctcagcaaggcctgagggaagcccatccagacaccagcaggccatgactcttgggtccttccctgttaaagtgctggcccaaggcctggccccagctgaatgtggccacatgcagggctagaccctccccaagaccttgggaatccaggccgcctagatccccaggcagaaaagccagcgtcctgacatcttattcaaatctttcctgcggctgttctctcagcttctctctactatccccttagcttccatgcctgctgcccgcctcctctttctcgagtcctaacacatagtgggcacttgaagatcttcctcccaccctcccaccctcattaatctattttttacccgaatctgggatccctactcccgtccctttttacaacctaatctacctttttctgaaggaattattctggtcctgaccctcacccccatctctcaatagcctgccctcgccccctgtacgctagccggctctactctcccaccactgctcccctagatacccgaggcttcacccagttagcccgtgagctctaaggctgttctgatctcttcatctgtcccttcacctggcccctgtacccccttcccctttggaccccttgaaccctcccaggacccccgctcagccccttcccgcccccaaccgactcttcccgaacgtcccttaccaaccgcgagagccccctactgcgctttggccacaccccctacgcctcgctcccggccccgcctctgcccctgaccgcgcctgcgcaaggcgggcgccctaaagtcctatttcactctgttgggaggagggggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcgggtagatccgaaacggggctggggcggagtgggaaaaggccgggtatgccttgcatgatcgcggggagctccttcctgtttttatcccacctagagaagccgggaagtaggggtttaggtccaatttgttggagtacttaaggactcgtttgcactttcttttgggggatgacagtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtgagcattaagcagggcagctttgcccctgggtggttgaagcgccaggctggaatgagtaaggtctccacaagaccttgctgcctgcctcccatactcccatcagattggatggatagtcgtggtccagaccttcatcttcccaccagaagtgtgcacagtcagaagctctctgccagactgaccctttttggtcccgtttagctcatacaggacctgggatatcatcagaaagatatcacagtggggatgttctgaggccactagaggccaagtttagacttgattcagtttccagctttgctgaggcactctgttcctgggttagggcagttctatgttgaataatgtttttaataatctgggcatgtctttctccgtgacttgaggcagttagcctcagaaagcctagattcacatttgagttttgccactgcctcttggtaaagtcagctgtaggagtgttatggttattagactatagtagccaacattcatctagtgcttactgttatgagccaggccctattttaagtgtattgaatgtaggtggtactaatattatcctcatttacagtaaaggaaaatgaggcacaaagaggttaaggaacttgtccagggctgggcatggtggtttacacctataatccagcactttgggaggctaaggcagggtggatcacttgagctcaggagttcgagaccagcctgggcaacatggtgaaaacctgtctctaccaaaaaattaattaattttttaaaaaaagcctgggcgcggtggctcacgcctgtaatcccagcactttgggaggccgagatgggcagatcacgaggtcaggagttcgagaccatcctgaccaacatgttgaaaccccatctgtgctgaaaaaaaaatacaaaaattagccaggtgtggtggcgtgcacctgtaaccccagctactcaggaggctgaagcagcagaatcacttgaacccgggaggcggaggttgcagtgagctgagatcgcaccactgcactccagcttgggcgacagagcgagactccatctcaaacaaacaaacaaaccaaa

SEQ ID NO: 10835 - DNA, 13315 bp, Homo sapiens
actgctttagagtcctttcccctgctcctcgtcctctcctcctgcttccccagcccttctctctgccccttatccctcagaccttctccccttacttccccctcccagtcactcctgaattgtggcgctgtagagaacagtttcttttccctaaaaactttctttatgcccctttctatttaatccttgcctcccaccctcacccccttcccttcattcaaccactgctgtgctttctgtcactgcaatagtgacatttctagaatttcatggacatgcaatcatatgttatgtagtcttttgtttggtctctcccttagcataacgatgtttgagatgatgccattcattcatttttgttgctgagcagctgccgagtattgctggaatcccagtttattcattggtttctgtgtctccagttgatagacatgtggattcctccagttagggcttgttattaatgaagccactataaataactgcttacaagtgtggacttacatttttatttcttttggataaatacgtatttgtggaattgctgggccatgtggtaatagatgggtaactgtataagaaattgccataccactttacaaattggctgccacattttttgcattcctaccagcaatatcagacattcctattttttccatattcttgccagtgttaagacttatcatatgtctttttaactttacctgctctaggtgatgtgtgatggtttctcattgtggttttaacttgcacttcttagatgactagtattgtttgctatcttttcatgttcatctaagtgacttattacatatattttatgaactattttgcaaattcaatgattaattccagagactttttcagaattccctagtgttttctacatatacaatgaagctggtgacaaagaaagactttcatttcttcctttcttatccattgatctgttttcttttaaaattattattatttggtagagatgaggtctcacttatcaggctggtctcaaactcctgatctcaagtgatcctcccacctcagcctcccaaaatgcagggattacaggcatgagccaccatgcctggtccttgttgcactggttaggatgactgttaggtgtttaaacaagaatgatgagagctcacatgtttgtttacaaggaacttaaacaaatttacaagaaaaaaacccatccccatcaaaaagtgggcaaaggatataaacagacacttctcagaggaagacatttacgtggccaagaaacatatgaaaaaaagctcacacacgtatatgaaacgtgactgtttataatcctatccaaaaaagacctgatttcaagcaacagcaggattgcttccattcaatacttggacctgcaaacatcaaaaaagccactggagaaactgaacgactctctgaaagccttaaactaagatatgaagaagttgaaatctggaaaaaacttgaggaaaaggacaggcagggggaagcacagtggctacaacaaaaaaggcaggaaacaggaagagaggatggcagcacgttggctaaaggttctttggagattgtattggattccaaagacaaaacccaaaagagcaatggtgaaaagaatgaaaaatgtgagaccaaagagaaaggagcaatcacagcaaaggaactatacacaatgatgatggataaaaacatcagcttgattataatggatgctcaaagaatgcaggattatcaggattcctgtattttacattctctcagtgttcctgaagaagccatcagtccaggagtcactgctagttggattgaagcacacctcccagataattctatagacacatggaagaagagggggaatgtggagtatatggtacttcttgactggtttagttctgcaaaagatttacagattggaacaacactctggcatctgaaagatgcacttttcaagtgggaaagtaaaactgtcctgtgcaatgggccttgggcctttggttttagagggaggctataaaaactggttcctttgctattcccagtatacaacaaatgctaaggtcactccacccccacaacaccagaatgaagagttgtctatctcattggattttacttatccctcattggaagaatcaattccttctaaacctgctgccgagatgccacctccacctatagaagtggatgaagacatagaattgataagtgatcaaataagtgataatgatcaaaatgagaggacaggaccactgaatatatcaattccagttgaatcagttgctgcttctaaatctgatgtttcacccatcattcagccagtgcctagcataaagaatgttccacagattgatcatactaaaaaactggcagtcaaattgcctgaagagcatataatcaaatctgaaagtacaaatcatgagcaacagtctcctcagaatgaaaaagttattcctgattgttccgccaagccagtagtttcctctccaactctcatgttaacagatgaagaaaaggctcatattcatgcagaaactgctcttctaatggagaaaaacaaacaagaaaaagaacttcaggaaagacagcaagggaaacagaaagaaactgaggagggaagaacacgagcaaaaagccaaaaagaaacaagaagctgaagaaaatgaaattacacagaagcaacaaaaagcaaaagaagaaatggagaagaaagaacgtgaacaggccaagaaagaggataaagaaatctcagcaaagaagggcaaagaaataacaagagtaaaaagacaaagtaaaagtgatcatgaaacctctggtgccgagaagtctgtagaggacagggggagaagatgttcaaccccagaagtacagaaaaagtcaacaagagatgtgtcccatacatctgcgacaggggattcaggttcaggcaagccttttaagattaaaggacaaccagaaactggaattctaaggacagaaacttttagagaggatacagatgatactgaaagaaataaaactcaacgagaaccttcgataatagcacgaagtgaagaaatggggaggatggtaccaggactgccttcaggctgggccaagtttcttgatccaatcactggaacgtttcattattatcattcaccactaacactgttcatatgtacccactggaaatggctccttcatctgcacctccttccacccctccaactcataaaggcaagccacagattcctgctaagcaggatagggaaccttccaaactgaaatgctcttactcctccccagatataacccaggctattcaagaggaagccagcagtaactccaacagttaatcaggaagacaagccaacatgctaccctaaagctgagatctcaaggctttctgcttctcagatttggaaactcaatcctgtttttggaggttctggaccagctcttactggacttcgtaacttaggaaatacttgttatatgaactcaatattgcagtgcctatgtaatgctccacatttggctgattatttcaaccgaaactgttatcaggatgatattaacaagtcaaatttgttaggggcataaaggtgaagtggcagaagaatttggtataatcatgaaagccccgtggacaggacagtatagatatatcagtccaaaagaccttaaagtcaccattgggaagatcaattaccagtttgcaggatacagtcaagattcacaagaatttcttctgttcctaatggatggtctccatgaagatctaaataaaactgataatcggaagacatataaagaagaaaataatgatcatctcaatgactttaaagctgcagaacatgcctggcagaaacacaagcggctctatgagtctattattgttgcactttttcagggtcaattcaaatctacagtacagtgcctcacccgtcacaaaaagtctaggacacttgaggccttcatgtatttgtctctactgatagcatccacaagtaaatgtacattataggattgccttagattattttctaaagaagaaaaactcatagataataacagattttactgcaatctttgcagagctcgacgggattcttaaaaaagaaatctggaagttaccacctgtgcttttagtgcatctgaaacatttttcctacaatggcaggtggaaacaaaaattacagacatctgtggacttcccgttagaaaatcttgccttgtcacagtatgttattggtccaaagaacaatttgaagaaatataatttgttttctgtttcagatcactgcggtgggctggatggaggccattacacagcctactgtaaaaatgcagcaaaacagcggtggtttaagtttgatgatcatgaagtttctgatatctctgtttcttctgtgaaatcttcagcagcttatatcctcttttatacttctttgggaccatgagtaactgatgtaggcacataaggagacataggttataaactagttatcttttaaaaggctcagcaacacaattcttgaaatgcttatcaagataatggtagcaatagctggccatttagaggaattctaggacagtgggagctgtgttactagcactatataattcctgtcagtggtgacaaataacacttaacaagtattgcagtaagcatcacttacaggtaccatttatttcaaaacaacttttttagtctgctccaaagttaaaataattaactagctaagcattattattctactggtctaaaaacctttgtaccctttttttccttttcactgttacagccttttcacatttctaaatcccatcttcatatactatgaatactctagaatgatgtgaagcagataggaatgtatgtgtacatatttattgcatacttacacatcaaatcgatatacatagtttaacatgtggtcctttcgtgaaacttagaactcagaggattgcatttttttctttgagcatattttgagtaactgcagtgctttcttagggaaatgacagggcaaagctatttttctgttggctttgggggcatttgggtgcgctaaatctttatcttaaaaaataaatggaaacttcctttaattttttaaaatgagacattaaaatcttaatgagaaaaattaaaaaagctcaatatcactgctcattagagaaatgtaaatcaaagccacaatgagataccatctcccaccagtcagaatggtaattattaaaaagtcaagaaacaatagatgctggtgaggctgtggagaaataggaacacttttacactgttgttgggaatgtaaactagttcaaccattgtggaagacagtgtggccattcctcagagacctagaaccagaaatactatttgaccccttgggtatctacccaaaggaatataaatcattctactataaagacacatgcacacgtatgtttactgcagcactatttacaatagcaaagacttggaaccaacccaaatgtccatcagtgatagatggataaagaaaatgtggtgcataccaccatggaatagtacacagccagaaaaaggaatgagttcatgtcctttgcagggacatggatgaagctggaagtcatcatcctcagcaaactaacacgggaacagaaaacaaagcacctcatgttctcattcctaagtgagagttgaacaatgacaacacatggacacagggaggggaacaacacatatcagggccttttggggagtgtggggggcaagggacgggaacttagaggatgggtcaataggtgcagcaaaccaccatggcagactatacgtatgtaacaaacctgcaggttctgcacatgtatcctggaacctaaagtaaaataaaacaaagcaaattaaaaaaagaaagcccatgtcttacatgtatgcatatgttcattgcagcactattcacaatagcaaagacatggaatcaacctaaatgtccatcaatggtagactggataaagaaaatgtggcaaatatgctctaccrgcaggatttgatggcrtgatgtctcacagaaagttctcyactcccagacatgggtccctcggcttcctgccttggaagcrcagcagcaggcatyrtgggaaggtgaagagcttccctaaggatgacccrtccaagccggtccacctcacagccttcctgggatacaaggctggcatgaccyacrtcrtgcgggaagtcgacaggccaggatccaaggtgaacaagaagsaggtggtgraggctgtgacyattgtggagaggccaccagtgggcattgtgggctgygtggaaacccctcaaggcttccggacttgcaagactgtcttcgctgagcacatcagtgatgaatgcaagagacgtttctataagaactggcataaatctaagaagaaggcctttaccaagtactgcaagaaayggcaggatgaggatggcaagaagcagctggagaaggacttcagcagcatgaagaagtactgccaagtcatctgcgtcattgcccacacccagatgcaactgcttcctctgtgccagaagaaggcccacctgatggagatccaggtgaatggaggcactgtggctgagaagctggactgggctggcgagaggctcaagcaccaggtacctgtgaaccaagtgtttgggcaggatgagatgatcgacgtcatcagggtgaccaagggcaaaggctacaaaagggtcaccagtcgttggcacaccaagaagctgcccygcaagacccaccaaggcctgtgcaaggtggcctgtattggggcatggcatcctgctcgtgtgggcttctctgtggtacgtggtgggcagaaaggctaccatcaccgcactgagatcaacaagaagatctataggattggctagggctaccttatcaaggatggcaagctgatcaagaacaatgcctccactgactatgacctgtctgacaagagcatcaaccctttgggtggcttcgtccactatggtgaagtgaccaatgactttgtcatgctgaaaggctgtgtggtgggaaccaagaagtgggtgctcaccctccrcaagwccttgctggtgcagacaaagcagcgggctctggagaagattgaccttaagttcattgacaccymctccaagtttggccatggccrcttccagaccayggaggagaagaaagcattcatgggaccactcaagaaagaccgaattgcaaaggaagaaggagcttaatgctgggaacagatattgcaactggtgggatctcaataaaagttattttccattaaaaaaaaaaagaaaaagaaaatgtggcacatatacaccacagaatactatgcagccataaaaaagaatgagatcatgtcctttgcaggaacatggatggagttggaggccattatccttagcaaactaaggcaggaacagaaaaccaattaccacatgttctcacttataagtaggagttatatgatgagaacacatggacacgcagaagggaacaacacacactggggtccacttgagggtggagggtgggaggagggagaggatcaggaaaaatagctaatgggtactaaggcttaatacttgggtgggtactaatgggtacagaaataatctgtacaataaaaccgcatgacacaagtttacctatataacaaacctgtacatgtactccttaactaaaaataaaagttaaattaaaaaaaaaagaaacaaagaaactgcatatctggaaagagcatatggttgggttctgtgttttgttttttttttttaaccaattcacacaatctctgcccttcattggagtgttgattcatataggtttttttttcattattgataagttttaggtctaccatgttatttcctcagttttggtttctctgttcctcttgtcctgaccaacgacttcttattagaaaccatagaaacaaaagaaagtagaataacacctttaaagtgctggaagaaaaaaaggacaactaagaattctatatccagcacagatgtccttcaaggacaggcaaaataaggagatgtttcaggtaaaagaaaattaagagaatttgtcaccagcagatctgcacaataacaattggtaaagaaaattcttcaggctaaaggcaaatgataccaggtgggaaatgaggttatcagaaaagatgaagatgatcaaaaatggtaaatactgagctaagtgcaaaaggctatcttgttcccctcatttactctaatttatatacatagaactgtttaaagataagaagaagtttttttcttgtgggacttataacctatatagatatattacatataatatctgtaccataaagatggacattttatagaggataaatggttgcaagatttctctatttatgggtactagtacatttttaactgaaagtggactgtgaaatgttaagaagagttaaattctgaaggaaattgagacacaaaaaccattcaaaagattaacaaatctcatgatggttttttgaaaaaaacaaaacaaaacaaaataaaaactaaacaaaaataaaaccctagccagtcttgagtctcatcattctacgatttcagaactattgtgaatacaaaagtaatcaaagaacagtcctgcccagaaagaggagttatccctaaatatggtgtccctggaacaggtggctctccctgctggacctcttccacgtgggtgctttctgcagtgactttgttgccttgctattccactttacccagtgtcctcacccaagagacaaggggtgtctgctgctgtatccacacttggagaaagaaaccttgatagtgtcagtacattacaagctgggcatgacagctcacgcctgtaatcccagcaattcaggatgctaaggcaagaggattgcttgagatcaggaattggagaccagcttggacaacatagtgggaccctcgtctctaaaaaaaataaaaatcagtaaacggctgggcctggtggtgggcgcttgtatttccaggtattgtggaggctgaggtgggaagatcccttgagctcataaatacaaggctgcattgagctacgatcccaccactgggctccagcccaggccagagtgaggtcttgactcaaaaaaatacattgtaagcctttgctcactatgggttatttattatttattcaatgtgtattttgattttattttactggcagcacaataaaccaggacatgctgaaactagaaatcacatccactttccagtgttaaaaagcccagtctagggaggtgagaaggagacagtcctcattagcgttgaggattcagggagatcgagatgggctgggcaggaaggttcttacttggaacctggaggatgagcaatgacattcctctctccaccttaaagctcatcctgggcatctgcctcctgggagcaggagcactgcaagctccgcctcccgggttcacgccattctggctcagcctcccgagtagctgggacaacaggtgcccaccaccacgcccggctaatgttttgtattttttagtagagacggggtttcaccatgttagccaggatggtctcaatctcctgacctcgtgatctgcccacctcgacctcccaaagtcctgggattacaggcgtgagccaccgcacccggcctctccttgggatttctttactggacaccagcctgagtcaactttcctgtaaagcaaaagaagcgtgaggttgctaaaggaggaatggtgtgatctccacctttggcgagatccctgtcaccgtgttcaggcgaagggccaggccttactccccatgcagagaggaggctatggccatgaagacgcctgtggagaagtgaggacccgctccctctacactgatggccaagagcctacagatggcggagaaggcttcccttcagctgtgtcctatcaggttcttccaggagtcaaggagtagacctgcatgttacctctggtgatgtaagctgcatgcacacctagaagtgaggtcacccctgctgggggtcctggggctgctggttgttctgggtgctcagtgtccagaaaagaagatggggaggaggctttgtgcaaaacagtaaccatactctataaattattttttcattagcctttgtgtcataaaataaaatataggactccaaaagaaaaaaatgtctaaaatttgtgtcctttaatacaaagtaaacacccattaatcaccagggatagatgtttgtggggcaaaccagaagccccatcatttgctccagcccagcaataaactctttcttccctcaaataaaaacacaacctgacttttacgatcatcacttctttgttttatttttatttttatcatccaatattatgatttagttttacctttagaaatatgcttttgttttctttattctatagattcttccttgaaatttatattgtgtggtagagcttcccatagtgtgcattttgctgattgctccccaaggcatagtttaatatgtatttctattatctgtattgcctctaaattggtaattggctatggagatcagcttctattcaggcttggtttctttttcacttggacttgtttgatggtgctgtattgtgttcttccatcaagaggaagaacctcacattagttttttcttttattgtgttgttaattgccattgctattcaatggctaaatctgttaattcatgatgggttgcaaaagagttattatagtctcagtctctcattccttcttcatttattatctgaataatttctaagtaagagattcaccctcctctactgtttgtttactactagaaacttggtttttgagagactaagccaatcatctactcacctatgatccagcaatagcactcttagttctaaaccaatagaaatgcatgtatgtgtgtgccaaactatatgaaaatattattcatagcagcacgatttgtaaaatctgtatacaacaaaattgtctatcaacagtgaaaggacaagaaatgtgagttatttataaagtggagcattggacagccatgggagtgaataggctacgaccacacacagcgagatgatgagacccagggtcatgatggtgactgtataatgccattcaactagacctggcagaactcatctgtattagaaatcaagagtggctactctagggtggggagggtggtttatgactgagtaggacccaaagatgccagcaaagtaggcctctacattaaaaaaaaaaagagagagaaaaattaaacagagaaatttaaaagtttataaataatgtttacttgtattcaagaaaattatagcgacagccgccagataatgatcagctctaaaaagagaagctcaagaagctcatgccacagcagctggtacagctgaggagatcagataaaccagcacaagcatggtcatgaaagggagctgcagacatatggtttccagagtttcaaaatccatatgactaaaatctatgtgatgcgtattatatgatgactgcctcaagacagacaggtgtccacttagagacacagagctgtgacttgcaggggctggttgattttctcagaactcattaacctaaatccattagttaccatcctgtttccactcctatcatcacctcagacaaccctgcgtttagctcaagattcttcccttcatcgtaactgaaagtcactaatgactgcaatcaatttgaaatactataagtaggtaagatttcctcagtaagtaaatggtcttagcatatttttgaagtcataactataatcaaagcctgggacatttatttgctctaaacaagcagttattcttcatccagaattacacaatagaagctctcattcttgcatttcccaacagtttgccttagccaggaaaataaaccccatgggtctctagcatgaccacagtgcaagaataaggggaagggcagaggtgagaactaagtgctcttctacagctacgggtctatcaaggtaatcttgagaggtacttatcaatatgtgatgtgccagcaacaacatgagggaagataaccacgtgtttctaggataaggcaaaggccctgctcatggattcatccgtaatctgaacacagcacatgaagagtgaacagctgtcaatatctactttcacctcaatgtaaactttcaaaattaagaccaagtggagcacggtgccctctgaagcactgtctgtcacacactaaggagctaagaactcctgtggcctcctttagaacacagctcttccaggacacacaatgagcaggcctgctttagcacccagggcccacatgcagctgctctgcccagagctgcccagctcctggaccactcacctctgctcctgctggctggtgcccaagctgtaagggctggcaaatattttgagtattggtcccaaaggcccctgaaggtgaaaggatcttgttcttcattttcattacttctaagcactgagacctcttacaagaatcatccacaagcatttactaagtgaatgttcacaggaaacccttcctgaaaagggtccttccaactttacatttgacaagtgtgtactaaggcaataaaactattcaactgagcattcaaattcacacagaggataccacgccaagaaaatgaaagcagaaatattggattctccttatttgttaaacctttccctctagaaccaacagcttttcaaactcataaaacaccccaaaacagtaaaacaatatcaattactcatctgaagatatccacctgaaacacagttattaatcttcaaaggcctagcaccaggcagcttcacacagcacatctgcagaattgtaatgatcaataagagtaaacccaaagtacactaaatactttcatggcctacaggaaaaaaaaaaaacgctcttttcaggacgatgtaatagttacaccctatttcttcatgtgcagcatgatattctatgcttaatggcatttaaatgttacacagtaaatactgagaaaacccagaatttttggatgtgcagaagcaatatcacatcattaatacaaaaggtgctcagctgcgggattataataccattgagtgctgagaccacttgaaatcttaagtacattcttagcatatggtctcctggctgtcacccagcctggtaccagctacccacctgttgcatagagctagccccagcactgccttggttgggccggttgtttttgtcaaactctaagtctccctcagaatccctgtacttctccactgcaatgtattgacagggttgtgaccttgtccttcccaaggg

SEQ ID NO: 10836 - DNA, 37064 bp, Homo sapiens
tgggggtcaggaagaaccagaaagggggaatggaggacgtgggataagaaagggactccagggggagggcaaaaatgttcatgacagaaggactcgggtgggtgtgtgtttgcacacatgtgtacaccaggggtgtttcaaggaacataagcaggcctaccttttggtgtcaacggtggtaacattgaaggtgactcccttgagccacagtaccatgaacagtctctgggagaatgggcagttcccaatcttggccccatcactgccagcctgaaaagtaaccccaacccaaggttatgcctgatgcaccccacccatccctaggccagtccctgcattcccactcccagaccagctgttttctgcctagtcatgacacatacactgtcccctcactatgggctctttgcccttgggcctgggtcaaacctaaggcagatcaatgggaaactgttttgcaaaggcaggcttctggttccccagacactgaggacaggtgggaggtaggtagagggaggaggtcctggagaacttgggaggatctgaatcctagagagggaagggtgtggaacttcagtgaggccagagttgtaggctagaagcctggatttctgggttcctgaagggagtagagtctgaagacaggagaggtgggtggggtttgggagccagagttttggttctctacacctccaatccaaggtgtctttgggtggggagtctagtcaaggggccctgggcctcgcgctagagatgtggagggccctacagagaggggctgccctctaattagcaagtggtgacctcattggcccaagggacacctccccctaagctgagggtgattcatctctctgtctccggcttccttcctgtcaaggatgtgggggaagggacagtgaggatgaggcctgggcagctaaggctacccctaacctgctgccagggtctcccagcacaagtcctctgactgcaataaccatcctctcacaggacacagggccggaatctctgcggcacagcctcacccacgagtaaaaatagccccggaggcgaatgtgagagtgaggtggggaccacacctaagggggcggacccaagcaggctccgacttccctgggcccagggagagggaatggctgcccgagaaacccaagcagaagggagagggagacacaggcagagacacacaaagatgagagaaacaaaaggggggaaggggaaagaaaggcggcaggaaagtggagagtggggagacgtgcgtgccaacggagagacacaaacggagcggggagaagaggacactgttaaggaagggagggaggggcacagccaggaggtcccaagactgggaaatgaatgcagcagcggtagggaggggagcggccgctgcaatcagaggggggctgggtgacaccgagaagcctgctgcctgcagttttgctacccaaatgccataggaccatctctccttacccacacccgcagagagaggagagagttggggcaagtcttctacttctccaacccccaaatcccaaaatgccctaaccgagctcttctcctccgtctgatctctctcccacccatccttgtggtagctacgttaaactcacgtcttcttgccacctccccttctgtccctttccccagtcctggggatattcaatgccacccgatcacctctccagctctgcttttcaaactccgatcccagtctcctgttttgttccgcccctccaaagcttcccaatttacttgctctcactctcaggcctccctcaacacaccgtcttccctgaagcgtctccatccacacacacacacacacacacacacacacacacacacacacacctctcctactgcactactcaccctcagatcttgtagggacacatgtcctaactgaggttcccctctgtcccttctaaaccctgctgggcccccactgtcccttcaccagctcgccctctaaccccaccccagtctcacttttgggaattctcctttttctccacttcccttcctttagtctgctagaaacttgcacttttacaaacttttcagggttgatcctagaattctcattacttgctaacaagttaatgtcttcccctctcaaaaccacccctcaaccaaagagtgcacgtgggattgggggtgggagtcaaggagggaagggattggggagttaaggctggaccgggggaaaggtgagagttggcttccaggaatttgggtggctgaggagagaagtgttcttaccttcacgaacaattcgacctgcggttgttcttcagccatggttgcgtcggggaccaggaagtggccgtccctgggggaactgggaggggctgggaccggggaaggcgggtctcacactcagggactctctcccctagacccagggctgtcccttcagcacaacacaagctcaatcagacctacttgcacccaaactaggcctccccaccagcccaacgcaccccacacccagctcctccagctcggtcctctcccgggctggatcagagagccgctgactcaccgaccggccccgccctgaacctggggaggggactggaggggggcgggactcgacgatgtagggagtgagtccggaaggggaatcctcggatctcccacaggatggggatgggggtgttaaggaggagtcctgaaaacctccttgtttctccgacctctcctgaacacaggactcttttctgcctcagtttccctgcttcattaatctgagtacaacccgactgaccctcatataaaaaacttgacactaacagcttgggcacacccgtgaagattcagggatggggacttcaaatggaaaggtggtcgtttaatcattctgcatttcttccagactccaatccaaattctgggttgctgggactgtggtctgagagaagaactcggaagtggaaggctgggactgcagataggaaccgttagccatgcagcctgggattagggaaggggtgacgccagcactccctgagctgcccagactggtgtctcagtaggtcctgtgccccccgcagtctactgtctccgggcccagctcagcactaggacttgcagtccttgtggcctacacttgggattgggcataggaaatagagttaggggccgggtgaggtggctcacgcctgtaatcccaacactttaggaggccaaggggggtggatcacctgaggtcagggagtcaagaccagactggccaacatggtgaaaccctgtctctactaaaaatacaaaaatttgccaggcggggtggtgggcacctgtaatcccagctacttgggaggctgaggcaggagaatcaattgaacccgggaggtgaaggttgcagtgagctgagatggtgccattgcactccagcctgggcaataagagcgaaactccatctcaaaaaaaaaaaaaaaaagaagaagaagaaaagaaaaagaaagtagagttagggatgggaagggagatgacgaagtcttttgcgaaggaaacataaagccgaggcaaggggctttgttgcagggaggggtctgttcctgtagcttggtcagctttgtgcttccacttatgtttcctattggggccccttcctgtgccctttgtcctcgtctcactgacaggttgccttggagatggggcagaggggtgggattatcatggcccgatcctgaagtatgtgtatagggggtggggtaggggtgttgttagctggtcctgtcatggggataaagaaagatcagacagaatagtgggagtagagtccttggggacacctaaataaataagcagggaggacataggaggagcagctctctctccagtaaccttgatttctattaaacctttatgacctgctgaaaaaataaacccagaattccagcctccatatcctgaatttctctcctgtccaaccatcccttctctatcctcctcatcaccctctgtccaacaaaagacctacagttccagaaaaccatggtggagtgcaagaacacagaactaaaacagagcttgaaacttaaagaaagggagagacttgggggaggagtggggtggagtgacgtgatgtgctgctggaaaccagcagttggtggtttcctcttgtgcttcctcttctgtgggttttctcctgcttgtgggagggcctttttctctcctcccgacagaaaggctatctttggtgttcgttcccttgaactgtaacatcctgtaagggtatgattccatgcctctgtgtgggtgtgaattccctcatggtgaccctcaaaatctgcacacaggaccccttcccattgaggggaggggatcaaaacaactctacttctcagggtcctctcctgttccaactggtctgtgtccaagagaagccttaggtaaatggggccagcttgaagatcaaacaggtttggcagcctctcccggcctctcttttctctcctacagctttatagctacagctgccttgatatcaatattgactttggctggctggcatgactacccacagggtatcgtgccttaatttaccaggtgacaggcaacgctgccctctcctggaaccatccagcagagccagggctgtacccccaaatcctgcaacagaggtttccctccatctcacctccctgtccctgcatttctcctatctcagtagctcctctttccctctctgggcttctctttccactccctccccttcctgggcttggtaaactagtccctaatctcttcacaccccagattggaaggtgggtccctccctgacactccccagagctgtcaccaacctcctccaagtttctatagctccattgctcaacagatttgccaggggtaaccattaacccagcccttaactctgttcccccacctttcttgctggaggggattttccaattactggttagcacagctaggtcatctcacccccaccatctttcctaacttcttgggttggggggctggggaggaatctccccatctcagggtactaggaacaaagctggggaggatggtgcatttaaagggattatatatatatatatatatattttttttctttctccctcataaccccacccccgcaacacacacacacacacacacacacacacacacacacacacacacagacgcacaaataagctttatggagcagtgacttcattatgttcaccgctttgagtccaacccctggcccaaaataggcactaaatagttgccgaatgcatgaatgatagatacctctctgtcttcaggggtgtgtagaagtgcgaaggggtatgggcatgtcccagtaggggtgtgagtgttctgatcagaactacttctctctgccagaatttgatgtaattcgaatgcttccacctctgcttgaagggtttaaataataaattaggccctgtcgtgccattatgggggtggtcataccctgtacccaggaaacaggcacggtagggctgagacagaagtcctgcttgtttccgcttatttatttgaaacaccgctcatttaggtcttactttgtttgccaggcactgttctaagctctgtataaatattaactcagagggtacaaatattaacttaagagttgttgcaggaaaaaaaataagcgcctctggctctttaagtttggcctccccctcaaaacccccgcaacggtcccaaaccccttccagggactgggactacggaccctggtccgaccttctcgcgggcttcccactgcgccaatcaaatcccagaaacagtgagtgctagaggcccggctgctaagcaacggcagagggcgggaagtttgaacgttctggacccgccccgaaggcaaataggccaatcagcgtccagactcttcagctacggcagtccgcttctcctcctcgccctgtcggatctctaggctggatccgggcctctccaatcaacagcggctaggagggcggggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaagggtaacctccgcgtgacaggaatgagggtggggcgcgtggagtttcccacaatctgtactttagttaaatacccgagaattcacctcctgtgtccacagctctccacgcccctcagccctgccccgcagccctgtagcagaagtacttagygctttgcattctgcgcgccaccctaccccggcctcctctgtgaatcgttgcttccgaaccgccctcactttttgcatccgcagagcctccaagctcatggcctccttaggagcgaacccaaggaggacaccgcagggaccgagacctggggcggcctcctccggcttccccagcccggccycagtgccgggccccagggaggccgaggaggaggaagtcgaggaggaggaggagctggccgaggtctctgaggggagtagaaacttgaatggagagttgatgggaagttagaataaaagagggttgggagccgggcgcggtggctcacacctgtaatcttagcactttgggagactgaggcgggcggatcacctgagctcaggagttggagaccagcctgggcaacatggcgaaaccccgtctctactaaaaatataaaaattagccgagcgtggtggcacgtgcctgttatcccagctactgggaaggctgaggcaggagaatcactgtaactcgggaggcggaggttgcaatgagctgagattgctccactgcacttcagcctgggcgacagagcaagactccgtctcaaagaaagaaagaaaaaaaaaacagggttgggaagagctgggcaagtctcttacctcctgagtggctgtttcacattcactaaatgggggtgatgatgcctatctcagagatttgagaaaatgattaaattatataagacatggtaaaccctacacttatgagtgattctaatagtgatttcctttcttccttgctggacagatccatctgtgtgtgctgtggaattcaggatacttgggcattgcctactatgatactagtgactccactatccacttcatgccagatgccccagaccacgagagcctcaagcttctccagagaggtggggatggaaccatgaattcctctgctctctgggattgcagatgtgttmcacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagayggtgtttcaccatgttggccagggtggtctcaaactcctgaccttgtgatccgcccaccttggcctcctaaagtgctgggactacaggtgtgagtcaccacgcccagccatgttttacttacattaactcacctcactgtctagcatattttgtgttgctgtaaggaaatacctgactctgagtaatttgttaaaaaaaaaaaaaagttttatttggcttatggttctggatggttggaaagctcaaaattgggcatcttcactggtgagagcctcagactgcttcaactcatggaagaagggaaggcagggtgtgtagaggtcacatggcagagaagaagcaagggggagggagatgccaggctctttttgacaaccagctctctcaggaactaatagagtgagaacctctcactcatacccaccaacacactccaggaagggcattaatctgttcatgagcgatccactcccatcacccacacacctcctgctaggccctacctcacaacactatcacactggggattaaatttcaacacgatatttggcagggacaaatcacatccaaactatagcactgactcaatatattttacagttgcttcacagaggctccctcttttgtttttatgaattcatttcattatttaacaaatatttgtgaggytgttttttkgtttgtttggttgttcttttttgagacagtgtcttgctccgtcactcaggctggaagtgtagtggtgccatcttggctcactgcaacctccgtctcccggattcaagcaattctcctgcctcagtctcccgagtagctgggattacaagaatctgccatcacgcctggctaatttttatatttttagtagaggcagggtttcaccacgttggctaggcttgtcttgagctcctggcctccagtgatctgcctgccttggcctcccaaagggcagggattataggcatgagccactgtgcctggccacaaatatatatgacgtatttacaatgtttcaggtgcttcagattcagccctgggcaaatcagtcatgtctgttctccaggggtttacagcctagtgacaacatccagaacatcccacttccctctcaccatcccaccactcttaactacttttctaaatctcaacttctacctgtgttcccactgtgcagagcactccctactcctagggaggaaatgtttttgagaaggagaggggtaggaagaggagggctatgggttttctcttagtcaaagacaaagatcctttaactcatttgatctctgttctccttccaagttctggatgagatcaatccccagtctgttgttacgagtgccaaacaggatgagaatatgactcgatttctgggaaagcttggtaaggacttggtaaaggatagagggaaaatggggaaggactaatatatggaatattccagggggctagaattgggtgagagggagtgtcagacagaggtagaaggactgagatgtaaagaatgatagccttttctttcctcccccacagcctcccaggagcacagagagcctaaaagacctgaaatcatatttttgccaagtgtggattttggtatctccttccttttgcttwgcctaactccctgttccggtgtcccattctttcccccaactctaccttcatcatcacagatctcccctctgccttatgtcatcctaaacctttgtgctcctcatgccctatgacctgtccccccaagatctctcctgctccctaccctttaataayctgcagcttattgggaagcctctgcttaagtcatgtctagggatgagggcctcccctgaggagtggtgacactttttggacagggttttattgttggaattctccccattaagttaaagccttttatcaccaaaccaaaaggcactgcctcagtgacccttattatgatccataaggcacttctataactttcctaggtttacaataagaacaggagtgtactatcctaattagatattaaggcattagtgttactagttctattaataccattattttgaccaaaatcctcaattccagacagatgtctactttcctcagccatttatctttctcaggctgtgctttcagacaagtatctttatattatatgtagaataaaaagagaattagactaagagtctgaaaatttggttcttgctctagctttccattaactgcctgtgtgagcttgggcaagtcaaataatctctcttgcttctattgtctcattcttaaamtggggtgaaaaaattgagctacaagaccgttccctttgcttgcctccctcaaataggtctggagataagcaaacaacgcctcctttctggaaactactccttcatcccagacgccatgactgccactgagaaaatcctcttcctctcttccattattccctttgactgcctcctcacagtgagattggtcctgggggataagggctgggaggcggcacaagtgctagggctgaattctgggaggtactggcctagccctggaaaatagtaactttccctggtgctctgcagcccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgtaggtgattcmccccaaccccaaccaaagtaatgtgggattgggaggcctgaaaagtaaagtgggggtggggtgtggatgtggctgtgacccagtgggtcaagkgctctaggacacccrggagaatctaagggctaatgagactttgggaagaagactgggacaatattcagagagggggacaaaggaagtggagttgtggaacgaactcagactgcttcctgcttttttgttttctgtcctcaggactcatctggtgaacatagatcaagacacttacaggtaaagaggtggaggcatgctgctgtctctggggagggagaaggattaagtttaatgccccaataatcctaatgaggctctagtttccctaatcctggggctattaagatctctctccttgaaggaaagggaaggggggttttgagggaaagagaggaagaaaagcataaagatactagctttcttttctatagggagaaactgaggcaaagaaaagtaagggacaaaccttacatcaagatatgatctcggctgggcgcggtggctcatgcctgtaatccccgcgctttgggaggccaaggcgggtggatcgcctgaggtcaggagtttgagacctgaccaatatggtaaaaccccgtctctactaaaaatataaaaattagctgggtgtgttgtgcgcctgtaatcccagccactcaggaggctgaggcaggattgcttgaatccaggaggcagaggttgcagtgagctgaaattgcaccactgcactccagcctgggcgacagagcgagactccatctcaaaaaaaaaaaaaaaaaaaaaaagacgtgatctcaggaggatatcccctgtccccattccatttatcagtcctcaattcttattcccttcaaaagtccaagttaccccaaactcctccatttctcctcgacagtgttctacagatttttaagagtgagtctcacccctcagtgtacaaagtggccagtggactgaaggaggggctcagcctctttggtaggtgtgccccatccctcatctcacrttacaaagacctaccagaaaagcaattggctccaaagatgtgtcccagcctcccttcccacttcactcccattgtcagatatctctttcatgccaatccaaatttcttacctatttgtaccccccgccccccaagcttgagcatcttcccatactttgtggctgtacagtgttgttgcatatcagccattactttaccaattctgtgttccttccctgggtttgtatgaatgtttctactagttgggtacctgttagggactttgggagaccttgtgtatagagaagagttttgtaactgcataactgcctatttgatttgtatagagtctttatcagttgtctctggctttagggtatattagggacatctccgcaaatatccatatagtttcatatctcagtaagttgtgtccaggttttttttttttttttttttgagrcagagtctcgctctgtcgcccaggctggagtgcagtggtgcaatatcagctcactgcaagctctgcctcctgggttcacaccattctgctgcctcagcctcctgagtagctaggactacaggtgcccaccacgatgcctggctaatttttgtatttttagtagagaacgggtttcactgtgttagccaggatgatctcgatctcctgacctcgtgatccgtccacctcggcctcccaaagtgctgggattacaggcgtgagccaccgcgcctggccagttgtgtccagttttgtgtgtgtgtgtgtgtgtgtgtgtgtgtgtgtgtgtgtgtgtgacgaagtctcgctcttgtcccccaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctcaggggatccactcgcctcagcctcccaaggtgctgggattacaggcatgagcgaccgcgcccggccgtccagttttttacatatgtgtgttgggctcttgagttttttgtttstttgtttgttttttagatggaatcttgctgtgtcacccaggctggagtgcagtggtacaatttaggctcactgcaacctccgcctcttgggttcaagtgattcttctgcctcatcctacctcagcctcctgaatagctggaactacaggcctgcaccaccatgcccagctaatttttttgtatttttagtagagatggtgtttcgccatgttgcccaggctggtctcaaactcctgagctcaagtgatcctcctgccttggcctcccaaagtgctgggattataggcatgagccaccctgcccggccagctattgagtttttgtatttttggaggggcgggagggctcttgagttttttgtgttttgtttgtttgtttatttgtttcgttttgttttgagacggagtcttgctctgtcacccaggctggagtgcagtggcgcgatctccgctcactgcaagctctgcctcccgggttcatgccattctgcttcagcctcccgagtagctgggactacaggtgcctgccaccatgcccggctaattttttgtatttttagtagagactgcgtttcaccatgttagccaggatggtctcgatctcctgaccacgtgatccgtctgcctcggcctcccagagtgctgggattacaggcgtgagccaccgtgcctggccagttcttgagttttaactaggtctgctttgtgtatttttctggctaagtgtccctgtgagtgtccatcccttcccccatctccatgtacggtaatcccagctcatatttgtggccaggcaccagctttggctgcctttgtgccctcccaggccagcttcctcaacaaccagcacctctgacctggatgcctcagcttagacacataaacacattccattccctgtccctgccttgtaacaagttcactccctgccttatccctcacaggaatcctcaacagatgccactgtaagtggggagagaagctgctcaggtgagtgggtcccacacatactacacactaatgcatgaattccatatgcacactacatactaaagcctactaatggcagtatacagattctcacatacaccaccccacctagtagtagtaaagcaactgccctttactgagcactggctaactgcatttcatccttataacagctttgtgtagtagctgatatgcatctcattttttgttgtcagcgcaggtacacatatacccattgatgatacacagacttgcacacatacaagcagcaggaaaaaacacaaaatgtaaggccgggcacagtggctcacacctgtaatcccagcactttggggggccaaggtgggtgaatcacttgaggtcaggagtttgagaccagctggccaacatggtaaagccccatctctactaaaatgcaaaaattagccaagcgtgttggtaggtgcctgtaattccagctactcaggagactaaggcaggagaatcgcttgaacccaggaggtggaggttgcagtgagccaagattgtgcactgcacttcagcctgggcaacagagtgagactccgtctcaaaaaaaaaaaaaatgctaatgtaacacatggctatgttagcatggttatctttagttatagaaaacacacttcacatttctgtgatgactctcaaatttgtgtctctagttttgaactccgtatgtgaatgttaattgcatatcaccacctgcagttttcacaggcagctcaaactcagagcatccaaactgatgcccaccagatctgttcctcttcctgcattccctttgctggttaatggcattgctggcagtacaccttctcaagccatgaaccttggattgatgctagaaacaaaaaacctgtcattccaaaacagagatctaagcatgtcactcctttttttttttttttttttttgtgactgagtttcgctcttgttgcccaggctggagtacaatggcacgatctctgctcactgcaacctccacttcccgggttcaagcaattcttctgcctcagcctcccaagtagctgggattacaggcgcccaccaccacacctggctaatttttgtattttcagtagaggcggggtttcaccatgttggtcaggctggtctcgaactcctggtgatccgcccacctcggcctcccaaagtgctgggattacaggcatgagtcactgcgcctggccgtcactccactttttaaatagcctaagtagaaagaaaataacataaaccttaggaggttttcccattaccttcaggattaagattagcatcttaagcagtataatgatgttcagggtccatcacgtttaccccagttttaatttccagactcaccttccaaagccccttctaagtcctttcctactggatctaccttatattctagtcatttagggccacttgccattatggaaacatgtcatgcctgtgtttatgctgctccttctggaaagtcttttttttttttttttgagacggagtctccctctgtcacccaggctggagtgcagtggcgcggtctttgctcactgcaacctccacctcccaggttcaagcaattctcctgcctcagcctccggagtagctgggattacagggacccaccaccatgcctggctaatttttgtatttttagtagagatgggatttcaccatgttggccacgctggtcttgaactgctgacctcgtgatctgcccacctcggcctcccaaagtgctgggattacaggcataagccactgtgcccggcctggaaagtcttttccttgttctgtacctatcaaaatcttacatccaggtcaggcgcggtggctcacgcctgtagtctcagcattttgggaggctgaggtgggtggatgatttgaggtcaggagttcaagaccagcctggccaacttggtgaaacttcacgtctaccgaaaatacaaaaattagcccagcatcatggcgcatgcctctagtaccagctactcaggaggctgaggcaggagaattgcttgaactcgggaggtagaggttgaagtgagcccagattgccccactgcactccagcctgggcaacagagtgagattctgtcttaaaaaaaaaaaaaagtgcatcctcttcaaggtgcaatccaactgttaccctttggcttttacaggtacctgtaaggagttgatgtgcaccttctttgtgctcacatagtgcttgtttatgtttttctagttgcactgtcacatcatgttagaattagcagtcagtgaatctgcttgcctccatagctatgaactctatctagtagctatacctgttacctcagtgtctgacacatggtcttgtacatagtagcactcaatgtgtgaacacaacgcaaatgtaaacgcactggtgacatcatctctaaacagagtggaaacctttgctagcctcaggtgcacaatccttcccctacctcacctcccgctgcaatgtgtrtcttgtaggagttaatttaggataatctctgaggtcatctccaggtaatcagcatctccaggaatcggcagggtaatttaattacccacacattcttcagtgcttcaggtgcagatctttaatctcagccacagatgggagggagagaattctcagtggagaagagagctggatttaaggtcggggaggaatgcgtattccccaaatggaatcagacagggcatgagatcatataacttgaagaatcatcatataatctaatgaactaaggacaggtgacatatttattaatatttctgtatacgaatttattttaatttattaggaaatacctctaacgtacaaaaagatgtaaataataatatagggccagatgtggtggctcacgcctataatcccagcatttgggaggctgaggcaggaggattgcttgaggccaggagttcaagaactaaaagctgtacaggcaccaagaatatgactgaatgtcacagtatgctctaaagggcactgtcctaggagtctggagacatgattttgagacttagctgttctcattggcggtatgactttgggcaagttgcttatcttttaacggtttcattttctcagttgttaaatttacagtttggtttaactaaagtctctcccagtacgagcagggcgtgagtcagagatacctaagtgtttagtgcagcgcatgtgctttctaaagtggggatggctatttacagactggcctacactgttctggtgggagccctcagtgaccaaggagcagaggtacctgaaacccacccttgaagccatctggatgctccgcttcattcaaatctggggtgttctaacccaaagtaactggccacagactgcaatgtaagatacaaatcttcaggacctagtgtrtgcacatgttggctcttatataagatggcatccttagtacttgttctatgtagaaaagaatttgtgggctcacaagtccctacagagtctcacactctcatggccaataagtatacagggatacccggaattagacaaacacagatgagacatttatttctgtatatgaatttattttatttatttatttattttttgagacagagtctcactctgtcacccatcctggagtgcagtggcctggctcattgcaagctccacctcccgggtttacaccattctgcctcaccctcccgagtagctgggactataggtgcccgccaacacgcccggctaattttgttgtgtttttagtagagacggggtttcaccgcgttagccaggatggtcttgatctcctgacctcgtgacccgccctccttggcctgccaaagtgctgggattacaggcgtgagccaccgcacctggcctgaatttattttcatttattaggaaatacctccaacacacaaaaagatgtaaataattagccgggcgtggtggctcatgactgtaatcccagcactttgggaggccgaggcaggtggaacaccagaggtccggagtttgagaccaggctggccaacatggtgaaacctcatctctactaaaaatacaaaaattagccgggagtggtggtgcacccctgtaatcccagctactccagaggctgagacacgagaatcgcttgaacctgggaggcggaggttgcagtgagctgagatcgcaccactgcactccagcctggacaacagagcaagactctgtctcagaaaaaaaaaaaaagatgtaaataataatactatcgggccaggtgcagtggcttatgcttgtaatcccagcactttgggaggccatggcaggaggactgcttgaggccaggagcttgagaacagcctgggcaacatagcaagacctcgtctctataaaaactattaatagtaatacaaatggccaggcgcagtagctcatgcctgtaattccagcactttaggaggctgaggcaggcagatcacctgaggtcacgattttgagaccagcctggccaacacagcgaaaccctatctctactaaaaatacaaaatttagctgggcatggtggcacacacctgtagttccagctgctggggaggctgaggcaggagaatcacttaagcctgtgaggcagaggttgcagtgacccgagatcccgccactgtaccctagcctgggcgacagagcaagactccatctcaaaaataataataataatacaaatatctatatatccatcagccaatttaagaataagacatgccgggcgcggtggctcatgcctgtaatcccagcactttgggaggccgaggcgggtggatcacaaggtcaggarttcaagaccagcctggccaagatggtgaaaccccgtctctactaaaaatacaaaaattagctgagcacagtggcgggtgcctgtaattccagaacctgggaggtggaggttgcagtaagccaagattgtgctactgcactctagcctgggcgacagagcaagactctatataaaaaataaaataaaaaaaaagaataagacactattggccgggtatggtgactcacgcctgtaatcccagcactttgggagccgaggcgggcagatcacgaggtcaagagatcgagatcattctggccaacatagtgaaaccctgactctactaaaaatacaacaattagctgggcatggtggcgcatacctgcagtcccagctactcgggaggctgaggcacgaaaatcacttgaacccgggaggtggaggttgcagtgagccgagatcgcatcactgcactccagcctggcgacaaagcgagactctgtctcaaaaaaaaaaaaaaacgaaagaataagacattgttgttgaagccccttaaatgtccctccccaatccttttttctctgcagtgttgaccattattatgaattaaagcttatcatccctaatgggacagttatgttttcacaggaagaatatgaaaagatgaatgtctgttgctgttacccagagacactttcacagctaaaaagacatacaaactcatactgactcaccgtctcttactcagcctcagagtgagctgcagtgttggcacacaaatacctcaacacactgctctccttctaaaatattgacaagctccgttacttatatacatggaatgacacacggtcttatccgttgaaactgtgatatgtagacacaattatgctcacatctagcaattttcagtagatacatgtaaacacacctgaatgggtaggacactgcacttgccactacattcccatagcacatcgtggatacatattgccacaatccccagggactgcaagcacactttttggcaaactgagatcaagatratagatgtaacttgtagtacccccacccaaaccctcacttccaggctatggttcacacgtccgactcatgacctgggggagctcagttctcgtctggacgtcattcagttttttctgctgccccagaatctggacatggctcagatgctgcatcggctcctgggtcacatcaagaacgtgcctgtgagcccagggtggagggcagggaggtggggaaggaggttgagggctgatactgggcagtgggcttcttgaggggcattagagtgagggaagagaaaacagcggctgtaaccttgtctgactgtagctgattctgaaacgcatgaagttgtcccacaccaaggtcagcgactggcaggttctctacaaggtaaggccttccttcttgaatcccaaaagtccaggtaaaggccctcagcctgtattccagactgtctgtaccctagacatgctgtccaattttattctaccctcttttttttttttttggagacagcctcgctctgtcgcccaggctgaagtgccatggggcgatcttggctcactgcaacctccgcctcctgggttcaagcaattctgcctcagcctcccgagaagttgggattacaagcgcccgccaccatgcctggcaaatttttgtatttttagtagagacaggatttcaccatgttggccaggctggtcttgaactcctgacttcaggtgatccacctgcctcagcctcccaaggtgctgggattacaggtgtgaaccaccaggcccggcctccctctttttttttttaactttgtattcaggaaaatgtaaaaaatatttagaataatataattaacccccatgtacccaccatgcagtttcaacactttaacttacgccaattttttttttatttctttttctttttttttttagacagagtcttgctctgtcgcccaggctggattgcagtggtgcgatctcggctcactgcaacctctgcctcccaagttcaagtgattctcctacctcagcctcccaaatagctgggattacaggtgcccaccaccacactggagtgatttttgtatttttagtagagatgggatttcaccatgttggccaggctggtctcaaattcctggcctcaagtgatctgcccatctcggcctcccaaagtgctaggattataggtgggagccaccgtgcccagcctagtatgtgtcatctatatctttttctactttcccctcttggattattttgtgggttttgttgtcgtttgtttgtttttttaaataaggtcctgctttgtcacccatactagagcagagtggtgcagtcatatttcattgcagcctctaacttctgggctcaagcaatcctcccaccttagcctccagagtaactgggactataagcctgagatgctgcacctggctttcttggattattttgaagcaagtcccagccattatatcatttcatccataaatatttcagtgtaatttcttttttctttttttttttttttttgagatggagtctcactctgtcaccaggctggagtgcagtggcatgatctcggctcactgcaacctccgcctcccaggttcaagcgattctcctgcctcagcctcccatgtagctgggataacaggcacatgccaccatgcccaagttttttttttgtatttttagtagagacagggtttcaccatgttggccrggatggtcttgatctcctgacctcgtgatccacccgcctcggcctcccagagtgctgggattacaggcgtgagccacctcacccggccaatatttcagggtaatttctaaaagaaaattattttttaaaaagaataacagtattgttatcttactttaaaaattgtattatttggtatcatcaaatatctgaaatttttcttttttgagacagggtctcactctgtcacccaggcttgagtgcaatggcacaattgtagctcactgcagcctcaaactgttgggctcaagcgatcctcccccctcagcctcctgagtagcagggaccacaggtgatggccatcacaccgaactaagtttttattttttgcttgcatttatttatttatttatttatttatttatttatttatttatttatttatttttgagacgggattttgctcttgtagcccaggctggagtgcaatggtgtgatctcggctcaccgcaacctccacctcctgggttcaagtgattctcttgcctcagcctcccaagtagctgggattacaggtgcgtgccaccacgcccagctaattttgtatttttagtagagacagggtttctccctgttggtcgggctggtctcgaactcccgacctcagatgatctgcctgcctcggcctcccaaagtgctgggattacaggcgtgagccattgcacctgaccaattttttattttttgtagagacaggatctcactatgttgctcaaggtggtctcaaactcctgagctcaagtgatcctcctgcttgggcctcccaaagtgctgagactattggtgtgagccacgatgcccagtcagatgatggccctagtcctttttaatctaccggttccttctctatcttttctctcttgttctttctttctttttctctttttcttctcctggcaatttgttgaagaaactagattattatttgtcttatagtgttttccattagcctggattttgctgtttgcatttcctagatgtttttggcacatttctctctcttctatagtttctgtaaattaatatttagttctagaagcatgattaggttcagagttttttttttttcaatactgttttagaagtagaggaacataatgtctgatatgtccgattgtctctctttttctgatgttggcaaatgttctgatgtttaatacctaaatctattattcatttatttatttatttatttagtttgaggtgagtctccctctgtcgccaggctgaagtgcagtggcacgatcttggctcactgcaacctccgcctcctgagttcaagtgattctcctgcctcagcctcctgagtagctgggacttacaggcgcacaccaccacgcccagctaatttttgtatttttagtagagacgggatttcaccatgttggccaggatggtcttgatctcttgacctcaggtgatccacccgcctcagcctcccaaagtgctggsattacaggcgtgaaccactacacccagccatctattaattctttagcaattacaaagtagtagcatttaaatctctgattctttcttcatttattagccagaaatttctgtaaagagaaacttccttttatgtactatttggttgccaagtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccatgcccagcccttttttttttccccaatatggaacgcttcttgaatttgtgtcatccgtgcccagtggccgtgctaatccctgtaaccttcgaaatttcagtatatgtgctgcagaaatgagcaccccccacctttatttactagctatcaatatggtaaattagttccctaacattctccaagatagccatgagatttttttgttttttgtttgtttgtttgtttgtttgtttgagatggagtcttgcactgttgcccaggcaggagtgcagtggcgcgatctcggctcactgcaagctctgcctcccgggttcgcgccattctcctacctcagcctcctgagtgcctgggactacaggcgcccgccaccacgcctggctaattttttgtacttttagtagagacagggtttcaccctcttaaccaggatggtctcaatctcctgacctcgtgatccacccgcctcagcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtgagtagaaggaaaaagggagtgcacccagggaggtcagggagagagaatgcagtgtgcaagatggggaaacatggaagatattgaggtcaattggataaagaatgggatggtgggaggaggcagcagaacttcagggaagtatctggagggtgagagttaaaggaggactgcagggagaaytggggcccaaggagagctgaggaacaggacagagggtgccaggtcctaagaaacagtacttatctcctcaggtggactttgagggcagccttgctgaaaatcgcttcacagtcctccccaacatagatcctgaaattgatgagagtgagtgttgggtgtggatgggcctgtgagccctgcgcagtgatggagtaccatccttggcaggtggtcaccacagctggggatcttcatagcaaccagggcaggagactcacttttgataaccacgtgtcttccaccctcgtagaaaagcgaagactgatgggacttcccagtttccttactgaggttgcccgcaaggagctggagaatctggactcccgtattccttcatgcagtgtcatctacatccctctggtgagggcaggagagtgggtgtagccttcagatgtmttttgggggagatattaggcttatgaaagacatactggtagataagaaaacttgtggggcagcctgaagaacatgaacacttttttgtggggatacagggatcttytaagctccctctagggtggggaggtgtccagtaagtctccaagcaggagagtagaktatctcctctttactctccccagattggcttccttctttctattccccgcctgccttccatggtagaggccagtgactttgagattaatggactggacttcatggtaagaccctcaacctctgtaaggtgagtgatgaggaaaatgagtcagcagctgaggaagagcgttactctacagcagcactgcccaatatgggatctctcctctgtagttttactctgagctttaccagcactgagacaaaggaaagagaagtcagagttaggggctggaggtggggttagaaagatggggaaggagaggaggaccaagagatgcaaagtccacagctttgaacccctgtacccagtttctctcagaggagaagctgcactatcgtagtgcccgaaccaaggagctggatgcattgctgggggacctgcactgcgagatccggggtgaggaaaagccagaggttatatgcattgtaagatgtttaaaaaaagcagcagccaggggaaggaggggagtgggcaacttggggatgcttccaacaggcccctcctcttcctgctctctgtctcgctcactctgactctatcttttcctctgaatgtcttgaggtctcagattgtatctgcarcctgtttccagatccccctaggggcctctgcctctccttcactttcccctggaactgacctccagctcccttcctcacccactcccagaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcaggtaagaatagaggcgggtggaggaatagacatgaggggcccaaaggctacatcttctgggggttcatctmtcttgatccacaagccatgcgaggtgcctctccgcccactgcagacatcctctgatggaactctgtgcccgaacytttgtgcccaactccacagaatgtggtggggacaaagggagggtcaaagtcatcactggacccaactcatcagggaagagcatatacctcaaacaggtgaggagaagccctgcagcctgggcctctggcgtctcctgcatctactccacccctacttgccagccaactcaggctcctgcagctcttctcccattttctgaccccgctcttcatgaaaggaccatcacccacatccctgtgcttccacctcacatgttcttattctccactggagagccatgctctaatggaactttccgtggcccaaattccttcacctgcctctgagtaggtacacaccactcccaagtatgtctctgcccacgtcccrtgcctcttcactgattctaaattagcccacagggctatggtcaggattcggggaggagagacagagtcagtgtgtctgttacctatttctcctgtttcaccctgtccatttctctttgatgtgccattcatgccttgagcctcactttcacctcagcccacggcaccaggccccaggccctgtctccttccctattcaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtcaaagggaacaaagggaggtgggattgaggaaggggataatgggaaaggaacccctgaaaatgctcataacaggaaagcatgccctctgctgcatgccctttatactaaaagtggggagcactaaggtcagagataagaagaatcaatamcataaacatttcttgaacccttgtttcatgtgagtcactgttggcaaagaggatgaacaaagcgtgcacctcaccattcaagaacttgcagtgcagtagggagggcatgtatacagctttattcacaggccaactgtggtcagtgcgttacgggcttccaatactaactttcccttgtccaccttatacccagcaggtggcgaaagcagtgaacaatgccactgcacagtcgctggtccttattgatgaatttggaaagggaaccaacacggtgaggggagaaactgatgaggggagaaactaaggaggggaaaatggaggaggatgaaggagcatgacagtgaggctgggcctctggaatggaatagggctgtgtgggcagaaaagaaatagaacacgagacagggaaaggcagtgcaagtgcagaggggcatatggggtccccatggctccgaatgctaacctctgccctctttgcaggtggatgggctcgcgcttctggccgctgtgctccgacactggctggcacgtggacccacatgcccccacatctttgtggccaccaactttctgagccttgttcagctacarctgctgccacaagggcccctggtgcagtatttggtgaggagaccaatctagctcctcggggacccccaggctgggcatttcccagaggtggggattggctcctctatcagaacaagggctccctcagcacagagaccacatcccttcccttttctccctccccacaggattggccaagggtttcaggacaggaaggaggtgattgatgatacactgtcttttattctcttttaagaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtgatgagatccaaatgtgcaaccacctccacatcagagctccctttcattcctagtcctactgggcctgggtctaggtccacaggatttctgacccttatttccccttctcttccccactccccttactcctcccaccttcttgcttgttcctaggtctcagacttgatccgcagtggaaaacccatcaagyctgtcaaggatttgctaaagaagaaccaaatggaaaagtgcgtatatggccccagtgtctttaccctctctgcatcttctcctgcaactcttctccccttttcagggactcagccttcctccagcactttgcccttcagaaacccaccatttctttctgaaatccctaaatcttcaagatcccaggttttctgtgccacagcctctcccctctgcccagggatttggttgtccattctgccataaatcttgcgattttctctcttcttcagttgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataargtttattttgaagaaagatattgtttctttagtctcaaaacaagagactaggaaagatccaaaacacagagcaggagtccacaggggaacctgccctgcctcagtaaaaatacagtgttgttgctgtaggragactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacycaggggcccagagcttcttcctttgggtgagtatcagcccaacaagaggtcccaggggaactctctcaatagatctgccctttatatttccattsaacttgagggcccacagtgttcccgcctgcctccccttgccctccaggtcctcagtggccagtctgggttcacactcagtgaccacacagtgaacccaactaggggtggagagaaagggccataacccagagccctactgtggcgtgagagtcagcctctgtgattgcctttcccagctaygcaggatgcaggctctggagagagaacaggatgccctgtggcagggtctggagctgctacagcatggccaggcctggtttgaagaccatctgagggaggcacagcgacagcagctgcatctaggggcccttggtgaggtatgggggctgcccctctgtgtgaatggggggaggaccagggagggaggaacagggaatgtgtagacacagcctgagaccactctggagaggggagagttaatggtcagggatcatgagttggaggcagcatcgtaatgacaggatgccaccaagtgttaagttggtgttcattgttggggctggaggaagctggtctgcattccattcagagggatttggatcactccatggagatgagggtgtggcctggattattccaatggggcagggatggacagggaggctccatgaagagtagtgaaagggggtattgtgctatttgagggagatggaggaactgatgtgctaaagagatggaggtggagagtactggattttcccacctgcctgggagggtactgggacgaggggatccagatgagagggatggcctgtggtgacaggaatagagtggcagacgacctcaggttttcaccatgttgtcagcctccaactcctcctctagaattttctaacagatttacactcagagcctggtcgcccccygttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggctgggaggagcccagaggccccatctgtttctcytccaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctccaaaaatgtctttggtttgtttctcatagggttaggaaaagtgcattgtgggaatatccattgccctctatcccagtcttgcagggtgttttgttttgttttgtttctgagatagggtctcactgtcgctcaggctgtagtgcagtggttcgaccacaactcactgcagcctcaacctcctgggctcaagtgatcctcctgcctcagcctcccagagtgctgggattacaggcgtgagccactgcacccagccccagtctcgaagtttctaagaaaggaaagggatgtgatggagaaagaaaaccttcattggctgggcacggtggctcacgcctgtaatcccagcactttgggaggccgaggcaggcagatcacctgaggtcaggagtttgagaccagcctggccaacatagtgaaaccctgtctctactaaaaatacaaaaaattagccgggcgtggtggcgggcacctgtgatcccagctacttgggaggctgaggcaggagaatcgcttgaacctaggaggcagaggttgcagcgagccgagattgcgccgctgcactccagcctgggcaatgagcaaaactacatctcaaaaaaaaaacaacaacaacaaaaaagagaaaaccttcatcccagctaggagaggtaaggtcctaagacctatgtgacaaatgtgtcccaggtcttcttaccaatggggcaggttgaaaatagtgctggagacccatccctttagagcccgttgtgtcaccaggaggccaggcctagcagaagcagcacccctccaactgtgccccaccaggggctgcccgcagccagccctgccccagccctgccttgagtcaccaatgtgaagggggaaaaggcaggggtggccgtggtgaggatcgggtcagatgagccggtaggggtggtgtgccggtcctgtggggaaaaggaagagaatgacagggtgtgctagagctgtactcaaattaaacctacaccaccctccccggccttgcccaccctgtgatggaaagtagtagttcctcacctgcggggctggggccgataccaggagccggaggaaagcatgagtcgggggtactgggttggcttctcgtccccctgcagtcacagtcaccatcaccacggaatccggggccgctgaatctgggacctccagccacaggcggccccaggccgactcattcagttccaggtgagccctggagagaggatataggcgtcgctaaagctccaggctgcccagagcctagagtcgggacgcctgcaggggcacgggagcggagaggaggattctgagggccagtcggagggggacaggggcagggcttgggataagcattggccgggcaagatgccagagggagctggagggttcatgagcctcacctggagaggttggaggtgagggagaagctggggttgacgaaagtcctaaggtcaagatcctgagggcccgagaagctggcgatgcggagactgagcgggactttgctgcccggggccaagaaacccgaggggccactaagctgcagagaagggttcttcagggaaggggccgctctaactctctccagccccagccgcactttcccctggcgtctcacctccagaaggacagggactacagtgctaggctgaggggcagccctgtgcaggcgccgccccgctgcgtcctggccaatcagctccagggagaagggtctaggggtggacagcagcgtgggcgacagcgaggctgcgaggagacctcgctccggaggtcccacgggctccaagggcacctggcctagttcggcaccctctgggacccctcgaaggatgacgtgggagaaatgcggctgaggatccccaggattggctctggaacccaaccctgtcacttctaccagcagctgggtctgaagacctgggacaggggcgaggaggggagaacattgtgagattcggagacacagggagaaaagaattaatggccttcaaaataggggttccctctggggagtatggatgggaaaataggttaccttcgaggggtattgatggggagcatcaggagggagttctggggtgctggaaatgttctatatcctgaactgggtgtattatatgaaatccatcaaactgtacactttagtgcacattatgtaaattataactcaatataaaagttatgcatatgcacagatgtatgtatacatatatacattatatatataatatatatattatatattatatattttatatatatatataaaactgggggttaggtgggtgggggctcagggaataaatgtacctgcaactggctgagtcagggggtagaggccagggtggggtccatcctccatggggatcccaaagtggaagaggaagtccagggaggtctgggctgggaaagggcaaaggcagtcagagcccttcctgaaaggaatgtgactgatcgtgttctctgaggcctgcagtctctgcttccccttcccaggaacacctccctccttaccttgcactctcaccccaggggtgtcctcagctgtgacctggatctcccaggttcctgtctgtggagggtcatccatggtcaccatccagaactgcccaaagcggcgagtgtgacctagaggacccccgccttcctcctggccctgggagacccctggggtcagggaagagattgtcacatgaagcacttgctctccttgagtacatcccctcgattgtctattccccggtcccctctcttccctctaccttcagaggtacctgcagggttcttgatccagaagctgctgatgtctccgtggatccggactgtgatcttctggagcagcccatccacgctgaacacaagtggctgcccaggcaccacaacaggagggtccaggggaagagtcaccttgagggattggcaggaccagaaaatggggaagaagatgaggtatgggatgaggaacaaagaagaaaggggagatagaaagaaaccacgtcattgggccgggcgcagttggtcacgcctgtaatcccagcactttgggaggctgaggcgggtggatcacaaggtcaagagttcgagaccagcctggccaacacagtgaaactacatctctactaaaaaaaaaaaaatacaaaaaattagccaggtgtggtggtgggctcctgtaatcccagctacttgggaggctggagcaggagaatcgcttgaacccaacaggcagaggctgcagtgagccaagattgtaccattgcactccagcctgggcgacagtgcaagactctgtctcaaaaaaaaaaaaaaaaaaaaaagaaagaaaaagaaaaaagaaagaaaccacgtcaaacaggcagaaagggataccagtaagagaggggcacggggccagggatgaagttattatggtcagagacaaagttggaggcaagggattcaggatgagacaatcacatcttgtgccccattaaaagatgataggccaggcgtggtggctcatgtctgtaatcccagcacctgggagaccaaggcaggaggatcacttgaggccaggggttcaagaacagcttagtcaatatagcaagactctgtctctgcaaaatacaagccacctccccaaaaagatggtaggacttcctgtggtaaccctggaggcagaatactggaagccaagtggggagaggtttactgatataaaaggacaatgcaggccaggcgtggtggctcgcgcctgtaatcccagcactgtgggaggccaaggtaggcggatcacttgcggtcaggagtacgaaaccagcctggccaaaaaaacggtgaaaccccggctctactaaaaaaatacaaaaattagccaggcctggtggtgggcactggtaactctagcgacttgggaggctgaggcaggagaatcccttgaacccgggaggtggaggttgcaatgagccgagattgtgccactgcactccaacctgggtgaccataagactccatctcaaaaaaaaaaaaagaagtggctagtcatggatctaagaggaagagaaacttcctttcctgccccgtgactggaagaacaacacagcagtgagagtgattcccctttctcctataagaagagaggtgcagcctgaccacccttcagttcctaagtgagggccctggcccccacttaccagggcagccatgctctccccaacaatggctgccacgtctcgaatgtgctggtctttggtgaagatcacctctcctcctgaggccagggccactgctttgtatggctcaaaacgcagaggggacaagatctcacgccgagctcgaccctgaacccttgatgtatcttcagtcaccaggaatgttacctgtacccagaagagagctcagtgattggggtgtccaagtgccatccactattatgaatgagaatccctgtgctcaagctttctccagagctgatggtttgtgataaggtctctgcctgccttctggctgctggggtggggaatcccaatgacagaaccccctgccttcagttagtagttggccacccccttgtaactgtcacagtggatttttggcgactagagccccagttcttcacattgtttattaggcagggtcaaataaaaattcagcgttattaagggtagggcctcttacgtatatcattaaaggtatcaggaaatgttccactcattgtctgcttctcccaccatataccaaggcttgttgggccaccatagtgtggtgcaaccctcgttatgagattgtcatcacagggtctctcacatccctgggaggctaacactgggtctcccactagctctgctcacccggcagcgccgctcctgagtcagggattccacctggttggtgagaaaggcatccttgggggaggcatccgtgaagacaaagatatctgagagtggaggtgtgtgcagcagggccagctggcagggaaggcaacgaccagtgttaacaatggcagtaggaggggaatgggtagagccacggaggatgaagcagaagggaatatggcccgggaaccctacagtgaagctagtggatctaggtgctgaaggtggtggggagccccaggagggatctagctccccctggtggtggggccaggaaacggggaagaagggaggggccagacctgcagggctgacaggcacatctcaggctcgtctccaccccccaaggcatggatctcattaagctgttgccagaagctgtcagggtcactggttgtaaagacagggccgaaccctgggaaggggaaaggaggttaagataagtgaggaaagagctcccctcattcttacccagagccacctccccagttgaggggcctggtgtgcttctggagccgacaggtattgaaataacaatactccattataagactcatacttggccgggtgcggtggctcacacctgtaatcccagcattttgggaggccaaggtgggtggatcatgaggtcaagagatcaaaaccatcctggccaacatggtgaaacctcgtctctactaaaaaatataaaaattagctgggcatggtgatgcatgcccgtagcctccccagtagcctccccagaggctccccagtagcctccccagctactggggaggctgaggcaggagaatcacttgaacccgggaggcagaggttgcagtgagccgagatcgtgccgctgcactccagtctggcgacagactctatctcaaaaaaaaaaaaaaaaagtcatacttgtcagtgcagggcggggcagggcggggcagggcagggcagacctaggtgtccctggtgggaaggtggcctccactccctgaaaaaaatggtggcatttcctgtaggcctttattggctacatgtgcgtatataaaaaaaaaaatggtcacacctattatcccagcactttgagaggctgaagtgggaggatcacttgagcccaggagctcgagatcagcctgggtaacatagtgagaccccatctctacaaaaaaatacaaaaattagccagatatggtggtgctcatctgtagtcccagctactcaggaggctgtggcaggaggattgcttgaatcgaggctgcagtgaggcatgattgtaccattgcactccaacctgggtgacagagtgagactctccctctctctctctcaaaaaaaaaaaaaaaagaaagaaaaga

SEQ ID NO: 10837 - DNA, 32668 bp, Homo sapiens
  misc_feature (1)...(32668): n = A,T,C or G, or insertion/deletion polymorphism (see Tables 1-2)
gctggccgggcggggggggctgaccccaccacctccctcccagacggggcggctggccgggtggggggctgaccccccacctccctcccggacggggcggctggctgcgtggggggctgacccccccacctccctcccggacagggcggctggccgggcagaggggctcctcacttcccagtaggggtggctgggcaggggcgcccctcacctcccggacggggtggctggccgggcagggggctgacccccccacctccctcctggagggggcggctgccgggcggagatgctcctcacttctcagacggggcggctgccgggcggagggtctcctcccttctcagacggggaggctgggcagagaccctcctcacctcccagacggggtcgcggccgggcagaggcgctcctcacatcccagacggggcggcggggcaaaggcgctccccacatctcagacgatgagcggccgggcagagacgctcctcacttcctagatgggatggcggccgggcagagacgctcctcactttccagactgggcagccaggcagaggggctcctcacatcccagacgatgggcggccaggcagagacgcccctcacttcccagacggggtggcggccgggcagaggctgcactctgggcactttgggaggccaaggcaggcggctgggaggtggaggttgtagcaagccgagatcccgccactgcactccagcctgggcaccattgagcactgagtgaaccagacaccgtctgcaatcgcggcacctccggaggccgaggctggcggatcactcgcggttaggagctggagaccagcccggccaacacagcgaaaccccgtctccactaacaaaatacgaaaaccagtcaggcgtggcggcgcgcgcctgcaatcgcaggcactcggcaggctgaggcaggagagtcaggcagggaggttgcagtgagctgagatggcagcagtacagtccagcttcggctcggcatcagagggagaccgtggaaaggataattccactattacttgtcttttggggtttgtttttattctctctttgagttttgtttccttatgcgcccagttacttttgaaaatgttctgggcagatttgcctagattaataaatgccctccatgttccaattacttttttttttttgagacagtgtcttaccctgtcaccaagctggagtgcagtggtatgatcttggctcactgcaacctctgcctcctgagttcaagtgattctcctgcctcagcctcccaagtagctggcattacaggcacctgacaccacgcccagctaattttttttttttttttttttttgagacggagtctcgctctgtcacccaggctggagttcagtggcatgatcttggcttactgcaagctctgcctcctgggttcacccattctcccgcctcagcctcccgagtagctgggactacaggtgcccgccactatgcctggctaattgtttttttttttgtatttttagtagagatggggtttcaccgtgttagccaggatggtcttgatctccggacctcgtgatccacccgtctcagcctgccaaagtgctgggattacaggcatgagccaccgcatctggcctatttttgtatttttaatggagaccgggtttcatcatgttggccaggctggtcttgaacttgaacttctgacctcaagtgatccacccttagcgtcccaaagtgctgggattacaggcatgagccaccgtgcccggccccagttatttttatttttattttttgagttagagtctcactctgtcacccaggctggagcgcagtggcatgatctcggctcacagcaactttctgggttcaagcagttctcctgtgtcagcctcctgagtagctgggactacaggcacacatcaccacgcccggctaatttttgtagttttagtagagacggggttttaccatattggtcaggctgatattgaactcctgacctcaggtgatccacccacgtcagcctcccaaagtgccgggattacaggcttgagccatctcgcccggcctacttagatgttatattagtggtaattcctgttatcctgtgagctctttagtgtctaaacaattttttttaagagatggggtctcactgtgttgcccagttgcaatcatatcttactgcagcctcaaactcctgggtcaagtgatcctcttgccttagtctcccaagtagctaggaccataggtgtctgcccccacgcctggctgtttttacattttttgtagagatgtggcgggtgggggggtctcactgtgttgcccagactggtctcgaactcctgtcctcaattgatcctgctacctcagcctcccaaaatgctgaattacaggcatgagccactgtacctggtcttaaacaattttaaaataacatttttatccaggattttagttaattttcaacaggtggattagttcttgctgtattctcgtaaacagaagtcctggtttatttttatttgttttaaacattgaatcccatactcctccccaccttaccctacccagaatttagactgttaatgttttgaagccacagcctgcatcttaatcactattttatcttagtgcctggtcttagaaattatattgactctttgatagaccatatataaggcaggtggatgagaatgtgggtagctagttggaaaaggctgcttggtcatttgcttgattattttctcacacagtttttcctttactaagagaaaatgcccccatattggcaaacaaaatctccctgcctgagagcgcccagagtatagcagagcatcttaccctgatacgcctcttttcactctcttctctgtggagacagaaggagcttcaagagcagggggagatcagaatcgtccagctgggcttcgacttggatgcccatggaattatcttcactgaggactacaggaccagagtatgtgactgtgtgcgtcaggggtgctggggggagggcacaggttgggggagacagggaagttgggaaacagaaataaaaacaaaagaaagaatttccctgcccccacatcccatggagagggcacagggccctggtaaatagtaatatgagggagagagacaggagggaaagagggaggagtgagagggtaaagagggggggagaggagggggaggaggaggaaggaaggagggggaggaggagggggggaggaagagggggaggaggatgaagaggaggaggaagaagaagggtatgagaggtggaaggatctgagcaagaggtaagacaggaagagaaatgctgtcctgggggtggaggttggtagagagtgagggtggggatggaccatgtctctcatctctgcttgtaggtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattttctggatgtcctttatttactgtgacgtgtgtttgggtgccttgtttaggggtagaggtgaagtctgagctttgcctcattcagagaggaaaggggtcaggggttcactctgacgttcaggccattctccctgtggagtggtgagggtgtacctaatctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgawcctgtcykytctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggkcttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctaygttgctgcagccatcattgagtntccaggtgggtgactttcccttattgtaaccccagacccttgcctctgacctctgagctaaccctctgtcctccrgcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgkgtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagragactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaayttattgtctcatatttttatggmcagtttatacaggcaccccacaagtccttttcccaacatgcccccctccstttttttttttttaaccgctattgctattatggcttatttgtggtgtttggtctgttttcagaagtgtcttttgcatctgtagactaaaagtaaacagcataaacagatacacattaaagtaaaatttgtaatagttgatcmtttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaatacgtttacacacggaattttttacaattatcattttaaaacttgtttagatctttaaaacaaaattaaacaaccttttttgtataaattttttataactttttttatgacttttacagacaatttttaacatgtcttaactttttatgttttataatttttttactaaaggtacatttttataactttttaaatttttttacttttttgtatttttttgatttttgtcttagtcttttttttacttttatttttttaaatgtgtaataattagatgagtgttggtaacaatggatgtatgtacatattttagtttttaaaatttagggatgtgtttaacatctgtttgccagaactgactaggttccaattctttacggttaacacctattgaaggagggtatgtgcctgtgagctggtaatctgggcattgtgggataatttgtttagccagcctctgtgtaagttgaaattatttagataagtttctccaattttggtggaataatcgatgtgattgggtggcttggtcaagcagtgatgtcataacctgaaggtctgcttgattattgccgtaagccaatgggccaggcagagagctgtgggctcgaatgtgtgtaataaaagtaggatgtgtaccttggtctagtaattgttgaagttgaagaaaaagaccacacagagtgggctccagagcaaacttaaggctgtaatagtttttaaataaatacacagaataaccttagctctctgaatgttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaartttaataattcatatatgagcctgtccaattagaattgccatctgatttaagtanactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaatattgagaagagattagacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggakagttctgcctacaaaagtttgacaaactgtgggactatttaacataccctggggcaaaactttccaatgatatttggctgcaggttttttgttattaacrgcaggaatggtaaaggcaaattttttgaaatctgcctctgctaaaggaattgtaaaaaagcagtcttttaaatctataataacaagcggtcagtctttagggagcacagtgggggatggragcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggcacggtgagccaagtctcgggctccctccccctgcacccactcggctgaggaggaggtggccattctggacatttctctacaggaaccgtgggctgaacaattttttgagtaggtttagggagactggggagattggcataaatcatcttcagactctcctttttgttagtactcggtagaggtggttcagagttctgattatcaaactcctctctctcctcctctgactcagcctcattatctgtctgaaaaggctccagtgctgcatgcaccaatgaccaaagcgaccaaacaggcaaaggaatttcctttccttctctatatgctcttttaaggtcctttccaactccttcttaatgttttaatttcaaagtttcctgttttgggaaccaagggcaaaattgttccatagcatgaaacaaatccataagattttccgtatcaacttttaccccaccatgcatgcttgaagagctgccgtaggaagctcaaatacgtggtgtacttactttcagtttttcccattgtgtccctagctttctctgggcgccccgcttacctgtagaggttaaaacttttatgtccttgggagtcctttgttcgttggtcctctgtttcacatgcttgagcgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagygctttaaatgaatctcctttgtgctcaaacagcatatctttaacttatcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacaggaatacggcagcctgygccctgggagctcactgtcttgtgggagggaaccactcaagccactcccyacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaasgatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagaygggagcggccaagtcagcattccaataattatccctcagaccatctcagagctgcagctctcagtaggantcctcggkcccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggcyggattctcgacctcctcgtgttggggacactctgaacctgaacttgcgagccgtgggcagtggggccaccttttctcattactactacatggtgtgcatgagctggggagtcanggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccmtggagaccacccagtggccaactccctgcgagtggatgtccaggmtggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctkcctctctgcccctcrgctccttgctgaacccacgtgtggtatttggggccagagatccgaattccgggattacgagtggaaggtgggcagctctctccagcagcctctcttatgttgctggtctcaaggggtcggggcgggkgctgaggtgtatgtcctttttgtcctctcatgctcacccccacctggccctgcagtgggtcagtatgcttccccgacagccaagcgctgctgccaggatggggtgacacgtctgcccatgatgmgttcctgcgagcagcgggcagcccgcgtgcagcagccggactgccgggagcccttcctgtcctgctgccaatttgctgagagtctgcgcaagaagagcagggacaagggccaggcgggcctccaacgaggtgaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgacccngmttccatttccctgtaccccagctccctgtyccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctratctctgcccctgtgcccacgcttcctttccctcaggcctatgtgtggccaccccagtncagctccgggtgttccgcgagttccacctgcacctccgcctgcccatgtctgtccgccgctttgagcagctggagctgcggcctgtcctctataactacctggataaaaacctgactgtgaggccccatrggagcctgagcatacaggagttgggggagccagggcccagtgaggggtggggaggctaaccgggccaggactctggccatcctcgttttcctgccctcaggtgagcgtccacgtgtccccagyggaggggctgtgcctggctgggggcggagggctggcccagcaggtgctggtgcctgcgggctctgcccggcctgttgccttctctgtggtgcccacggcagccrccgctgtgtctctgaaggtggtggctcgagggtccttcgaattccctgtgggagatgcggtgtccaaggttctgcagattgaggtgaatggagcacccctgaatataagtccccgggccccragctttgtcctccaccctcagcactctctctgctrgccaggccaggggcccaacacccnaaccaatgccttggtctgttcccatcttctacaattctgatccaactctgtccctggagttgaaactcaaagttctgggggagtctgngctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttccccmatttccccagaccaccgaggccggaccttggaaatacctggcaactctgatcccaatatgatccctgatggggactttaacagctacgtcagggttacaggtgggagtgccctttagtcccttcccagtggccaccttcggattcatgtgggacytgtggatccctgcttggtcccactccccgtgagcctctgacacagagtcctcagacctccaccctctccctcccatgtagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactkcctcccgagaccaaggaccacgccgtggatctgatccagaaaggttctgggtgcaagggcaagcaggagggggkccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacgggncagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggntcgcctgagaaactgcaggagacatctaactggcttctgtcccagcagcaggctgacggctcgttccaggaccnctstccagtgwtasayaggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaarctcatttttgggggagaaagcaagtgctgggctcctgggtgcccacgcagctgccatcacggcctatgccctgacactgaccaaggcscctgyggacctgcksggtgttgcccacaacaacctcatggcaatggcccaggagactggaggtgaggggtgaggcgctctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactcgtggtctcccttcactttcagataacctgtactggggctcagtcactggttctcagagcaatgccgtgtcgcccacsccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggsgggggtgggtagtcctcagaccaagggcttgcttgagtcctggctcaacctccctaggacacggtgattgccctggatgccctgtctgcctactggwttgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccancctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttantggagccgcaaaaacaggtttgcttgtgcccttctaacatcgccttcccttttctgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatccrgtagcccagggagatgcccttaggtatggcaccagagaggtctgtggcctyacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaascaaacgaggactatgaggactatgagtacgaygagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtytccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagtngtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtcyccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggcygttttggtctctctgggtgtagcctgctcctcttacaggtcatgcacgcagcctgtttgctctgacaccaacttcctaccctctcagcctcaaagtaactcacctttcccccttctyctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacrtcatccccgcagccaaggatgtcaaggccgctgctaatcagatgcgcaacttcctggttcgagcctcctgccgccttcgcttggaacctgggaaagaatatttgatcatgggtctrgatggggccacctatgacctcgagggacagtgagtcatctggtcccctcagtctcttgtcctccccatgcctygccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaaygacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctccctctcagtcctgatcatggattcagcagcagcgaactcgccaatgtagtgggtggcacagccagggtcttgactctggctctgcagtagcacagtctggaaaagctctgaggggagagagacccccactggtccgagggtctggcacagagccagaaatgggggggaaggtatggggctgggtcgcctctgacctctcaggtaccatccaggaggccctggcctctcactgaacccggccactcctctttggcatggcctcttcccaaatccccaaactgcctccttacccacaaaagtggtctctgagtgtcagtccagtgggacccccaccccttatggcttcagttccccaaatagggctggacccttgatcctgatccagctgtggctatccagccccttcctggggactttggactttgaggggggcatgcccagttgtgctgggaatccatactttccctggctggagtagaacctgtggactgtagtcctgagggcagtcatgttctgcctgtgcctggaaacacaagaaacttgactgcagagagaagaaagaggagagaggaacagagcgaggaaaccgcccgtctccggggctttttctgttccctatccttgactttctaagaccagtggggtcccctcctctgcttctttttcctgagttctgtgaaattccccaattcttattttttatctcaaaccagctcaaggtgggctgttttcctttcaaccaaagaaaggtgctcctggtggctaaaggtacatattcgacagctagatttccaggctggaatcctgccctccacaacatgcgaacaatacccgtgttgcatatagagcatggctgtgaagagttgagtgagtgcccacaaagcacttagagcagtgtctggtacatgctattactccgcagcgggaaaccacttcctcctttgtcttctgggcacttttgtgagtgaaaggaggcactaataacaatcacactgggatacctgtatatactggaatgccccaggcaaaccaggcttaaactgtattactctatctgtagcttaaactaacaaacaaacccacacaaatcacattttgttcttcaggcgattcaggaaggcctattaggcagggactgccattttctctctgagacaaacatcatgccagtaaactggcccacggtggggtggcagagggagagggcccaggtcggggcggacacccttgcctgcacgggtgatgtggaaccagaaagctgactctggatgcaggaaaaaggtcagggttgcatttcccttccttgcttctcgatgggtgattaattttttttgaaatacggacgtcccaaggccaatgagactggtgtcattccagaaaagggccactctgtgggtgggtcggtgggaaggcacctgagggtggggtcaagggaggccccaaaacagtctacacagcaggagggatggctggggctcttgagctataagtggcacctcagggccctgacgggcgtcttgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaaggtgagaggctgatctcgctctggccctcaccataggagggggcggaggtgacggagagggtcctctctccgctgacgctgctttggctgtctcccagatgtggtggtgctgaactccaagaggaccattgaggaagccatggtcaaaaagtgggcagactttgctggcagacctgagccacttacctgtaagggctgggggcattttttctttcttaaaaaaatttttttttaagagatgggttcttgctatgctgcccaggctggtcttaaattcctagtctcaaatgatcctcccacctcagcctcaagtgtgagccacctttggggcatccccaatccaggtccctggaagctcttgggggggcatatctggtggggagaaagcaggggttggggaggccgaagaaggtcaggccctcagctgccttcatcagttcccaccctccagcccccaactcctcctgcagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgaggtaaggctgggctcctgaggccacctcgggtcagcctcgcctctcacagtagcccccgccctgcccgctgcacagcggcctgctgaactcacactgtttctccacagcgcatgagagcccagcccggcacccctgtggccattgaggaggaattctctctcctcacctgcagcatcatctgttacctcaccttcggagacaagatcaaggtgcctcacagcccctcaggcccacccccagcccctccctgagcctctccttgtcctgaactgaaagtactccctccttttctggcaggacgacaacttaatgcctgcctattacaaatgtatccaggaggtgttaaaaacctggagccactggtccatccaaattgtggacgtgattccctttctcagggtgaggacctggagcctagacacccctgggttgtaggggagaggctggggtggagggagaggctccttcccacagctgcattctcatgcttcctgccgcagttcttccccaatccaggtctccggaggctgaagcaggccatagagaagagggatcacatcgtggagatgcagctgaggcagcacaaggtggggactgtgtgtggacggcctcccctcggcccacagccagtgatgctaccggcctcagcattgctatgaggcgggttcttttgcataccccagttatgggcctgttgccactctgtactcctctccccaggccagccgctcagcccgctcctttcaccctctgcaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgaggtgcgtcctggggacaagcaaaaggctccttcccagcaacctggccagggcggtgggcaccctcactcagctctgagcactgtgcggctggggctgtgcttgcctcaccggcactcaggctcactgggttgctgagggagcggctggaggctgggcagctgtgggctgctggggcaggactccacccgatcattccccagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcaggtgactcccgagggttggggatgagtgaggaaagcccgagcccagggaggtcctggccagcctctaactccagcccccttcagcatctccggctacgacatccctgagggcacagtcatcattccgaacctccaaggcgcccacctggatgagacggtctgggagaggccacatgagttctggcctggtatgtggggggccgggggcctgccgtgaaaatgtggtggaggctggtccccgctgccgctgaacgcctccccacccacctgtccacccgcccgcagatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcga

SEQ ID NO: 10838 - DNA, 15585 bp, Homo sapiens
  misc_feature (1)...(15585): n = A,T,C or G, or insertion/deletion polymorphism (see Tables 1-2)
ccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccggctggcatcggtcctgccccatcactggctctggcccgggctgtgggcccccatcccccggggctgcagccgcacttggaaaggctgcatcttgaggatgacactgcagtggggcaggggctgcagggagggcagggcgtccccggagggcagcagcgtgaaggcctgcagcagtcgggtcagcaccacgaagagctccaggcgcgccagcggctcgcccaggcacacgcgggcaccgcagccgaaggccagagctctggagttcttgcctggctccaggaagcgatctgcgggcgggtggacaggtgggtggggaggcgttcagcggcagcggggaccagcctccaccacattttcacggcaggcccccggccccccacataccaggccagaactcatgtggcctctcccagaccgtctcatccaggtgggcgccttggaggttcggaatgatgactgtgccctcagggatgtcgtagccggagatgctgaagggggctggagttagaggctggccaggacctccctgggctcgggctttcctcactcatccccaaccctcgggagtcacctgctgggccgtgtggtgcggtggggcaaggctaagggcacaacgggccgcaggcgcagcacctcggcgatggtggcattgagcaagggcagccgtgcacggtccttgtaggggacccgggagctggaggcaccagggcccagttcgtggtctagctcctcctgcagtcgctgctgaatctggggaatgatcgggtggagtcctgccccagcagcccacagctgcccagcctccagccgctccctcagcaacccagtgagcctgagtgccggtgaggcaagcacagccccagccgcacagtgctcagagctgagtgagggtgcccaccgccctggccaggttgctgggaaggagccttttgcttgtccccaggacgcacctcagggtggtgaagcaaaaaaaccacggcccaggagagggtgtttgctgtggtctcagtgccaccgatcaggaggtccactgcagccatgtgcacgtgcccttccaggagctgtccagagccctcttccatgctcggctgcgccaccccttggagcatgtagtccatcatgtccctccactggcctgccacgaggctctcctgcagagggtgaaaggagcgggctgagcggctggcctggggagaggagtacagagtggcaacaggcccataactggggtatgcaaaagaacccgcctcatagcaatgctgaggccggtagcatcactggctgtgggccgaggggaggccgtccacacacagtccccaccttgtgctgcctcagctgcatctccacgatgtgatccctcttctctatggcctgcttcagcctccggagacctggattggggaagaactgcggcaggaagcatgagaatgcagctgtgggaaggagcctctccctccaccccagcctctcccctacaacccaggggtgtctaggctccaggtcctcaccctgagaaagggaatcacgtccacaatttggatggaccagtggctccaggtttttaacacctcctggatacatttgtaataggcaggcattaagttgtcgtcctgccagaaaaggagggagtactttcagttcaggacaaggagaggctcagggaggggctgggggtgggcctgaggggctgtgaggcaccttgatcttgtctccgaaggtgaggtaacagatgatgctgcaggtgaggagagagaattcctcctcaatggccacaggggtgccgggctgggctctcatgcgctgtggagaaacagtgtgagttcagcaggccgctgtgcagcgggcagggcgggggctactgtgagaggcgaggctgacccgaggtggcctcaggagcccagccttacctcacagaactcctgggtcagctgctccaccactggctccatggagtcacggatgcccagcagcagggctgagcgggtgagcttcttgtgggctttccagagcagggagtagtctcccaaggacaggtccgggtagttcctagacaccagcttgtctgcaggaggagttgggggctggagggtgggaactgatgaaggcagctgagggcctgaccttcttcggcctccccaacccctgctttctccccaccagatatgcccccccaagagcttccagggacctggattggggatgccccaaaggtggctcacacttgaggctgaggtgggaggatcatttgagactaggaatttaagaccagcctgggcagcatagcaagaacccatctcttaaaaaaaaatttttttaagaaagaaaaaatgcccccagcccttacaggtaagtggctcaggtctgccagcaaagtctgcccactttttgaccatggcttcctcaatggtcctcttggagttcagcaccaccacatctgggagacagccaaagcagcgtcagcggagagaggaccctctccgtcacctccgccccctcctatggtgagggccagagcgagatcagcctctcaccttgcagcccaaggtggagcctgtagatgggcccgaatttctgagtcaggccaagcagatagatggggaggtcgggctgcagcaggtgcaagaagcccggggcaagaggcgggaggtggaggctccggagcttccaccagttccacagcaggcgggcgccagccagcaggggcagcagcagcagcaggcccaggagcagcatggcaagacgcccgtcagggccctgaggtgccacttatagctcaagagccccagccatccctcctgctgtgtagactgttttggggcctcccttgaccccaccctcaggtgccttcccaccgacccacccacagagtggcccttttctggaatgacaccagtctcattggccttgggacgtccgtatttcaaaaaaaattaatcacccatcgagaagcaaggaagggaaatgcaaccctgacctttttcctgcatccagagtcagctttctggttccacatcacccgtgcaggcaagggtgtccgccccgacctgggccctctccctctgccaccccaccgtgggccagtttactggcatgatgtttgtctcagagagaaaatggcagtccctgcctaataggccttcctgaatcgcctgaagaacaaaatgtgatttgtgtgggtttgtttgttagtttaagctacagatagagtaatacagtttaagcctggtttgcctggggcattccagtatatacaggtatcccagtgtgattgttattagtgcctcctttcactcacaaaagtgcccagaagacaaaggaggaagtggtttcccgctgcggagtaatagcatgtaccagacactgctctaagtgctttgtgggcactcactcaactcttcacagccatgctctatatgcaacacgggtattgttcgcatgttgtggagggcaggattccagcctggaaatctagctgtcgaatatgtacctttagccaccaggagcacctttctttggttgaaaggaaaacagcccaccttgagctggtttgagataaaaaataagaattggggaatttcacagaactcaggaaaaagaagcagaggaggggaccccactggtcttagaaagtcaaggatagggaacagaaaaagccccggagacgggcggtttcctcgctctgttcctctctcctctttcttctctctgcagtcaagtttcttgtgtttccaggcacaggcagaacatgactgccctcaggactacagtccacaggttctactccagccagggaaagtatggattcccagcacaactgggcatgcccccctcaaagtccaaagtccccaggaaggggctggatagccacagctggatcaggatcaagggtccagccctatttggggaactgaagccataaggggtgggggtcccactggactgacactcagagaccacttttgtgggtaaggaggcagtttggggatttgggaagaggccatgccaaagaggagtggccgggttcagtgagaggccagggcctcctggatggtacctgagaggtcagaggcgacccagccccataccttcccccccatttctggctctgtgccagaccctcggaccagtgggggtctctctcccctcagagcttttccagactgtgctactgcagagccagagtcaagaccctggctgtgccacccactacattggcgagttcgctgctgctgaatccatgatcaggactgagagggagaaaacaggattgggatttctggggttgggcaatgacagctactgccttcttcatggttgacctcccagaccgggccatgtcttgctgcaactgaatccctggctccggaaaatgggcttatgccaccaccatgctgagcagctactgggagaaagatctgatgagcaaccatagggccatgtatgcaagagcctcaggaaacctctgccacagtgggaaaggcccaaacttctcaaagttacgtgggataagacagtgctcatcggaaaggagcgcacctggaaggctgacgtgcttactacttgtctcaccatctccatctcttccaccacttccaaatccaaactccgaatgtggtcaattacatgcaatgtccccaaaggtaccctgtcctgcccccggcctctgggcctttgtatattctccttctgccccagatgccctcatctacccctgctctttgcctggctccttctcagtcttcagagccccacttggaggccacctgctccaggaagccttccctgtccctgcctggcaatgcccctgacttggttagatgccccacaggaccacactgctccctgacatcacatctttcacagagggtggggactgcccgtcctcttatctgtctccccagcgatgagccctggagtgagcagctgtatctctggcacctggcacagggcatggcatgaagtgaaagattcccgaatttctgtcgaatgactggatggcaggctgctgaactgtcatgacctctacggaaactgatctcaccaaacttctttggacagacgcggagtcatctctgaagaccccaggtgtgccactaaatgggggaaagttaggcaggtccggtgggaaggggagaccccaggagaacagcggcttcctcagaggattcacaaacacaccaaagtcagacttttggcttgtttgaaaccagtaactggaagaagacactgccggacctgaggattgcacaactccgggaaagtcacctcattccactgataacagaaccaagcgtcagcaggctttcaacagcccggaactcagctaaaatctgcagacctcagaaccgccagcagcacgaggacagagtcggggaggtgtagctggacaacagctcatgaggcagaagagctgtgtcacaggtgtcagctgagcacaagccctgtctgaggccgtggtgactggcgacagccgggcagtggagggccttggaagctgaagggtggtcttggcatggactctggtccttggggtgcaggctcttgggtcccagttctgctcggggtggtcctgtgaagcactagactcctagcgggtcatctgggaggttctagcagagctgaacagcccaagggtcatcagggctcagagagtctaaggttatgtcaacctggcctgcccagaactgcatcgggcaggggcactgctctcagccctagcaacacacactgacacttcgctgccaacactgacactttgctgccaaaagcctttaatatgccctggtcccaggctgtgttcatgaaagcggacacagcagtgcttccagcttcatggttcccaggttcaggttcctcccagcggaggtgggagggcagccctcacacctggcacccctgagtgccatactcctggaggaagtcrttgagctgggcacaggctgcccgctggcgggtgctccggcacaggcgttcagagggcatctcctcgatccagctattcgagtccagcaggtactgggggctgcagggggcaaaggggcagtcagcagggctcgggaggatggcaggtggaaacggagagcacaggcatctggcttctgaggggcaaggcctaggtggcraggcatggggaggacaagagactgaggggaccagatgactcactgtccctcgaggtcataggtggccccatcyagacccatgatcaaatattctttcccaggttccaagcgaaggcggcaggaggctcgaaccaggaagttgcgcatctgattagcagcggccttgacatccttggctgcggggatgaygtgcgcaaaagtggtcagaggggaagagaaggtgcagggtgagcccaggctggggactctgtgtagatcctctcattccaccttcgccacccccatggagaggtgccactgcctccctatttatggccaagcccaaggcttctgacagcccaaggggattttcacacttccagatggtcaggtcctcggccacacctcagcctccctgtctccccccagccctgcccgcctctccggtttgcttcatactgaagtgcaggacttgggtgatcttggtctcaaagaggcggaaagcagctctgctgtcttctcggagaaccttaacctggaagcctaagagggggtgagragaagggggaaaggtgagttactttgaggctgagagggtaggaagttggtgtcagagcaaacaggctgcgtgcatgacctgtaagaggagcaggctacacccagagagaccaaaacrgccggtccccgagggagggtcaggccagggcctcggtgggaagactgaccgtactccacacgggggtagtagcaggcaaacttcatcctgtagccatcctcgtcctgcagaccccgctccagggcgcgacgctggcgagggcacttccctgaagttggggaacccatcagacagtgtggggggggccccggccatcccgcctccactgccccgccccaggccctcagtctcaccctcagcacactggcagacttcagcagaacacaaggtggccaagagtctgctcttacttggtgccccgtaaaacacagaacatctgcgctctggagaacagagaggagttagggcacaggcccctccattctgcctcctcagtcccagggagccccagggctctctgccccctcactaccccggtgtccattgtcccataggagggcacctatgccaaagttctcctgaatttcagggtgtcctgcagtgctcaccggggttgtagtagtcgtacagggttgcgctggccggctgcaccagccccaccggcacttcctgcacagcctcaaagcccacgcactcccgggaggtggrgacctggccaagcgtggggaggagagatgagggacccactccctgggccctgcagccccctgtactgggtttccttggcctgtttttgtttgcttcctattggccttctctccagtgtccttcacattctgttaccttcctactcagagaactctcaaagctgctccgcaaggtctctggtgacttcacttcccagagggtgaccttgccccagtcttcactgctccaggccctcagcagagtcttgcatcatggacgtgttctctgtgaaactgtccctaagctaagggttagcttctggaccacccttggttctgacctggtcatttcttacgttccctccttcggaacttccttcctcagagctcccctgtgggggtctcaaccactccctggcttccaccaaaccaatccaggctgatgattcccaaactgaacttgcagctccatccttgcattaggattgtggcaggacctgtaagttctccaaggcactctgcctgcccccaaacccactcgccctcctcgcggcctcatctttgtcatggatacnactgggtcctcctttatttgccacaacctaactgcaggttctgtcatcctgcctgaccccccgactcaggtcccaggcctgacccctcctcgtgcccacgcgggcccagtccacacggtgccgtgccagtgtccctcctgagctaggctgctgcaccgtcagctccctatccgggaatcttgttggctctgtgttttctattgtgttcaacccagatgtgtcagccaggcttccccagctgatgggggctggcccctctgcacacactgggtaggggtctccctgacctacaaacagctggctaatgacagccaccacacctttctcacattttctcccagaggttacagtaaatgttccaaaactttttttgaaggccgggcatggtggctctggcctgtaaatccggtactttgaaaggcctaggccagaggatcgcttgaggccgggagttcaagaccagcctgggcaacagagcgagaccctgtctttactaaataaataaataaaaatgttttgagagccgtaagagggttgataactattttagccaaataaggtcgtgaaaagacaaatacaactatcatctatggccaccatcactttgtaaaggaaaatacgctttaatattaaaaaaaagataggaagttcaacaaaaaaacaaaggcagcccctcaagctgaataaaaccagcattaggaaagactccctctcaaaccctgagggtccctgctgactggcatcggtccctgccgcctgcaggtctgccccttactctgctgtgtctcacgggctcacattcttgtccttctctctgatgacatcacaagttctcaagagcaccagccgctgacacagctgtctcctgagaaacctcctaacgcatactcagtaaacccggtgccatcgagtcccttcctgcctcatctctccccactcaccgagtcaaaatacagcaggacgtggggcccctcggtctcaaagtgactcacgtaacggtcagagagggaggtcagctgtggaaaaggggagttggtcacaggccctgcacatgacagggctcagtacctgggacagagggggttgccctgggtggctgaccacaccttctccaggtcagcacgcagggcgtggaatccactcaggagggtgacgtccgcgatggccatgccagacagccccaccttgccgttccgcctgtggaracgtgtgagctgtcgtccaggttctgcctgcgcgggctccagaagcccagccccagcctgggtcctgccctccctcccctggcccagggcagctcccggcgcccaccagatgcacacggtgtagtgcaccctggactcctgctcctccaccaccttgggcgcctccctcctgcggcggttcctccgaccctcaaacagctgcaggggtgtcacgggctgcagaggggcatctgggtcatccttggctggaagctcrtcgtactcatagtcctcatagtcctcgtttgsttccactgcacagggaagcattgtgaggagggctgggatggccacccggctccctgcgccagcccctgcctggccccaaggcctcccaacccccacactcactcgtgtactcgacgtggcctttgactgtcacttctatctgtaggtcctggcaggtcgtgttcttcatgtccaggacattgtaggtacgaaggacctggctcagcaaggggcagggagaggacgtgggacatgtgaggccacagacctctctggtgccatacctaagggcatctccctgggctacgggatttgaggccttcagccccttttcctccccgtcactgcacagtccacacacacgagtggcaccacattcgccacaggcgtcaggcgagacagagaggtaaagaagcaggggcctgcccccagaggccaacactccagactgtgctgggaagaggctggactgaaaagctcaggaaaggcttctggccaaggcttgaaggagaagaaagagcttgtcctgtgggccaagaagcagggaaggacaggaaaggcaaggggatctgtgtagacaaggagagctgtctggccggaggggtgggcagaggcccagccatctgagccgtgggcagcggggagtgacttttccccaaggctgatctggctggggcttttggaaggtcagtgtcactgccgtgtggacagtggatcagacaggggagacaggaggtagagagaagttccaggtagggagaaggccgtctcagcacagaatctaggatgcagcaccaagggccacaggcagcaggggagcagaggaggagtcactagggacataaggacaggcttgggagaggggccactaacacggcctctagagtagtggctgggctcctggctgggaggggctcccaccagccagacaagagacacagaatgaagaagggctttgggacatgcctcgtctgaggtgctgtgggagtgggacgagtggggcccatggttcagggaagaggcctgggctgaggagtgggattcggagccaccagcactgaggcgggtaaaggaaacaacaggtacccagagatggggagagcaagcgaaagcaagcagggggaaaaacacccaggacggaagcacgggacaccaaccctgaggtgtctgcctccttccccggaccatgtgcctctgcccacaggcctctcactccacaccctctcctccaccagtgcctggccccaccccttccctggccctcaccttcagggttcctttgctgtttcctcccaccttcacattgatcttgctgcccaaggaaaacttcagcaacagaaaagggaaggcgatgttagaagggcacaagcaaacctgtttttgcggctccaataacttatctccttcctcaaaacagccccacctcctctccccacctcacatttccacaaagtttataccagcacatgaattatctcacttcagccttctaacgaccctgtagggtgaactctgtgtatgttactctacaagtgagaaaactgaagctcagagctccaggtcacgcagccaggaagtcagtcttcccccgaagaccccaggaagaagtgctgcggggattccacgggtgggagggtggggacggcttctggcctggccacgaggcccaggtgtcctggctacccaggcgagggagtggttcaccagggagtggttcacctgcagctcctcctccaggccgcgaatctggcggttgttcagctgcagcgcgtgggacttgaacccattccggcctgtggagctgagagtcacattgagacccctctcctcagtggtgtgggaggcaatccagtaggcagacagggcatccagggcaatcaccgtgtcctagggaggttgagccaggactcaagcaagcccttggtctgaggactacccacccccgccagagcccggggacggcccctacttgggtactgcggaatcccccttggaagctgccctgacgggtgagccaggccgcagcctggtctgccatctctgctttgccctcgtgaagcaggaggtgcagcagggcgtaggctgtggtttcaatccacagggctggggcctggggcatggggtcggatgggttgcgaggagccggggtgggcgacacggcattgctctgagaaccagtgactgagccccagtacaggttatctgaaagtgaagggagaccacgagtaaacaggaaggcagggagaagagcctggtcccctggcccttagccaccccctgctgggctctcctgagtctcccccaacccacccctgcttataacttcattcctcctctgagtcttcatccagcctctccctctgggcacactcagggatcctaaggtcccctgggcctcaggctcactgccagagcgcctcacccctcacctccagtctcctgggccattgccatgaggttgttgtgggcaacaccccgcaggtccgcaggggccttggtcagtgtcagggcataggccgtgatggcagctgcgtgggcacccaggagcccagcacttgctttctcccccaaaaatgagcttgcctttgagatggaggcttcctggaagaaaacgggaggagggtcttgggcctggacccctgggttcctgaggaaaaagggagagagctgggggccagcagagggcagaaacgccactgaacttaccactctctgcttcaatggctctgcaccctcatcctggaagacggccagcccatgatgaagggcgatggtcacaaaggctgtgagtgccacagtctcatcattgcccaccaaacccccctagtaaggggagaaaagatgtcaaacaggagggggaaggggcaaagagagtcctccgacaggcgcttctcgggccagccccagcatgcccgcacctgcatgctcctatgtatcactggagagaggtcctggaacgagccgtcagcctgctgctgggacagaagccagttagatgtctcctgcagtttctcaggcgagcctcctacctgctcctgggccaaactcaggaccttcaacacaaaggctgtgagcctggagggcaggaaaggagggttggggataaggacttgcttctcattatgcccacgcccccaggtgcctggttatccaccctcccatcataccagctctgtcccacccctgccccagccctgaccccctcagaaccctggaaccactctcccaagctcaccaggtgctgctgccccgtgacaaccaagccgcataggaaccatccgccttccgaaactgctggatccgcatgtagccttggagaggagaggtggccgctcaggtgacactcacccttctgctgtttgagcccaaggccatgctccccatcctcatcaggggccccctttctttccctctgtagcctcctgggctgtccatcttccagtaactgtcctttcctggcccccctcctgcttgcccttgcacccagaacctttctggatcagatccacggcgtggtccttggtctcgggaggcagtgtgctccactgctctgtcttgtccaggtagcgggaagcagccagtgtcggagccaagtagatcatggtttgctccccacagcctcgaggaagcctcaagagggaggccacgcctcctggtgacaaggccccctcagagcctaaagtgtccaatggatctgaggctacatgggagggagagggtggaggtctgaggactctgtgtcagaggctcacggggagtgggaccaagcagggatccacaggtcccacatgaatccgaaggtggccactgggaagggactaaagggcactcccacctgtaaccctgacgtagctgttaaagtccccatcagggatcatattgggatcagagttgccaggtatttccaaggtccggcctcggtggtctggggaaatgggggaagttggcagcctgtcctgctgtccacatcccccaccacctgtacccacttaggaaaccaatggctggaggtagagggtcactcacccaaggggttgagttcatagaccagctcctctctatggatggccccttccttctgtctcagggaaaacatggttgtgaggtcacacaggactacagcctgccctgctagcacagactcccccagaactttgagtttcaactccagggacagagttggatcagaattgtagaagatgggaacagaccaaggcattggttcgggtgttgggcccctggcctggccagcagagagagtgctgagggtggaggacaaagctgggggcccggggacttatattcaggggtgctccattcacctcaatctgcagaaccttggacaccgcatctcccacagggaattcgaaggaccctcgagccaccaccttcagagacacagcggcggctgccgtgggcaccacagagaaggcaacaggccgggcagagcccgcaggcaccagcacctgctgggccagccctccgcccccagccaggcacagcccctccactggggacacgtggacgctcacctgagggcaggaaaacgaggatggccagagtcctggcccggttagcctccccacccctcactgggccctggctcccccaactcctgtatgctcaggctcccatggggcctcacagtcaggtttttatccaggtagttatagaggacaggccgcagctccagctgctcaaagcggcggacagacatgggcaggcggaggtgcaggtggaactcgcggaacacccggagctggactggggtggccacacataggcctgagggaaaggaagcgtgggcacaggggcagagatcagaggggccatcaaagcttcagggccacaggagggaggggtgggggtgacccagctctgtctcagtccgcctctgccctctggcccacgccagctgcacgctggcacagacctccccagatcactggaccctcttcctacactaagagcaaagggaacagggagctggggtacagggaaatggaagcagggtcacctgaggcccagacagggtgacatcacctttggttttggacaggctcaggccatggatctcccacgtggtcagagagtcggggagccacagtgtcaatctgtgtagggaaaggcagagaaggcccgtctaccccggctggccccgagacacagcacagagaaaaggccgggccggcacacactctcacatttgaaagcggtccactgtttccactctccagagccagttctctgggaagaagctgcgcacgggaatgtcatcctcatcaatcaggtcctcctcctgcaggatctccagggctgggggaccacggtggacgggagtgaggaggggaccgttctgcctttccaagcgccgccacctgtgccctagccccacccagcccctcacctcgttggaggcccgcctggcccttgtccctgctcttcttgcgcagactctcagcaaattggcagcaggacaggaagggctcccggcagtccggctgctgcacgcgggctgcccgctgctcgcaggaacgcatcatgggcagacgtgtcaccccatcctggcagcagcgcttggctgtcggggaagcatactgacccactgcagggccaggtgggggtgagcatgagaggacaaaaaggacatacacctcagcccccgccccgaccccttgagaccagcaacataagagaggctgctggagagagctgcccaccttccactcgtaatcccggaattcggatctctggccccaaataccacacgtgggttcagcaaggagccgaggggcagagaggcagacccccaacccggatcccaggtggagagcccaagctactgcctaggcacccgcaactcacatttctcattaatcgccttttggaagttcacgtttctctttttccgggttgtcttctccttgggacagcttagtcctggtagagagaaaggctgcagtccagccgtcaggcactcggcctcctcccctcctccccttcccctgcccagcccttcctgcccg

SEQ ID NO: 10839 - DNA, 34263 bp, Homo sapiens
tggtggcaggcacttgtaatcccagctacttgggaggctggagcaggagaatcgcttgaacctgggaggcagaggtggcagtaagccgagatcgcaccactaccctccagcctcggtgacagagtgagacccagtctcaaaaaaaagaaaaagacacaaattgactagcccaacgttatattgctggacggtggcagactcaggacttgggccccagttttgccactttagcacaggttcgtcggggtttataggggggactctttgctgataggaagttttcaaatagcatgtaagagaacagtgtagaagtggaatatgtgaaggaacgtctggtgggaagatatgtgaagctggcaagtagggaggttgaagagaactcacttcacagaagaattcattgccacggagcccacagaaccaggaaatccaggacacctcctctgagctgctcatcttcacgtcagctagaaaaagaacagtgtcagtaaagctcaagttctccttccctgcctctggtatcctccctcctcccacattcggccctccaaccacgggagaattcggaaccaccctttcttaaagcaacccaaactctgaagcactcctctccagctcctctaatttacatctcagccccttttctttgaagttaaacattctttggggtcccaccacttgaaagaagccaacagatactttgacccaccagcccgacccacatccctggagctcccgaaggccagggccctctctcctctgtgtcaactccggcagggacctcgactcaggctccctaccaatacaagtctctgcatgacccccacgcctttcccaagggtttccaagtttatcattctcaagcaagaaccgggctcctccttttctcacgggttgggggcgattgtcaggtccctttcaccggaatccacacatcccccctccgctcctcaggccacctctccctccttcgtgccggacctggtcgcttcctcccccgcccccacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccaggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggtgcggcttggctccgtgcgtagggacttgggtggggtggggtgggcggtgtgagaactggaacgtcccagtgcgctaacctgaggtggtgccagccattctgctcgtccctttgcacttctccatttccccttaggctctaagtgtgaccttcgaaccctggtcagagtaatggtgaggggcaggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtatgtcttacggggtgggaaagtggtttcagaaagaggctggtgtttattgttggtgaggatgggggtgggggccggacgcaggacctctggacaacagtctcatggagttttattaatctttactaaggagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccagcacagtgctgaagagttctttccttatcctcatgtgtaggttgacagggtagtatagtcaagtggttataaacatgagctccctggatttaaagcctgattccacttacttgggcaaacaacctaatgtctacatgttccagttttctcatcttagaaatgggggtagtaagaattgttgttaggattcaatgggttaatatatgtaaaatgctagaatagtgcatgccgcatagtatgcaatacatgaatgttagctatagtcattatgactaatgtccctccccttgcccaagagtttgctaggtctggttaccatttttttctttcaactattctgctctggatcccacaatggtttaaagaaatttgtttttaagacaagtcaagtgcagtagtgagaaggaggggaaaagtggagtaaggagtttgatctgtaactgagtgaacaattaattcagataactcaccaccacctttggaccagcctggatccctcactgttaagtaggaaggaaggcaatttgtcccttttttttttttttttttttttgagacaaagtctcactcatctcactctgtcgcccaggctggtgtgcaatggtgtgatttcagctcactgcaacctccgcttcctgggctcaagcatattttttgtagaaagcaggctttgccgggacatggtggcatgtgcctgtaatcccggctacttgggaggctgaggcaggagaatcgctaaggtggaagttgcagtgagccaggatcatggcactgcactccaacctgggcagcagagcaagactccatctcaaaaaaaaaaaaaaaaaaagcaggcgttgccattttgcccaggctggtctcaaactcctgagctcaaagccatctgcccgcctctgcctcccaaagtgttgggattacaggcgtgagccactatgcctagctggcaatttgttccttagcagaaaagctgaaaagatcctattctaccctgccagccccctctgaggcctcaactcttccccttttccttcccctgcccttaatgctttttcttctttctctgcaggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccacccatttgtctacacttttctttcccacacttccccactctcccaccacccacccccttgtcttgctcatgccgggtggtaggcacaagaagagctcactgttgtgaaatccaggaattcaaatttgcagacgggcaggggagggctgttcaagtcgcaagactcctcattttttcttttctgggaaagcctttcatgaagtcttggatgcgaaatggaggagtggtgggggatgtggaaaagaacccaggggcagggggctgtagggggcgaccgagtttagggaagcatgagaaacccgggaaaatggggagctgggtttatattaaggtcctggtccttgctaatctcggtttggcggtccggcgcgcacagacagcgcggggtatacgggggcggtctattcgcagggtccgccccatgagctgcggcaccgcccccgcgggtccttccagtcctggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagatgaggattgaaaaattatctttattatcttgagtgggagctggagctggaagtctccagcttctccctccaacaactcagctcccattgtacccatctggggacttagatgaagttacaggtcagttattggacagctcacaggcctctgtgatggggggagggaaaaagaaggacagaagggaagtccagggagaaaagcaaagttgatagtaatggggtgggggagaacgtgttctttcattccctgtgtcaaaggggagtctctaaggctcttttccctccacgtatgaccctctgccccctttatccagtgcaaactcagaaacctctcttttgagtagcccagaacccatcctgcctccctcaggtgacatcacagctcttagccacatccctctggtgacatcacacgagcctctttcaccctgtaacaccagaagacttggtgagtcctaatcctgttttatgagattttaaccccttaccttgattcctaggagtcaataagaaggctttggagtccaggcaggaagtcagggacttgaattcctccacacacttttcgggaggatgtggtgagcgatctggaagggcaaggtggggtcaggccagtcaaaacccctggaagcacctagctcttcctgggagggtgtcataggacccagagtgaggagttctcctgccctcccttgtttccctccaacccttcctgccttgtatccctactcactgtagaggagaaagcgctggtaaccctggcctgtctcattcagcatgattccacctgggcatgagctggaaaagagctcagtcttcatgtcagggcggcctgtcaaggcaggtgggagaagtatgagaacagagatgcagaaccaaactcaagggagggtgagggctgggaagaaccaaccttcagttctgagatctgtgctcccttcagtcaggtggtagatccatttccggggcacacagagcccatctttcctgcagaggtggtggtggcaaggaggaaagaatgagcatcaccccaaccatagtgtcccagcttcttttttttttttttgagacagagtctcactctgttgcccaggctggagtgcagtggcgccatctcggctcactgcaagctctgcctcccgggttcacgccattctcctgcctcaacctcgtgagtagctgggactacaggtgcccaccaccatgcccagctagttttttatatttttagtagagacggggtttcactgtgttagccaggatggtctcgatctcctgacctcgtgatctgtccgcctcagcctcccaaagtgctgggattacaggcgtgagccaccacgtctggcctgtcccggcttctatttactccattgtatttgttattgaagcccagctctccttgggtttcaagctaccaagcattggttaggcacatctttctccagagggcaattaatacagccactgaattccgtgggccaagcatagtagatataccagctaagaggccagctcttggtgggtggattctcacactttgggcagagactgaacccagtgatgcttctgcctccttaccactcacatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactggagagacaatgaagggagcaaaagagggtgggttccagcacaggatgggttcaacctcttcatcagtcaaaacagcaagatttaggggtagaggtgttggctgccttcctctttccaactggggattggatccatgacaaagagtcattaaatgacttttcctctttgcccctccccagtcaacctgggtaaccaccccaccccccaattctgccatgcctctgcattgatggccacagtactgatatttttcttcttgctttcattatcacaacactcacacccccttcctctcttcctttcccaagatggtctccagtcatcctaggccatccacccaagtccctcagagcctccaccataggcttcccccaatctcagtccatacctccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggctgctcagtccactctgctttcagctcccttgcgttcgacccttgaccctttcacctgctaatgagtaacttcaaccttgttttccaacccaaacctggattacttagtgtttgggacttcctccccctcttccggatgcaaccactccatagtacaccctggcatgtccagggtttctcaggagttatgaggagagctgagctgtccagggagaagcctgtggtctttgaacctgtatctgagctggttatttgttgcactgtgcagcactgaagggaagtagcttgactgggcctctcattcattcacttagcaaactgttttgaatcccaagtcccagttgtttcccaagaactagctaatccccggggacataaaaaaacgaataagacatagcccctgatcttgaagaagtcgttagagggaaaactagctgtgtagacaaaccattgcaatacaacttggtaaatgctttagaacaggtatgatgcaggtgctggggcacggtggattgctctctttagtttacaattagaaaaatatgtataccctggcagtgttcactgacacattcactcaacatttattactacaaagaggctatgtaatctggctgttagagaggatagatgttggtgtcaggcagaatgtgtccaaaccctaactacaggcagggcaggtagctcatgcctgtaatctcagcactttgagaggccaaggtgggcggatggcttgagcccaggagttcaaaaccagcctgggctacatggcaaaactctgtctctacaaaaaatacaaaaattagccgatgtggtggcacacgcctgtagtcccagctactagggaggctgaggagggaggattgcttgagcctgggatgtcgaggctgcaatgagccctgattgtgccactgcactccagcttgggcgacagagactctgtctccaaacaaacaaaacaccaccaacccctaactgctatgtctgttttttcatctgtaaaattggcaaatcatcaatcttataggattaaatgaaataatgcacataaagcccttagcaaagacttgcacatggtaagtccaaagtatatatttgctataattaatagtaatgtttgcaaagcacttagtttctggtgggtaataagttctcaaataataggcagtaagaattgccaaataggttgtccttggatagcaccaagtgactggagcagttaatgctgtgagagatggatcttcctcgatagattatttatttacttatttatttttaagacagggtctcactctgtcgcccaggcatgactttgacttccccggctcagatgattcccgagtaggaggtataggtgcacgccatcacgcctagctaattttttgtagacacggagtttcaccatgttgccccaggctggtattaaactcctgagctcaagcagtcggcccaccttagcctcctaaagtgttgggattacaggcatgagccaccacacctagcttgataaatttatatcccatggactgccacaaaaaatttgccgagggctgaggcttgcgatttagttaaaaaacaaacaaaatttgggtgaccagtatattagagtttattaatactgttctattttggtgtaatgtttgaatttttttttttttttttttgagatgggagtctcgttctgttgcccaagctggagtgcagtggcgcgatcttggctcactgcaatctccacctcccgggttcaaagcaattctctgcctcagcctcccaagtagctgggattacaggcgcccgccaccacgccaggctaatttttgtatttttagtagagatggggtttcaccattttggccaggctggtcttgaactcctgacctcgtgatccacccgcctcatcctcccaagtgtgagtcactgcgcccggccgaaaatttttgtaataaaaagctaaaatgtggttaggcacagtagctcacacctataatcccagcactttgggaggccaagtctgcaagaccaggctgggcaacatagcaagaccccatctctataaaaataaaattagccaggtgtggtggtgtgcatctgtggtccctactagggaggctgaggtgggaagatcggttgggctcgggaggcagaggctacagtgagttgtgattgcgccactgcactccagcctgggcgacaaagcgagaccctctctcaaaaaaataagctaaaatgttaacagctttttattggggcagtaaagtacaagtgctcgatctggagtcctgtaggcctggatttgtcaattctgacacttatgttcgtctaagtgtactcacttaaaaaatgttaaaagctcgttaaaaggctttttaaaataatacacaaaacccgtagtatatgggctggcacaagtgctcattaaacagctgcttattagaactcttaactaaaatataaccaggacctgggtataaactacgaatcccagaaaggttggacaccccaacagcgatgtgtctttctggaggactcgcagtttcgcggggccgaggcccttggcccagggcaggttaagagaagagggcacggagaggcggtaatgcctccacccccggccttcggaagcacgctggccggcctttaaattccccacggtcagggtcttgtctttctgtccactcggactccatttgctcccaattctcaaactcggaagcgcctcttttcttgacaagtcgtgcaacttagtagcacgtttacttttcctaaaacgtgtcatgtccccttggccacacaccgacgaatgtgacgcccacagcccttaaaacgcccacccggcagaaccgaaatctagcccaaccaagcaaccgagaacaaaattgaccagtgccgcccccaaacgcctactgaaagagtaacttccggaggcacagaagaaagggcgcagcgagggcaatagggtggagaagagttttagctggctaggacagtgccgcctgaaattatcagcctgccaagatttaaacatagatgaatgtggcataatcccccatctccaaagtccaaggtccatacgaccgtccatagcccctctcgaggcagtggtagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaagaccttggactctcaaactcgtacctttattgtgggggcccaggtgagacacctcactagttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctcagcctcctgagtagctgggattataggcgtgtgccactatacccagctgatttttgtatttttagtagagacggggtttcaccatgttggtcaggctggtctcgaactccttacctcaggtgatgtgccctcctcggcctcccaaagtgctggtattacaggcatgagccaccgcacctggcctcagattttctttttattgatccctttgttygtattccagtagaacgttttctgatgttttgtgagtgaggctgattttgttctgtcctccacatggatagaacttaatgcagagggaaatacagaggaaggaagaatctgtgtgtcatcatcatgggtggaccccaacccaaagggacaggcatggctctggcctttgggaagggaaacagcacaggaaccctaagcaagtgtgtcttactgatagacattggtcaggtctatgctgtgtttttaaagggtagaaatcagaacccataatggagataggtccttgatagactgttgagtgaaattactaatttttatggcatagcttgagtctcttgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttctctttttgcttttttttttttttttgagatggagttttgctcttgttgcccaggatggagggctggggcgcaatctcagctcactgcaacctctgcctcctgggttcaagcaattttcctgcctcagcctcctgagtatctgggattacagacgacgcctactaccacgcccggctaatttttgtatttttagtagagacagggttttaccgtgttggccaggctggtcttgaactcctgacctcaggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtcacccaggctagagtgtagtgatgcgatctcggctcactgcaacctccgcctcccgaattcaagtgattctcttgcttcagcctccctagtagctgggattacaggcgaccaccatgcctggcttatttttttgtatttttggtaaaaaaggggttttaccatgttggccaggctggtctcgaactcctgacctaatgtgatctgcctgccttggcctcccaaagtgctgggattacaggtgtgagccaccgcgccaagccaaatttattgtctgtattttgacagctgttactttagtttaagggtttgcacagtaatgatctcacggtcaagacaaacgggtagtgattctgtggtggtttttacccctcacctccacaactcggttgtctgtctttgttcttcctctttcctccattctttccattcctgtgcatgcctcttcttttcagatgaatgtaaaagagtttaaggagcacattgctgcctctgtcagcatcccatctgaaaaacaacggctcatttaccagggacgagttctgcaagatgataagaagcttcaggaatacagtaagggggctggggaggcagttcagaggttggggctactgtctggagggatgaactgaggccatgggtttacctgttcatactatgttttggtgtgtgtctatttttctgcagatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctgtaagcttatgttccacaggggagggcttttgtgggtagctttggttgtggtagcaccagggaattaataagatagatgcttccatctttagattgggttcagggggccctgtggtgtgctattggtctcagtctttaaggagaaaaggaggtagggctccagggaatgaattggaggtgtggaggccttagtgttggcttctcccagaacaacttcccttaccctttccccagagtgacggctctgctgtggatgttcacatcaacatggaacaggccccgattcaggtattgaggggcctccgagggtcagggaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccggatggaggtaagtgggcaaggctggctagggtctctctccaccctccctctcccttttctctcagcctgggagttagggcttcactggccacatccacagggtttggccttcataatctagtcttctctgcagtattcattcttttgggcagaaaaagtatctttgtgaggctctctcatttctgccaatcctcttggtgcctggtatctggggagtttgtttcagacttagtctcatggcatctcttttcaattaaaggattctactctcttaacttgtggaggctgggaaaccaacttgtggaggaaaggaaaccacaatctctactctttgttagaaatttatttacaaatattacagatgctgtggccgggtgtggtggctcctgcctgtaatcccagcactttgggtcgccatggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgggagtaaagaatagaagctttggctgggtgcagtggctcatgcctgtaatctcagcactttgggaggcagaggcgggcagatcacctgaggtcaggagttcgagaccagcctggccaacatggtgaaaccctgtctctactaaaaaatacaggccgggcacagtggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcaggagaatggtgtgaacccaggagacggagcttgcagtgagctgaggtcgcaccactgcactccagcctgggtgatagagcgagactctgtctcaaaaaaaaaaaaaaaaaaaaaaaacaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggatcatctgagatcgggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctgaatgaatttagaaaatgtaaagtacaggagatcagtatatgatgacttactgattcatagtagtgttttaataggatgttccttatgtgaataagatataatttatttgcaaagatttggtctacatgtaaacttccaaggatataactgaaagttttggaggacatggtattctcagtaggcattattgcttttattagtgagatggactccagcttgatattttctgcctttttgtgtttggctggttgtgcgcagcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacaggtgggttagggggagtctggcctgagggagagtgaggggtgttgatagagtgacccagggtagctactgggcctgaaggaggttaggaaaggaggagactggaaacatggtgatgaaggctggagatactttagaggtttatcatgaggttttcttggttaggctcttgtatttttctcacatctgcctgtccatctgtctttttcagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagcatgatgagggaggttcatgctgaggtgtgagggaacagggtggggaagggagaggcacatgctggtggtggtagcctggggaccagagcagaagcttaagtagacagatgtggggggtgtgggggttggtttgtctttggaggtgtgtttgtgtggtgaagggagtacctctccctgtttagatggagggaaaggcaggctttctgattgggggattatgggcctgaagtatgcctgatctcagaaggatatagttaggccttggccctacctacctcagggccactgtctctgtctccctgcccagattctggcacacagcctggtggtgttccgagtgctcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaarttctcccttgctctctatccagcagggcgcyggtctgggtaccaatgcctcgttggcccagatggtgagcggccttgtggggcagcttcttatgcagccagtccttgtgggtgagttttcattcttccccactcagagtttaaactcctttcctagtctgctcactggcactttccagttctttccatattttcttggttcctgctttcctggaatggggctgctgtagtgtcttgtgtcttcaggtttcagcttttttttttttttttttttttttttttgagatggagtctcactctgttgctaggctggagtgcagtgtacaatcttggctcactgcaacctctgcctcccgggttcaagtgattctcctgcctcagcctcctgagtagctgggactacaggtgcacgccaccacgcccagctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactagctcctggctagtaattgtctttttttttttctggtagagatggggtcttgctatgtggcctagactcctgggctcaagcagttctcatgccttggcctcccaaagttgctaggattacagccaagagccaccatgctcagcccagctttctttttttggtttcttacagctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctgggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactccccatcttcccagacccgttggtttgtgccctcttgatgccgtattatttccgtgtgtcttcattctcacctcactttctgttctttgttctttatttgccaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccgggtaaatgaaggccaggggccccagaactctcctcttttgcacattttattccttatttctgactgcttctctgccaggtaaagctccaattgcccccacacaagccctggacttgttggggtcgaggtggaagtcttgggaggactgaggctttgaactaaacctgttctgtttcctccacagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagtggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgagggttttgtgttctaaatctgctttctgtccctcagcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggagtggagggctgggggagaaaggtttggaggctaaaaattctgaagcctggctcttcccgccatctgacacccagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttctgggattcagacttgctcttggttgttgcataaccatacaggacttgaccttagtctgtttgctagcagtcctgtattagttgctcagctgcctaatccccatgtgcttagatcccattttcctttaaggtgggtttcctcttgtggattacctagctctgaatcccggatggcttgaccccttctgcctttcgttttgaagagcacgttcaagcacattcactttagttttggctagtgccaaagagaattaggaaggcatttctgctgtaaaaaccacatcctggactcttaatttcccctctctccactagcatggagactcagtggagtggttgactcatggaaagggtgagccggatggtggcactggatctgacgttgatcctcttttccctcccaaccccctgtcccccagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcaggtgccaccttgaagcagaatagggatggtctagtgggaggggttgggctagggtccctcttccctggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatrgggacttggccagcstttctccaacctgcttrctttttctctttagctccggtctgatatacaaaaacgactrcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctctacattgtctccattaggtagtgtgtcccttaatcttgtgtgaacttttttaaattaatacttccttggaacactgttgtgttctactcagcacgctaaattgtacaagccagttttgatgtttgtttttttttttttttgagacagagtattgctgtctcccaggctggagtgcagtggcccgatctcgagctcggctcactacaacctccacctcccgggttcaagtgattctcactcatgcctcagcctcctgagtagctgggactacaggcgtccgccaccacgcccggctaatttttgtatttttagtagagacagggtttcaccatattggccaggctggtctcgaactcctgaccttgtgatccacccgccttggcctcccaaagtgctggaattacaggcgtgggccaccgcgcccagcctgatgtttgtattttttgtgcgaaagcactttatatataaataaaaaacctgtattttgagttgggagcatattccaggtgcacactagcatagagctctcaaattacccatcaaaaaaagtttctgagcagctgcagacctaagtatagtctttagcataactagcatgcagcgttaccatgtgaaatcccacttagtttgacaatgctggaattggtctatccaattcaaagagccccttaagtgtgctccaacattgaggccttaacagagatttccccttagttcatcataaagaactgaagtcccatggctgcaaattctttgctagtccctttgagatgcagttgaagtcccttctaaacccccccatcccctaccttggctagtttagtgctctatcaactaagcatggcataagcttagaaaattccagctagacctcttggaacatgagctcacggacatttaacaggcctgctggagagtccatgtgaagacactggttgataacccagtaatgttacagatgtcccaccaaggccctagatatgcaaaggaagccatattgggaccagcccaggtgtcagctgcagactgataaccagttgacctcgctcactggcacaaaaaagcagatttatccagctgagctcagcccaaattccagactcacaaaaatttaaagatccaatacgatggtcatgtttttagtttcaacagctcactggaataagtaatgaatatttccctgactgaaactacagatcactcagcaccatgctttaagacaatgcaaacaactcatcccccaaatcattgtagaagtttttttttttaaatccttttattactcttttttaacaaacagccccagggacaggggaccaggggaagggggaggaggggaagtgaggccccagccccacaacccctccccgcccacccctttcccccttatatatttataatctatatacaagccccgggggtagggggcaagaggaactccctcagcggggtgggggcaacccaggctccttgtcccctcgggacccaggctcctctgcccgtcgggagggcccttctcgaggtggcggccctgtccgctcccaaggcttaggtatccagcgcagggcatctggtggggaggcctaggggacaggcatgtgttaaagagtgagtcacagtgagaggtcagcgatgagacggaaggacaggaaatcaggtggcaactcgaatttagagttggggccacaagggtttctccttcacctgctggtaaaggtcgacgcgctgggtgcggaagactccactgtaggtggaaggcgtggccttgagacgggaattgaggccagagaaggacctaagggaagaagggcgtctaaggcaagcctaggatccagaccctggttccaaagtaaggaagcacttggaaagtccacatccctattccgtttcaccttccagttgggggagtccgtgatgatccaggtcccccaaggttgctgctcagtttttgataatcctggaacggctttagttccactggatgcagctgaggggaaaaaaatcatgagctgcctaccttgaaatacagaatccctactcccaagtcttggcgctccctagcccctcagttcctgtaccttacctctgctcgccccaagctagcggggaagggcctggcaggtgaaggcagcacccgagtagcaggagcaggtgggggccgcacagccaggctggggggctgcagagcagggcccacaggtaacagagaaaggggaggtggggcaggaggtggtgctggcggcagggagccaaagttcaccacaggcagctgtgagtctaccatgggtagaagcatctgtaacaagaaatttgggtgtgcatgttgggggcagggaggaatgtcagaaaaccagggaaaatcaaagccagcaactggacagagaaatcaaatgaaggggaagtgtgaagatacaatatacctgctgggcaggagcccctgaagggagaaagccactttggccaccaggctgcagaggagtagaataaaaatccgaaggggatggcagatcctggcgtacctgtcgggaaacagggagaaatatatcaacccccacaaaatcattctccctaccctatcccccaatatctaatacctgcccccctcttacctgaagcaacgatgtgtcaggcaaaggactggggcagaaagccggagagtagaggaaggaaggtggagggtagagaactcctccagccggcaacttccccagctctgtagcttgcattgtggagaaatccagaaactggcccttgagagctaccccagagagcagtgctgagggaggggctgggccggggggtaggtataggggctgtgatctgaaaataaattgtggggagaaaagctgttaggaagccagagtcctagcaatgccttaagtccactagcttctagtaccctagaactgtgtcttccccttccctctccccgaaacacatctccaagtacttctgtgatccacaggcatcgagtcttacctgtaagggtgcagtgagggtgtcccagggcggaagcctccactgtttggatgtaattgagagtccatggctcccccagagatctgcaggagaggagcacggttgaaacagctttagtatctgtggtcaagaaaaaagatcaccatcccacccatagaagcaaaaagtagggagaaaaatgatgtgacaaagtggtatctcacaactctgcaacgtagaaaggcttgattataaatacataccaggcagaaaaaaattattattcactgaaggggtcatgcaatgggaagcggggcctacctgagaactggaaggcccagcactgccatagaaaacctcaggatacaggcgctggcctgaggagctgggctccgggacacagtgcccagaatccaggttcttggattgtggctcagcagaggcagcagcactgggaagcagctcccagtctcgtgatacaggaatggcctgggaaggagaggcctcgtggagagggatgtctggcatcctggacgccctggtcactcccagcaatcttccccagaaatcttgggcctttccaccaaactcttactcccacttacctcagtgactgatgctgttagctccttctctgctttcaagctgtctcctaccactaggcgtaagtctgagtcctgtgatcacaagaaggcaggagacattgtcccgtgacagacatgtgtcctctatgtcccacctttagtccttcccttctctccacccaactcaggatacccagatccagcccacacagaccttgtcactagtgccaaactggactgggggaccaggtcgatgggatggccgaatggggccaggctctgtgcctcggtctgtacgctgtgatcgttctgtgccaatggggccagggggcagaggctgctcccggggcagctcctggattgggcacacagtaaagtgcattgggggagggaaagggaaatccaaattggaatgcccagaacacacacgcagagagaaaaagcagaaaaaggtagggccaaagtcagattcctggaaacattccccttatccttttttggtcttttacctttctgtccccatcgtggggggcaggtggtggtctcctaggaggttcagagccaggtggaccctcacaaggaacagcattcaggggtgaggagcctccaggcctcttggggggtccctctgctgcccccttgagtcctccatcaggggaacttcgctggctgcagggacctgatgacacctgagaatccccactcaggtccaccccactgtcagactgactcatctgagaggagtggagaaggagctagttaagtcagggtagaaagcaccccaatacctgactgatgcacacatacaaactgcagaaaggggacagccaagtgagagaacagctccagactcaacccagagcaggtggggggtatgaccagtgctcaaaaaagtcccagctcagacacaccctcccaccctcactcacttctgtgccagccacatcctcaaaaggactcaggggctccatccaaggctccatggagctgggccggtaactctttcggctagtggctggagaagggagcaccaaccagaagagaagtgaggagatgacagttcagaagcccctctcattcttaacccttctaccatagtcctttcactcagctttactcaccagtatgtaaacggttccagatgtgaggggtcagggcctctgtgcctgtatctctggactctgcctgagggcctgggccctcaggcttagagcccaagaatccagagctatgaggaggtggcaaagattcctacagatgagaagggccagaagcaaaacatgaattgggtgggaattgggaattataggaagccaggacagagtggggtgacacagggtgtggggacaacaagggagacacatgggagactaatactgagaattctggagtaaaaacacagtgaaagaaacaggaaagaaaacagagaaaacataacccagaagaattttcacgagtaagagtgcagtgaagcacaatctcaaacccatcccttacctcctgtagcagctctggttttctgggaggccgctcccgacgtttagggggaaagggactaaccccggcagagtcccgaggagtcccacccacccctctcaccattggccccggctcctcaaagtgggggtctgggaaagagaaaaagggtcagcatctgcctggctctgccactgaccctaacttttcctctctactccacctcccaattcttctacccttgctccctgcagaaacgcacccagcagcagggcccctaggccaggttctccacccgctccctccagcacttgaccttctctggggatggagatattcccacccataacccctccagcttaccagaactgaggccgctgttgaccctctggggctcgtatcgggttgggggcctaggagaggggccctgaggggcttggggaggcccaggcttgtgccttggatgaccccctggtgcagttacactcccttgacggctactaagctgggccagagcctgttggatgccagcagggttgctgtggataacttggtccaggcggaagacagcagaactgctgggaggtgggggaggcaggggaagccccgggggacgctcctctggaggacgactggagaaaacagagcattagctccagtatccactaaatcgttactttttcccacaagttatgtttcccaacttctgcttacaacctattctcttccctattaaagtccaggtgtttttgagtccttctaagggttcctatgcatacagatgcacagactggaaagcaaagaaccagcaatgaatacataggtgggtgttcttgactctaacaccctaccaaccgctttccagttgccttagccagacatggaaatcctactgacattctagagcccatggcccctcaggccacaatctccactccacccaaacttatctttccctcaggctttttccccctcctccaattttta

SEQ ID NO: 10840 - DNA, 13170 bp, Homo sapiens
accctccaagatcaggaaatgtgtccgtttcttctttgtcagcctcacaaactttttttttaagttcaactatccctgtcattactaactattcccccatgatccctagcctacacttttctgtggatgaaaatgtaatgtattcgagaattttaacaatttcttagttttcccattcacattcactgataatttattttgatcctcataatttattgagcacagcagggaccggggtcctttccccaccttagagagattattttcactgctaaagatcataagcctagtgagagactgggagggagatggacctagctctcctgacacaggtcccaagcccttacctccacggtgtctaccctccctccaggacttcctccgtgtgccagctccagcaaaggatctgattcagctcgcccccaaaaaagacttttaatagttcaataacaataatgaatatgcaaggtttgttctaaggcatttagaaatggtttcagggagtcatgaagccagtcctctcttgggctaggggaggccgagatggtcttgagctccaggggacttgtttcttagtgcccaggcctgggcgcccctcccccaccaagcctcccaggtcttctgtccaaagccctccccctccaccccacctccaaccccgtctgctctaccccatcaactacgttttctccctcagcacttgccttataccccatgcactcacgagcacagaggcgacttccctctctcagactttaggcgccactgcagggtccggaaaagaaagagaaacggcccagcgcggtcgcttacataacccagggcggggctccgctccgcccccgaaagtttttgcgacggagttttccctcttgttgcccaggctgaagtgcaatggcgcgatctcggctcaccgcaacctccgcctccaaggtttaagcgattctcctgcctcagcctcccgactagctgggattacaggcattcaccaccaagcccgtctaattttatatttttagtagagacgggatttccccatgttggtcaggttggtctcgagctcccgacctcaggtgatcgcccgcctcgacctcccaaagtgctgggattacaggcgtgaaccaccgtgcccggccttggccgcatgtgttttgaattttgctgcccggaattcactgcgaggactgggatcacccgtcaccccgccctggtctacggaaaatgaaatgtgtttactgatatagaaacggaataacggcgctgtgggctggggagggccgagctgccttcaggcttctggtctccagctgcagggcactcacacctgcccgttatgaaaatgcagacccgcagggcaggaattccgagtccgggctggagcgcgatctggaatccggctctcttgaaacagcaccgcggaggattcggatccgggtgagtaggaaactgcgcctcagcccctcccacgggccgcccacgtattccaggatccgaaaacgcttcctgctgctccgtcaccccaggaaggcagcgtccgcctctgggcggttctgatggaaaccggctgcgccgcccgcaggaaaacccacaactaaggggccaggaaaaagcctcttagggtcccgccacttcagtgaggatcctaatttacacccttagtttggcctccatgaaagactggagtgaccttcactgaaatgatacaaggggcccagggagctgcggcgctcagaatgcggtgacagcgccgcctcgcgtcccttccctgacctgctcccggcggacgcggagaagtttgttggcctggaggctggaatataccggggatcaaatgcagagaatggagaaaagagggaaggatggggggacgtgttgaagaaatgagggaagagataggaagaaaaggggagagaaaaagtaaaggagagtttttttgttttttgttttttttttttgagacggagtcttgctctgtcgcccaggctggagtgcagtggcgcgatcttggctcactgcaagctccgcctcccgggttcagggcattctgctgcctcagcctctggagtagctgggactacaggctcctgccaccacgcccgactaattttttgtatttttagtagagacggggtttcactgtgttagccaggatggtctcgatctcctgacctcgtgatctgcctgccttggcctctcaaagtgctgggattacaggcgtgagccaccgcacccggccggagagagaaaatttaaaagacgtagtttcattatttcttttatttttgccctttatctagttttacttatgaacatttttaccacaaatttctctctctctaaatctgtaaatatgctgctattattgttatttcagagcctgtgagggtaagttgcagacagcatgaccctctacctccagatgtgtcagggtgtgtctcctgggcacaagaacagggtttttgttttgttttgtttcacataagcaaagtacaagtctcaaagaggataatatttttaaatcatcttattgggacatactttgcatgcaataaactgcatctatttaaaatgttcaacttgttgaattttagctgttgtacacacccacatctccactaccacagtgaagataaagaagattttaatcgtctcccaaagaacagctacacgataaaattctatgttgtcattaaaaagagtaagagcaattttaagtattgctatgaaaagatgtgcccagcatacttttaaccttttttaaaaggttaaggaggctgggcacagtggctcatgcctgtaatcccagaactttgggaggctatggcaggcagataacctgaggtcagaagttcaagatcagcctggccaacatggtgaaaccctgtctctactgaaaatgcaaaaattagccgggcgtggtggtgggtgcctgtagttccagctgtttgggaggctgaggcaggagaatcgcttgaatctgggaggtagaggttagagtgagccgagatcatgccactgcattccagcctgggcgaaaatgccactaatatcacttacataatattaatatatatttgaagtaggggaaaacctggaagattcctcaccaaagttttgacagtgactccagagactgggataactttgtgactttcatttcctcttaaatgttgtgccagggtctgaccggcagacccaggctgcacgatggatgaataatgtactcagacaccgatattcagtgaaagagtgcaccagagggccaggccactcacagaaagggttgtggcagctgcgtgccctgactatctggccctgtgggcctttattcagcacagatttaatgacaaaggctttgagtcaacacacctgtgggtaattaatctggtcgcagtcccccggagagagcagtcctacaaatgatcaaaggtaaacatgctctttagataaactctcttacatgtctttgtacttactcgaagctattaactcaaggtaaggggattaggctgctttcagctataaccctatcctgaggcttttgcaaaactttccaccttccaagaaggtttgtgtctatttcctataactttatctttataattattcccaccacctgaccaatcccctacaatgttggaattttatcttttagtgtaaacttggatttgggtggattgcagtggttcatgactataatcccagctctttgggaatcgaaggcaggaagattgcttaagcccaggagttccaggctgcagtgagctatgattgtgccattgcactccagcctgagtgacaggaggagaccctgtccccaaaacagaaaaataaataaaattttaaaataataaaaattataaacttggatttatgtggaggttaaggaagagaatatttcagtttgaaaatatgaagctaagccccacaacgaaatagttacagagttttaaaaaagaaaatgttcattaaaacccaccaccagaaactctctttcaagaggatccttcatattttcatggcattgaatctttcttaaagtgcatttgaaagagatgttttcagtggaatagagagatgtgtaacaatatttacaaaagcggttggctgtaataaaaaggaaaacgcaaatgagtggggacacaggggaccctgttccatttattctcaaagcacgtttgaaaactgcgttgccatagcgtccttgggtagaggcaaagtcgaggcagatcttgttcctggagtattgatttgattttggaaacggtccaaggctttcagaaatcaggctgactttcagatctaaagtctcaagaatattcgttctagcagtgagcctgtgagaatctagcccatctgggcgatgcacgctctgcttccacctagtggcagtgattggaaggacagggcacagtgttactgcatgggtggggctgaagccaaggtgaaaccgcctttgcaaaattataactaaggaaatgatgacagtgaaagacatcaaacctaactgaccccatcttgcttccaaccgctaaactgcccttcttcatttctaggcgtaggctgaactagccttgggaaggaatttagtttatagtttaaagggaaactgttcttgtaaaacgaagaaaggccaccggccattaagttaggatgagaggggctggaattctgaatattaccagccattattccagaggtcataagatttgcaacttctccagttactcttgaaggtaacatcactattgtgaacctcagagtggccttttgagatgtcttttcaggtttttgtatttttaacagctggagggccccatctggacctgccaaccagtcctgtggcccccacgttcaggaactgactcagcctaagagaatggcctccactcactatgatttcataccggagccaaccagtcagcactcccgattcactggcccccctatccaccaaattatccttaaaaactgatgagagtttttggggagactgatttgagtaataaaactctggtctcccgcacagctggctctgcatgaattactctttctctgttgcaattctcctgtcttgataaatcggcttcgtctaggtagccggcaagatgaacccacttggtggttacaaagggagtccaggccagtgtgcattactgtagtggggtccaggtagcggaggaaaggcgaggacactcagggaataaatggcagaggaagaaggagcacaagggaggacccaaaccctccagacctctccttccttctctccctgttagggttggagggaaccagcgtggtcccaggaggggtggctggtggggtgcagaaaacgccctggttgcaaaggggcctcacgtgcccgacacaagggtcctggctgttagctgctactcatgagttcaaactaggaggaggctcacacgtgtcctttgcaaagtagactccttatctcccactccggctggtttcccaaatccatcctgataaagcagaaaaaccaagagccaaattctgcgggtgacctttctgacagctggaaggtcctccccatccccattccttgcgtgctctcctcttgtcctgccccctctgctttgtctccacttcctcatccttttccctctctggaccctgctcctgagtatctcccaccttcttcagacaacttctcctcatgaagtacagagtcccccacctccaggaaaaagagacaaagaccacgagaaggacctgagaaacgcctgtgaccccgcccctgagtccagcctctccctcagcgctggctctggctgtgtgtgtgtgtatgtatttttgttttgtttgtttgtttttgagacagggtctcactctgacagtctgcagtgtcctgatcacagcttactgcaggctccaactcctggactcaggcaatcctcccacctcagcttctcgagtagctgggactacagactggagccaccacacccagtgtgtgtgtgtgtgtgtgtgtgtgtgtgtgtgtgtgtgtttgtgtatatatataccctttttttttttttttttttttgtagagactgggtcttgctttgttacccatgctggtcttgaacttctggcttcaaacaattctcatgcctcagcctcccaaagtgmtgagattacaggcataaaccacaatgcctggcccctgtgtgtgtacatasaaagtcaaagtgctaaacctggcgcctaggaaacatccccacctaggcattgcttgcaacagtmggtattttgtgcacctgtgcttttatttcaggagctgggacagttatattcatcagaacagcacggtgtcaaggccctcacccccagaaagcttargagacactgttttatggaggagagtgagattggaggaasccctgactccaggtctcctgatccttcctacacaaagcgaagctgaaaaaaagtgcaggacactccatttcctcctgggaccagacagggaagccagagccaccatggatgtcaaattccrgcaaggaaacaccagtatagcaaaatctccacatcacattttaaagctcacacaatggctcaaagagaacccacatcaaaaaaccgaattcctagctcaggtgagatcaccaaagttgcctgtgaggcttcgtggaacctgcaggtagaaaggacatctttatttygagctgcagcccagttgctyctgcgtcttggagccccttgaaaggaccctctcccttcaacagtacatagggaggccatttctggggagaaatgtagactgtccttagactcctgaggtttttacacttgcttgctgactctgtggactttgactwcatcattaaacatcttataatgatgtaatttgctttgactgtaagtgtagaacaggacgctgttcctgaatcaggaaacaagggactggtgacctgaactgccaccaccctccctggtgctcagatgyaatgaaatygtgaggcaacaaatctatggctaggtaaagggtcaactccatttcagcaaatgtttcagatgttccttcctgcctagtaatgttccagctttaccccagccttaatcttttaaaatgtatattttccttagcgttgattttaaagtaattcgtatgtatttattacactgggtttgttgcagtaagccacctcgaatgttgctgtagaattaaagtaagcaaataaatgtgtggttctccaaggagttattgctaacaccatcttaaaaatgtattaaccccaaatccaatcacttctcactcctctactgcctcctccccagggccatcctctccaagatagtaaaccagaaggccttccagctgggctgcctgctgactctcacacccgctgtccatcacccacacaatagtcagagtgagcatttcaaatgggaattagagctcatcctcgcctccgcgtcccacagacatgccagcctcttcccttcttagcacagtgaaaccccagtctctcactatgttttacagcccctcatccctcatcacaggatccttctggccactctggcctcatcccacccctctcggcccagctcattcatctccactaacactgctcaatcctgtctcaggcacctcccactggaactccccaagtgcacctgctccccagggatccaaagggatccaaaggcccctcacaccattcaggtctctgctcagacgtccagtgttcaaattcccaggaacatcttgatcaacagactatatctcctaccatcctcaccaccatcaaccttctagctcaagcatattttctccataacaattatcaccggtattagaattgttttcatttgtttcattggttgtcatgttcttcgaggcagggaccttgtctagtcaccacttggatttccagcatctagaaatccaaggacagagaaggggctcaataaatatgggttgagtaaatgggtgaatataattggtacactgcttttttttttttttttttttttttttttgagacagagtctctctctgtcacccaggctggagtgcagtggcatgatctcggctcactgcaagctctgcctcctgggttcacaccattctcctgcctcagcctccagagtagctgggattacaggcgtccgccaccacgcttggctaattttttgtatttttagtagagatggggtttcactgtgttagccagaatggtctggatctcctgacctcgtgatctgcccgcctgggcctcccaaagtgctgggattacaggcgtgagcctctgcgcccagccggtacactgcttttgagaagtaatttgataatatgtatgagaaggcttaaaaatgttcatgcggccgggcatgatggctcacgcctgtaatcccagcactttgggaggccgaggcgggtggatcatgaggtcaggagttcgagaccagcatggccaatatggtgaaactctgtctctactaaaaatacaaaaagtagccaggtgtggtgacgtgtgcctgtaatcccagctacttaggaggttgaggaaggagaatctcttgaacccaggaggtggaggttgcagtgagctgagatctcgccactgcactccatcctgtgtgacaaagcgagattccgtctcaaaaaaaaaaaaaaatttcatgccttttgacccagtaacttttattgagaaatctgtgattttaaaacaaaatccaatatatagaaagatctttaggtataaggatattaattacaataatgaaaaaaacatgcaaaagaagagtggctaggtcctctgtttggaaacagcctacagctggtgaaagctgtgtgtaagaagattttgtaatatgatagaaagttgtgtattgataataaagttttgaaaagcaagattcaaaataactcataagcatgacgacactaagtcatcctgcacagtcacccgcatgcacaaaaaccaggagtggaaactcaggggcagctgcaaagcacagctccaggccccttccctctgaagtctgaggctctgccaggcaacgtttcatcccgatcctcccagtggagacactggcagtttccatccttctgcttctttatacctttttatattttctgtacttgagattttacttcctaagaagataaaatacctattagaaagttttaaaaatttgaaataaaattttaaagaagtccaaatgtctggccaggcgcattggctcatgcctgtaatccctgcactttgggaggccgaggcgggcagatcacgaggtgaggagttcgagaccagcctggccaacatagcgaaaccctgtctctactaaaaatacaaaaaattagctggatgtggtggtgggtgtctgtaattccagctactcaggagactgaggcaggagaatcgctggaactcgagacgcagagcttgcagtgagccaaaatcgtgccactacactccagcctgggtgataagagcaaaactctgtctcaaaaaaaaaaaaaaaaaaaagtccaaatgtccattcccaactcagcttcaaggaaagtctcctctagactccacagggtagaaattcctgttgatggcaccttcagaaggtaagaaaggaactcgtcctccaccatgcctgacccgtctttgggttttaggcattggccgactgataaaggcaatactgagagtgtgatcaatgtgtagacgaccgattgtcatataatatgaatctcaccacacctgagagagtgggatagattctctcattttcatagtttgggcatctgagtccctgagagcctgaatgcctgacatggattctccaagaatgttggccttcagactctaaagggccccgggtctcctgtgaagccccctgtgcatgcaccacacccgcagaggctccacaacggcgggaagggcacccagggtcagagcccaggcgagttcacactcggggaccatccacatccagggcgtgcaggggaggggccgaggtgagagcccaacccctgcctaggctgtggtgactggtggctgcacgggggtcccagcgctcctggagctatcattctttatctcctgaagaccccggacccgcacataccaaaattctgcatttctggtggagcggtcttctcttttgagatgtaaacactacttctcgaatcttaaagccagccattgccactcctaagggataagcctctaactccactgaaattagcctcagaatttcagctgagcatttggagccacaggcaggaagtctgtgggatttgcacctggctgatctggaaggtggtcctgaaaggtagtgtgtgactaggggggctttgaggggcatggatgtccctgatgaaaggagaacaagacagatgggaaggttccaaaagtgaactttagggggccctgtgcccatcactaggatttggaaaatcttttcccagccacttttggcctgtgggttttcattctgctttcctgtctgccaagccattccaggcaatcccttcatttggtaaacatttatcaaatacctactgtgtgcagggcattgttttaagaggagctgggactgagataagaggaaataaaccctccttgccctcaaggcgtgcccagtcttgctcaggcagagatcagtaaggaaatcataacacaaattgagagaggaaaaaggaagaaactggtcaggcgggcagttatggtgggtcctcagttgaattatttcaaacaaaagaacggcctgcaggcacaaagaagggaacttgcacaggggggcttgcctaagacatgcccacagctgcacaaataagaaaggctgcacaggagacttgcccagacatgcccgcaatggaaaattctgtcccccgatacgtgggcagtcagggaaacaaagcaatatggagtaactcaagctaagggcctgcatgggcactaggaggatggggtggagctaccggaaattcgtgccttatgcaaatgagacacccagccctcatcagtttcttataaaaggctttgcattcagctgtaaaaatggcaaccatcttccaagccccctctccgtgggggagagctttcttcttttgcttattaaacttttgctccaacctcaccctttgtatccatgctccttaattctcttggtggtgagacaaagaactccaggtaacacctcacaaggagagactgagaggctgctacgttgtggtgcattggcaagactaacaaactggctagtgggacatgcacacttgcttggtagacatatatgtagatcttcagctctgactaatgaaggaataccaaaaatctcataaaagaaaataatattatttgagctttgttttgtggtgtaagtgggagccccacaggcacccagggtaggagagctttgctcagaatccaggaagtgaacatctttccctgggccaggccaagaatgagactaagctgattgaggagcctggtgcctcctggcaagaaagggtgtctgacacctgactatccagaagtcacagctactcaatattgagacttgaaacagagagagagacagagagagagagagagacagagagagagagagagacagagagagagagagagacagagagagagagagagagagagagagagagatctgatttgaaaagcagaattctgctgggggcttgttaaatgcagagtttctgatacagtaggtccaggccaggccctgaagattgcatatctaagttcccaggtgatgccaatgctgcttcccccaggaccacactttgagaaccaccaccctaaggcaatctgtgttggtttctaatatcagaagagggctgggagtgggctgggaggcagaggtgtaggatcagtgagaccacacctgacccaccctggacagctccccaccccattcttgcagcattttatttcctgggagtcctgggaatggaagacacccaggaagggaccaaatgtggggtcacagggtgatccagaggctcggcttcatacagcacctggggctcccgccactccacaactggcccccacaccctcagtcttcccacccctcacgacactgacctccagaccttcctcgactaatctcagcaggttgggcctgggatgtgacactaggagctctgagtgtaccttctgatccaaagatagggtgaccgcgtatgacaagtactcagatgggccattaataggaccttgaacatttggcaaatggcttcagtcacgtgtgcttgagaattccagtgttttctagatatggcatccatgagcccacacaaacactggagggcgtcgtgagcatactgaaacccataactgctgcactggatcccctagaatccctttcccacttagaccaagatttgaacaaaatttccttcaccaaacaaactgcatttaattaatcatgctgttattttaccttgtaatggaaaaaagacagatgtaaagaaagatcatgcaattaaaaagaaaacaacgtactgaattaaaatggcggtaaacctccttgttaaaggaataacataatatttagaaaatttttaaattttatttcgataaaggttaaaaaattccattagtttttaaaaagtttttcattttgaattttttgggggtttgtttggtctccttaggaattatcttttatttcttgatatagttcaaaattcaaaattcaaaatgttcaaaaggtaaaatgtctctctcttaccctgtctcatccccaacaggcaaccaaggatattaacttcttgcttattcttccaaatatattttatgcatatgcaagcaaatataaatgtgtacatatatatcctttgtcccttttcacacaaattttagcagactctatatgttattctacaccttgctttatttcttcatgagggaatatcaagagttttctatgtctttcttcttttgtgttaaatgtttgtagactctgccgtgtagctatgcagtgcttgtttgggttttcttaagaagggaggcctccttatgttacccagagtggagtagagtgtattcacaggtgaatgctactgtgcccagcttgcaatgcttttttaaccagtcccctagtgacagacatttggattattttttcttttatctgtcattttctttcttcttttctttttgcttttacaaacagggttgcaacatataa

SEQ ID NO: 10841 - DNA, 27779 bp, Homo sapiens
gagagctgggattgcagccaagtttatttgtacagggccctgtgataggctagttcccaaaagcctgtgatgcaagaacttttgcccatagactcagtcaccatgtagctgttacctgttcagagctggctttttgctttcccaccctactctggaattcttaaatggctttatacttagaaatcatcttatttctgttgaacctagatcaccccaaccagaaacttctattaatactttgtgctttcttgataccagggtctatttggtttccacttaaggtttttgcatactctgcccataagtgactcattagttactcaagttttattcctggctctgccactagttcattaggggtctttgccccagagtcatttcttccatgtaaaaaaacttgggctcattaaatctaggtaggaaagggcggatgtggcaggttttaatagaacaggtcaagataaggctttatttctatagaaatgatgctttgacaatagtttggcttggtgtaaggctcacaaaagaaaatcacatgtaccatgtgtgggttaagcggtttgattcacactgaaccaggccagcccagttgccctctgctgtgtccacccgtggagtggagctgtgtcacagccatcacactggtaaactgctgtagctggtttaccaggctttctcttgccctgacagtacaggtgaagcctgtaaataaatcttctgctatctttgtgaacttaaccaaatcccagttaccttatttaaatggcaatagatctgttttcccttaaactagaaaccttaattacctgtattcctacctccagctcaacccatatatttgcacctttccagtaagcaggtttgtatttccatctctccccttcccctaagattctgaattagttctccagaccttgccaagcacattctccctggaaagcaaggaatatcacagacccacaagaagagtaaatgcccaggagtgaatgaagcggcttgtccttgacttggaaataaaagcaaagctgtgaaaagccaggtcgctacgattttgttggcagcaggactagccacagagtagggaagttttggggccaggccctaggttttcccagaatgccttgggtgatgccaccaagaaccttaagaactccctcttacattttccatcggttgcaggcatggcttttgcaactgataggtgctctgactacagatattctggtgtccatggcaacatggccttatggcttgtaatagtgggaacttccagctcactggcaatttcctggaggtggcaatatctttggcaggaaaccatctcttctgtcttggccaccagggtctgctccaggccctgaatgagtccacatcaatccatccttcttccctgtagtcattccctcttggggagggaagggaaggggggtatttatcagacctatttgctcgctgctgtgtctactcatgggcaggtgtgtccgatggtgccttggcggtggaccttaggtctgaatgccagcccggcaccctgggcatcggaagtcggcctccctggcagcctggatgctgcagccaacacaggccacatggaaccagacgtcacagccatcacactgaacccaggccactgtctcttcctggggcaggcagcaacaaggagctgcacagggctccccgcccccaactgcagggggagccatgggagcgctcactgggtacttccgaggacggccacgtcgatttctgaaggaagtgacacagacacaagggtcaccggaaacctgtaggagaaggcctagaccttgccaccctatggctggtcatagggtgaggccacagaggcacagtggtctgagaactaaggtgagcctggactctgtccttaaaaacacatagggtgggcctaaaaacctctagtgtgagcctgaaagttccccatccttaggcactagaagaatggggttaaagccatatgaatgtaaaaagcaggacatgctcactccggttgttttataagcactgccccaccccacctctcatgttctcctgcacatatttttcttttcctatcagagctaacccaggtcttgccattccatctattccacctcccgtgcccatccccccaggcagggggacctcctcacagcctagggatacaaggaatcgaaaagcagtaaaacactgagagggccaagtgaggactccacttacccagtgggagtcagtggggctttgtctacacggagtttcttcctgggctccataaggaccggtggcgggttctcaggaggctcactctcatcatccagttccgccaacactcggtgaacagatttcctccgattgcgttggggtggagcagaaggcgtggtccccacttccccaggtggggcgggaacaggcaggctctttggtccaccccaactaggggagaaggtgaggggctggggccggagcttgctgaggctgcctatggagtttaggatcagtgtggccttgggggcaggggagaaggtgctgagaggccgctgtggagccccctgggagggcagcataggccggaaaccagccccaacccgggcttctcccctagaccgtgggatggtaatggcagcaaagtcctgaggcttgactcgtacttgttggaacatgaagtagaactccgaggggctggttcctgggggcccttcagggccaaaggtcaggaggtctccatcactcaattccagcctgtgacctcttgggagtcggacattattgaccaaagtacctgttgatggtggggcaccaggcaaatatggaggacaaaaacagaaatgaccagagtcaggagtggagaaatctgtatgatttctggggaagaatatgaaactgtagtcagattctccctcacatcctaagcccctcagcaggtgacaggtaccaggcagtacactccttgtcagctaggaacaagtctgtgtttcttgtgctttcctacaaaggatccctgccctcactgtcctaaggtccaattttctttctttcttctttttttttctttcttttttttttttttgagatggagttttgctctattgcccaagctggagtgcagtagtgcaatctcagctcactgcactccgcctcccaggttcaagcaattctcctgcctcagcctcctgagtagctgggattacaggcatgtgccaccacgtctggctaatttttttatttttagcagagacagggttttaccatgttggccaggctggtctcatactcctgacctcctgatctgcccgcctcagcctcccaaagtgctgggattacaggcgtgagccaccgtgccccgccctaaggtccagttttcaaacatgctcactctcccccagctccagctcgttcagatcctagctctaccacttaccagttatgtgaccctgggcaagcttttggtttgtttgtttgtttgagatggagtctcgctctgtcgcccaagctggagtgcagtggtgcgatctcagctcactgcaacctccgcctcccgggttcaagtgattctgctgcttcagcctcctgagtagctggggttacaggtgcacgccaccacacctggctaatttttgtatttttttttcagcacagatggggtttcaacatgttggtcaggatggtctcgaactcctgacctcgtgatctgcccatctcggcctcccaaagtgctgggattacaggcgtgagccaccgcgcccaggctttttttaaaaaattaattaattttttggtagagacaggttttcaccatgttgcccaggctggtctcgaactcctgagctcaagtgatccaccctgccttagcctcccaaagtgctggattataggtgtaaaccaccatgcccagccctggacaagttccttaacctctttgtgcctcattttcctttactgtaaatgaggataatattagtaccacctacattcaatacacttaaaatagggcctggctcataacagtaagcactagatgaatgttggctactatagtctaataaccataacactcctacagctgactttaccaagaggcagtggcaaaactcaaatgtgaatctaggctttctgaggctaactgcctcaagtcacggagaaagacatgcccagattattaaaaacattattcaacatagaactgccctaacccaggaacagagtgcctcagcaaagctggaaactgaatcaagtctaaacttggcctctagtggcctcagaacatccccactgtgatatctttctgatgatatcccaggtcctgtatgagctaaacgggaccaaaaagggtcagtctggcagagagcttctgactgtgcacacttctggtgggaagatgaaggtctggaccacgactatccatccaatctgatgggagtatgggaggcaggcagcaaggtcttgtggagaccttactcattccagcctggcgcttcaaccacccaggggcaaagctgccctgcttaatgctcaccttggctgctgtggtcttccaggctgaccctccagtcatcaccccggggctcggcatgcagttcggcgtggatcccagagatgaggccaggctcctgctggggccgcagggccacatcacacaggtcggccctgtggcccaagcgataggtgcagccagccccggcgggggggtggaaggtgtagagatcaccgcccctgccgccccctatgcgcagcagttggaagcagggcagcatgggcggtgccccctctgcaccacctcttccacttcaggcatccatttcctttcccactcctgggccacgcaccgctggcttaagttcgcttcccagtctgatgcaaacttgagttgtgctgtatgcggtttcaactttgagcacactacctgaatagcccaaattcagagtgcaagcagcctaggactcaatgcaaaattggttaagccgacttgcaaatgaaaaattccaggaaggtctccgtgcaatgcaaactcaggaacacgtcctatggcacctcacttgagctggatcctcagatcacaaaatatttggggagcctccaatctgcaaggcaaggatactttaggcagctcctgtgtgtgtcggggtggcggggcgcggggaaggaggtcctgttatacacacgtctacgtgcaatacgaacacatcacctctgtgtaattcggagaagagcagcttcttcctgtcaaacttgcttatcctaatagagcactcctgcttgcctgcgccccgatcttctggccaatccctcactcataactggttgaacctccgagggcaatgaatccactgtcatcccccaaaagaaagtgcaaacgagtccttaagtactccaacaaattggacctaaacccctacttcccggcttctctaggtgggataaaaacaggaaggagctccccgcgatcatgcaaggcatacccggccttttcccactccgccccagccccgtttcggatctacccgcgcggcgcagtctccgagtagcctcctcttcaagcagtgccagcctgtgcggcggatcccgggaccccttgggctcctcggcaggagccgacgttgctgcatctgtttgacagccaagaagccggggccaggaggggcgcggcctctgcgcgcgggcagcgcctacccctccttcggaattcccgggcccgaacttcgcgccgagcgagcccgcccccgtgccgttcccgattggccagctcatttgttctcttccgcgccattggacagcgccccaagatctcccgccttccactttttctgattagttcacaagttttcccgggttgccgcagtgaggaggagccgcctgggcgcggagatgctccgacgcatttagtgggcccaaatttagacgccactgcgcctgcgtacacctttccccctcctcccaacagagtgaaataggactttagggcgcccgccttgcgcaggcgcggtcaggggcagaggcggggccgggascgaggcgtagggggtgtggccaaagcgcagtagggggctctcgcggttggtaagggacgttcgggaagagtcggttgggggcgggaaggggctgagcgggggtcctgggagggttcaaggggtccaaaggggaagggggtacaggggccaggtgaagggacagatgaagagatcagaacagccttagagctcaygggctaactgggtgaagcctckggtatctaggggagcagtggtgggagagtagagccggctagcgtacagggggcgagggcaggctattgagasatgggggtgagggtcaggaccagaataattccttcagaaaaaggtagattaggttgtaaaaagggacgggagtagggatcccagattcgggtaaaaaatagattaatgagggtgggagggtgggaggaagatcttcaagtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattyccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtaraggcactgcccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcrggtggacctggctataattcaaggattatgactttgttattgtaggggctttctctttggaaggtggcctgaaaattgaattggagtgtctttgtttctcctcttgtccaggggaacatagatggctgragacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtagggatccatccacgccgttttctcaggcttgcttgctagtgacccttcctcactggaataaactccttaccctatttcggccctagtttccagaacgtactcatttttatgtaagcaattagttcctacagtgcataaataataaagcagtgtgctaagtgctagggatgaggataacaatagtgaataagacaaatcctgacttaaatttgtaattaataaggaatctaaaatcctaagaggggagatagattgaccaccagctgatggtaaagcatggtatgaggcaagatgaagaagtgcaaactagaggtagagacccagcactgtggcagtgtgggttcattctgatggaagaaagcctttacagaggacatgctgtgggagctggccatgctgtcgtattatctgtaaacattcttattcttgtttcatgtgtcttttcccagatgtactgggatatcattctgccattttgctccagaataggattacattagaagaagcagcatgatgaagaaggaatactagactgggtgtcaggagacagagactctatttctagtttggctaccagctagaggacatttggcaagtcacttaatttccctagcctacagatcgctgctactaaagaaagaaagaaagagcgagccagatatggcggctcacacctataatcctagcactttgggagctgaggcaggaggatcacttgagcccaggagttcatgaccagcgtgggcaacaaagcgagactccgtctccacagaaaataattagctggctgtggtggcatgcatttgtagtcctagctactcaggaggctaaggtggtaggaccccttgagctcagaagttgaagactgcagtgacctatgatccagccactgcattgaggcctgggtgacacagtgataccctgtctctaaaaacgacaacaacaacaatctcttatagtcctgggtctcagagagctgcctcaggagccatgttccaagctggattaaacttcacgtgacattggtagacgatttctctaaaggctggcactgtgttatttatgtactgttctctcagactcctcataaagtatacctaacactcaataaatgcctttttttttttttttttttttgagatggagtctcactctgtcgcccaggctggagtgcactggggagatcttggctcactgcaagctccgcctcccaggttgacgccattctcctgcctcagcctcccaagcagctgggactacaggcacctgccaccacgcccagctagttttttatatttttagtagagatggggtttcaccgtgttaaccaggatgatctcgatctcctgacctcgtgatccgcccgcctcggcctcccaaagtgctgggattacaggcatgagccaccgcgcccagccaataaatgccttttaactagcacctggcctcaccatattgatactggaagcttacgacctctctatgcccattcctccctcaaacttcttgcccttaaattasaattgagaagtccctgtgtgttcttccaacctttccacttaaaatgtgtggcctaaaaataaaaaaataaataagacaaaaaaaccaccaaaaaacaaaaagaatgtgtggcctaatgatatacacatttgatgttgaatcctcctgtatgtagctctctctagggagatcatgttccacgatctcagccagactttaggtcctgtgagtccaggcactggactcaacatgctcaatagggctttgatgaatgatgatgatgtcaatgcagacatccccataccccagcttcagcacccccttcacctccccacacggaagcagaggggtcctcttttccttctcctggctatgtttatgccctcaactatccttccagcactggagacaagtctcacctgcactaacctgtctttgaaggtcctgggggctggaggggtcacaggccctgagccagcaggctgaggtgatcgttcggcagctgcaagagctgcrgyggctggaggaggaggtcyggctcctgcgggagacctcgctgcagcagaagatgaggctagaggcccaggccatggagctagaggctctggcaygggcggagaaggccggccgagctgaggctgagggcctgcgtgctgctttggctggggctgaggttgtccggaagaayttggaagaggggagscagcgggagctggaagaggttcagaggctgcaccaagagcaggtgaatgcaggggtagaaaggattcaaattcataacggagagctgggcagtagcttccaagcaaagaacaggtattgcagaaaagaccctccatgagtagtgagtagtagagtgatgagacctttggtgaaaataaacacacatgggctagaaagatggagaatttgggtacttttatcttaattcaggttgcacttttcccccaagactcaggtggcctcccaccacttgaagccctgcttccctttctagtaggaaatagtttgcctccctactttactccaggtaccaattcatcaggggtattgtggagggcagtgaggaaggkgggtataagggggctatggtggactgggagagagagattattcagtcctcaaactcagtacttactctgccatctctaagactcagtgaccaaattagcctgagtcctgccttcgtggatggaactgacagcctcgtgggggatatacacatccacatttaatttaatcataattaattgcaatcaggaggaatgccttgaaggagaaggactagaaagcactaacttagtctggggttcagggaaggccactgtaaccagttgacatgtcaaggaaagaaaccatagccctgggcgcagtggctcacgcctgtaatcccagcattttgggaggccgaagcargcagatcacaaggtcaggagttcaagaccagcctggccaacatggcgaaaccctgtctctactaaaaatamaaaaattcaccaggcrtggtggtgcgcacctgtaatcccagctacttgggaggccgaggcaggagaatcacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccataaaggaaaaaattgatccattgactttataacatgaacattaggaatagccaaaaagaaaaaaaaaagctatatttatagctcagatcacaagaaaagggtaatatccctaatataaaatgtgtgcctagaaattggtaagggaaagaccagcaatccaatcagaaaatggacaaaggagatttatgaaagaaacttagaaacaagaagctaggccaggcacagtggctcatgcctgtaatcccagcactttgggaggccgaggtgggcggatcacttgaggccaggagttaaagaccaacctggccaacatgaagaactctacaaaaaaatacaaaaattagccgggtatagtcgtgggmgcctgtaatcccccagcttcttgggaggctgaggcaggagaattgcttgaacctgggagacagaggttacagtgagctgacatcacactccagcctgggcagcagagcgagactaaaaaaacaacaagctaccgtttgtgctgaataggagttggccagtgaagaggcgtgtgaagtccagtggtagctggaagacacttggtgggacaacaggtgaaggcggggacaggaggccagaaggctggggcacagagatgaggggcactgagtgtgctgcagagcccaggrcccagggcacaaggctttggccacttcagaacttgctactttcccataagagcaatgagcaggctgggcacagtggctcatacctgtaatcctagcactttgggaggccaaggtggaaggatcatttgagcccaggagtttgagaccagcctgggcaacaaagcgagacccccatctctattttatggaagaaattagggctgggcatggttgctcacatgtgtaatcctagcactttgggaagctgaggcgggtggatcacttgaggtcaggagttcgagaccagcctggccaacatggtaaaacctcatctctactaaaaatacaaaaattagctgggcgtggtggctcatgcctgtaatctcagctactcrggagggtgaggcaggagaatcgcttgaacctgggaggcagcgtttgcagtgagctgagatcgtgccattgcactccagtctaggcaacaaagtgaaactccatctccaaaaaaacaaacaaaaaaaaattgttttttcaagtaataagcaaccgttgaaaggttgtttttttttttttttgagatggagtctcgctctgtcgcccaggctggagtgcagtggcgcgatcttggctcactgcaagctccgcctcccgggttcatgtcattcttccgagtagctgggactacaggcgcccgccaccacgcccagctaattttttgtattttaatagagacggggtttcaccgtgttagccaggatgatctcratctcctgaccttgtgatccacccacctcggcctcccaaagtgctggaattacaggaatgagccactgcgcccggcctgttgaaaggttttaagcagggaaataacatgattagatttgtattttatgtctaaaaaattttgtcatttatgtcccccaaattaattttattgttgtatggagacagggctagaggaggcagaccaggaagcagggtgggcactttgccctcctttccagtccatcccatgactcttggtggctctgacacccctgcaacmctttgaggtgccatgagcaaaagacacaaaattcctcctttcctggagctttccttccagtgtggtccgacagatagtaacacatacacataagcaagatatggtcagtgctaagtgctcaggaggacgtgaacagctgatggggcagagtagggtggggagggacrgtattagagggcccagtgaagccaccctgaggaggggctatygcctggggtctgtggagcaaggaggggccgctgtctggttctcagcagactccccgtggccggagcggggagcagtgggagagcctccagggtgagctcaggaggtaggcagaggccgggtcccctggcctgcaggtgtggagagacacctgggttttgttgtgaatgctgtgagaagccactgagggtttgtaaagactagttaggagatggtcgctgttgcccaggcaaaagatgagggttggtggcagtggagacggagacagagaggtgaagatatgttttgggggagatcggacaagaactcctgatgggttgtggggcagctgcrgagagtgagttgccagctctccatttgctgtgcacagttggctgattggttgggtcattctctaaggtcacagaaagtgggagtgaagggaacaaggaaggcctccrtgtggggtcgagcctctgctgagccccctcttctttccgcagcwgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgaggtaggtgggcggacgccgacgggagcccagcaattagtgatgtggtggatctgcagggcgccccactgatggctgtcccattcccaccccaaccctagcaagacccaggaagacttggaggctcaggtgaccctggttgagaatctaagaaaatatgttggggaacaagtsccttctgaggtccacagccagacatgggaactggagcgacagaagcttctggamaccatgcaggtgagggtgcaggaatgtatctgtgtgcagacttagggatcaggttgggaggcaagcgtggcccttggaggagcgtgtagagcacagcctccgggagagaaggtggtacctaaggcggcatggaggccctacagaggggctgctttcctctgcccgcagcacttgcaggaggaccgggacagcctgcatgccaccgcggagctgctgcaggtgcgggtgcagagcctcacacacatcctcgccctgcaggaggaggagctgaccaggaaggtacagcccaasccccagacccctcaccctcagccgcatcctgcatctactgtcccctgcctccctccctgtgggcaggaggggtcaatgtgccccagaacctgcttagatctccttcctgtgaactcctcttgctgtagctcatgttgcccaggcaggacagaggagaaacaaagatgccacctccttcctctcctcccccaggagcccacrcttttctcccactccttctccctcaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtcactgcactctcttttctcccggtattccctcccagcaccttgctccttccatgaaggtggcatccattcaaccagtgtttattgagtggttgccacatgctgggcacacagccctgaacaaaactaaaatgtggagcttgcattctagaacagagacacagaacacgcaagtaaacagataatgttgggtaattatatgtgcgatagaaagattgaagccrggtgcagtggctcacacctataatgcgatcactttggtctysaactcctgacctcaggtgattcacctgcctcagcctcccaaagtgatgggattacaggtgtgagccaccgtgcccagtcaagtaatgccaacagtttgggagaccgaggcaggtggatcactggaggtcaggagttcgagaccagcctgggcaacatgtgaaatcccgtctctactaaaaatacaaaaaattagccgggcatagtggctcattcctgtagtcccagctactctggaggatgaggtgggaggatcacctgaggctgggaggtcgaggcgaggccacagtgaactgtgatcccatcactgcactctagcctgggtgacaaagcgagatcttttctcaaaaaaaaagaaagtagtaagaaaaattcaaaagataatgtgacrgagagactgtggggtgagtcagcctcaggtaggatgctcagagacagcctctctgaggaggtgacagcatctgaggagagtggcatggtcagttggtgggtcttgtggggtgkgtcaagggctattcccatcttygagtgggcacatggaatgtggaacatggaacactgggctcagattccatcctcagaacctaagcttctgtctccctgcgtggcattcattctttttcttttcttttctttttttttttttttttgagaaggagtcttgttcttgtcacccaggctggagtgcagtggcctgatctcagctcactgcaacctccgcctcccaggttcaagtgattctcctgcctcagcctcccgagtagctgggattacaggcacatgccatcacgctcagctaatttttgtatttttagtagagacaggctttcaccatgttggccaggctgatcttgaacccctgacctcaagtgatccatctgcctcggcctcccaaagtgctgggattacaggtgtgagccaccgtgctgcgacccacccccgtcgcccgcccyccctccccccagcccctgcatggcattcttacagagatctctgcacctgccactttgcttccagtgcccccctcatcttttagctctagagggccctgccyagctctctctcctcccccaggtgrcctcactccaggaaaaagtgacatcccagagccaggagcaggccatcctgcagcgatccctgcaggacaaagccgcagaggtggaggtggagcgtatgggtgccaaggttggtgtcagcctactagagactcggggagggcaagggagcccctgttccggggctgcagccaggacttagggagggaccctgtcctttgctgcatcctccccagggcctgcagttggagctgagccgtgctcaggaggccaggcgtyrgtggcagcagcagacagcctcagcygaggagcagytgaggcttgtggtcaatgctgtcagcaggtatcagggatggaggggtgggtggagtagtgtttctgcyacctcaggktcctgggcaccttgttgctgaggatcctcaggcaagaggggctggaaagtggccactggaggctacagggctgggcagatttagctctatcaatgttcctgtgttcgtttcttttcctggggaagccccttctgcattcatacctgattgcttgttatgaatttcccgttgcatgtttggctggaggtgaggccttgcttcctcctgcagttcagtctagtaatggcttgagctaaatagagcacccgggaggatcttcacttgcagtattgttcaaggatggagagtgtagacacttcatcttcctttttttttctaaaattttacgggcaatccgtttcactggagaaaaatttagtctatttatttatttattttgagacaaagtctcgctctgtcacccaggctggagtgcaatggcrcaatcttggcycactgcaacctcacctccctggttcaagtgattctcctgcctcagcctcccgagtagctggattacaggcatcctccaccagtgtcctccactacgcccggctaatttttgcatttttagtagggacggggtttcaccatgttggccaggctggtcttgaactcctgacctcaggtgatccacccacctcagcctcccaaagtgctggaattataggtgtgagccactgcacctggcctagtctatttatttaaagctgtatacttacttgcttattatatacttaacttgcttactattccatctaaaatgtaagccagttagtttccttctaaatcaattgccagcctttgtctctcctaccaacttcctagttgtttcattacctacaattgttgtatgaccttcagaaaaacctctaagaaaacagcaaagcttctttgtgctggtgatgacttcccctcagccttagacactgaggtacccaaggcargtagttcttttttttttgagacagagtctcgcactgtcacccaggctggagtgcaatggcacgatctcagctcactgcaacctctgcctcccgggttcacacgattttcctgcctcagcctcctgagtagctgggattacaggtgcacaccaccacacccggctacttttttgtatttttagtagagacagggtttcactgtgttggccaggctggtctcaaacttctgacctcgtgatccgcccgcctcggcctcccaaagtgctgggattacaggcttgagccaccgtgcccggccggcaggtagttcttagcacagtctctggcttgtaaatgttkattgttatcgtgaggctcttcttgatgggttaatwtagataaagataatttttggtttagcgaaattaagatgcaggatgagtccttgcccaccacttccttctcttgggtttgtaccttagggactaatttagctttaaaaattatgaaaaatttcaaacttgcacggaattaaactagttataatgacctaccacccaggttcaatccatcgcgggtgccccctacctccaggagaacagaaagatgcactgtggacagggtttgactttggtaccaggtgatcacagaaatggtctgtgtaatgatgcatttgccgaaagtcctccaggcttaaagcagtccaaactctgattgttgctgggtttattagattgtctctaggtaattggagactttaataagagctgtggtaggtgttggaagcatctactggaacaatttccagatcaaagtgaactttgctgtgctgctggggatgcagctgcaagccttcatcatcatgtgtttttctgtgggtgcagacctggactctcctgaggaaaccccagcccggccccagacactccttggcctcctcctggggcctgtttaagctgctcagttttcatgagccaggttggtcctacttctggcacagccagctggtaaagcatgtggacctgcccgtcaytggtgctagatcgacactcctgggcttggagaggataactttgttttcttttgtttttttgagatggagtctcgctctgtcacccagtcttgagggcaggggtgcgatcttggctcactggaacctccacctcctaggttcaagtgattctcgtgcctcagcctctggagtagctgggattacaggcatgagccaccatgcccggctaatttttgtgtttttaagtagagagagtttcaccrtgttggccaggctagtctccaattcctgacttcaggtgatccgcccgcctcggcctcccaaagtgctgggattacaggcaggagccactgcccctgaccagagaggataactttactctttgatacacgatagtgagcaaaacacagttgtgagaaataagcttaacaggttgcttaaaaagatagtcatttaatgcattcttggggcaagggtcctttagataattgacggaagctgtgcgttctgtacttgtataatgggacaggattagagggagttgtctatacaaggcacagcaagtcctttgggaatgaggggaggcatggaggatcagtgacttgtgccctctccagctctcagatctggctcgagaccaccatggctaaggtggaaggggctgccgcccagcttcccagcctcaacaaccgactcagctatgctgtccgcaaggtccacaccattcggggtgcgtaggacaactgcgagccacgtcctgcccccaccccaccagctcggactttcttcttcctgacccagctctctctgatcccacatccattcaccttcctcctttcaccagtccttgcatctctttttcccttactccctgtcyccactttctcccatgcaaacttcatctctttttctccctgctttttcccyyccaggcctgattgctcgaaagcttgcccttgctcagctgcgccaggagaggtgaagtttgkgcactttgaggtggatggggctttagggcattggctgctgggacccccaaaaccatgaggactgaggtgggatgggggctttgggatcaggcagctgggtkatttctyctgactctttctcttccccgtcycagctgtcccctaccaccaccggtcacagaygtgagccttgagttgcagcagytgcgggaagaacggaaccgcctggatgcagaactgcagctgagtgcccgcctcatccagcaggaggtgggccgggctcgggagcaaggtacacctggttgccagagggtggagaggatgaggaaaaacccagtgtctagggtgctgggagaggcctgacccagcaccccctccttttaggggaggcagagcggcagcagctgagcarggtggcccagcagctggagcaggagctgcagcagacccaggagtccctggctagcttggggctgcagctggaggtagcacgccagkgccagcaggagagcacagaggaggctgccagtctgcggcaggagctgacccagcagcaggaactctacgggcaaggtgtcgagagggaaatgggtgcttcccttggagggtggggtgggaactgcgaatcaaagstcctgctgatatgccccgtctgcactttcaccccagccctgcaagaaaaggtggctgaagtggaaactcggctgcgggagcaactctcagacacagagaggaggctgaacgaggctcrgagggagcatgccaaggccggtgagccttgccagggtggatagggccttccaggaagaaggaagtgttaagacataaggttattattttcccctcaaagtgtgttcaaagcttcattacaggaagtaatraaggtatccaggagtagcacagatgaattatcacatcgtgaacacacccatgtagccagcaccagattaagaaacagcatatggccggtcgcggtggcttatgcctgtaatccaagcactttgggaggccgaggtgggtgtatcacctgaggtcaggagtttgaggccagcctggacaacatggcgaaaccctgtctcgactaaaaatacaaaaattagctaggcctggtggtgggcacctgtacmccaagcttacttgtgaggctgatgtgggaagaytacatgaacccgggaggtcgaggctgcagtgagccaagattgtgccactgcactcaagcctgggtgatagagaaagaccatgtgtcaaaaaaagaattgtgtaatgaatgtatcttctctaactaaatatagcagttaacatttgccacatttggtctcttatctatatacacacatatttgtacatcttttgaatcactttaagttgtaatcatttaatgttttgttgttgttgttgtttgagacagagtcttcctctgtcaccagctggagtgcagtggcatgatcttggctcactgtgacctctgcctcccgggttcaagccattctcctggctcagcctcccaagtagctgggattacaggcgcccaccaccatgcccagctagtttttgtatttkcagtagagacgggattacaccatgttggccaggatggtctcgagctcctgacctcgtgatccgcccgcyttggcatcccaaagtgctgggattataggcgtgagccaccacgcctaagtaagttgtaaacataagttgttcagccgcatctcccaaagccagtaaattctcctatatagctgcaatcatcacactttaagacagtgaacactaattgcacaaaatctaacccagttcatgttcagatttcccctgaggaactccaggatggttcagggatgaggaagatacttaggttcagattcccaggctcctagagcatcagcccacccctccaactgtacagaagagacagatccacagagcagaacagcctccccaagccacagagttggtgacccagcgtttgttcctgtcttcatggtgcctggctgcctctggcctgactcacacctgcctcctctgtgccttggcctctctgtagtggtctccttrcgccakattcagcgcagagccgcccaggaaaaggagcggagccaggaactcaggygtctgcaggaggaggcccggaaggaggaggggcwgcgactggcccggcgcttgcaggagctagagagggataagaacctcatgctggtaggagacaggagggcagacaggcagacactagggcccatcctgggctggttcctgggctagaggtgtrgaaagaggatggtgagggaggctctatccgggctaggtttaaccctctccttcccaggccaccttgcagcaggaaggtctcctctcccgttacaagcagcagcgactgttgacagttcttccttccctactggataagaagaaatctgtggtgtccagccccaggcctccagagtgttcagcwtctgcacctgtagcagcagcagtgcccaccagggagtccataaaaggtcttgggccaagcacaaagggacaagggacaaatgcgcgcacttcaggaatctcctcttcagactctcgcatgatgagtgttgttctctgcggtccttcgaggcccttagcctcttttagcgatgcccagcttggaccaaagagcctcctctctcccattcctcatttcctgtgccagccctgtttcctctgtaaccacgagcaccttcccttgtctggtgctcatctgctgtcttccttcccagggtccctctctgtcctgctcgatgacctgcaggacctgagtgaagccatttccaaagaggaagctgtttgtcaaggagacaaccttgacagatgctccagctscaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagaygactacagaaggagccattgtttggaaatgttatttctgggaatctgtgggaattctccctgcagccatctctcttggagattgtgagaagtggtcccacccatagctctctctatgggtggcaccttttcaaatcctttttctaggcagctttggaaatgtttgggaagctcctgcttttctttattctcaacttttgttttaaaactcttttcttctggaagatgataaatgctaggagtggggaagatgaaacattcactcgttcaacaggaatgtcaatgccaggcactgtattagcctgggggccacttggaccctgagagcctacatcctagtgggagagagagcgagcagatgggacctaaacagatgaacgagatcgtttcaaataagtgcttgaagagaaagtacagtatgatgatatgatagaaactgactctggggagaggcctctgagcaggggaccttgtgcagaggcctgcctgaagtgggctcctgtggaggccaggaggtctctgtagagaatgctcaaggatgctgctgcgaggccgagatgtggccaagtttggattttactgtaagtcaatagaaagccattggagtacttctttaaaaacggggaagaaagccaggtgtggtggctcacgcctgtaatcctgacactttgggaggctgaggcacgcggatcacctgagctcaggagtttgagaccagcctgggcaacatggtgaaacttcgtctctactaaaatacaaaaaattagccaggtgtggtggtgtgagcctgtagtcccagctactcaggaggctgacacaggagaattgcttggacacgggaggtggaggttgcagtgagccgtgatcatgccactgcactccagcctgggtgacagagcgagactcagcctcaaaaaaagaagaagaattaaaaaaaaaaaaaaaaaacagggaagggggcccggtgttgtggctcccgcctgtaatcccagcacttttttttttttgagacagttttgctcttgttgccaggctggagtgcagtggcacaatctcagctcactgcaacctccacctcccaggttcaagcaattctcctgcctcagcctccggagtagctgaatcccagcacttttttgggaggccgaggtgagcggatcgcttgagcccaggagtttgagaccagccaacatagggagactccatctatataaaaaataaaaataaaaaacattggagggcatggtggcgtgcacccatggtcctagttactccagaggctgagttgggaggattgtttgagcccaagaggttgaggctgcaatgagctgtgatcgcaccactgcaccccagcctaagagagcgagaacctgtcctcactccccaaacaaagggaagacgcaacatgatttggtgtacattttttttcctgagggacttactggatggtcccttccagagtgaggtacacatatccacgcactgtggtcagcgattgctcccggcacccagcgcagcagatgggtgggtctaaccaggtcacttccccaggagggcataattgagcagtttccgcatcaggtccacgtgggccagcagcatgcggcaggcagcggctgtggcgcttcaggcccagggcgtccccatcagcgtacttggactgcagcagccccaggtaggcctcccacgtgttgcccacagtcttgctgcaggtgaagcagcgcacacaactcctgagctcaagtggtcctcctgtgtcagcttcccaaagtgctggcatgagccactacgcctggcctgatatatatatatatgttttttttttttttgagacggaatttcactcgttgcccaggctggagtgcaatggtgtgatctcagctcaccacaacctctgcctcctgggttcaagcgattctcctgcctcagcctcttgagtagctgggattaccaagaggcatgtgccaccatgtccggctaatatttttgtatttttagtagagacggggtttctccatgttggtcaggctggtcttgaactcccgacctcaggtgatccgcccgcttcggcctcccaaagtgctgggattacaggcgcgagccaccacaccaggcccgcgtgatgtatattttaagacctcttttgctggtggaggacaggctttgtgtgagggggagggataaacagtgggagcaagggggccaattagaagggtgttggggaggctcaggggagatggtggctcaggatgatgggctgggtttggacagggtgtggaggggcttgcaggtggatggtggaggagtgtaacgaaggtttctgcgtgagccctggagggaacagatgagatcacgccattgcataataaggtgttccttactgtggggtagcggaccaggcagggaacaacctgggaggaatcaaattttattttggacatgttacttctgaaaggctaacagacttccaggcagaaaggtccttgagggaaacgttctaggggtctctctgggaggcttagatcaaggagctgagaccaaaaggagaatgggagggaggagacgagtacaatagagttggagccaaggtcctagaggcggataggtggattcctgagggaggaggaaggggctgaggttgctggagcctggcagcttcttccggagccattggcaggactgatgcaaacagctctgggtgggaagagggaaccaggatatcctcctgtgtccttccttttctgcagtcatcctgggtggctgccagatggaattccttggatatcattgcttggaggtcccctgcatgcctgaagaaggacatggtggagagcaggatgcctggatcccatgggggaagggaagtgcccaggaaagcacgaagccccagggggagctttcagtgcgggggtgagtggggaggctggggtagtagctgacactgtcccagctgcatcccaggtttgaaaggcacctcctcccccagcgcaggcatcctgcctcccaaccctgtaattacggtgcttcccaacgcccatcgtgtggtttgctcccattctttggcttccaatagttgcaagggatgaaggtggacatctctgtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggcccctcctccactcctcccctataaagcctcttggggttcccaggcacccagactcagcccaccccagctttgggggccagtacatagccatgatcctcaactggaagctcctggggatcctggtcctttgcctgcacaccagaggtgaggtgggaacagaggcagggactgcagtttggggtgatgagggatactcaagatggcggaggtgaactggacgcatggggttggggacaggaattcaggggatgcagaaggtgcatctggctcaccagaaatggctttctggacacattgggtgggggacatggtgcagaaggtgcatttggctctcaccagaaatggtttgctggctccatgtggcaaagtcggtcaggattaacgtgggggggacgagtttcctcggagctgggatctgtgttaaggagctggggtccttgtaaagctggggtctgtgtgcctgggggccaaggtgtaacccaccttgggttgcaggttggcctgaggacaaagctagtggggtaccccaaccaggggtggatggagcttatttggagaagtctggtcagtttaaagtgggtcaagtgaacggttcagatccatcgggggtaggggttcatgacattttaccatcagttaagtatttacaaacctaccgagagctctttgagagtgacttttttggtctgtttgtgggtcagttcaggctgcgtccatccagacaggctcctcctcctggggctggggctgggtggggctggggagagaagccctcaccacctcttacctttctccttcctcctttacaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctatggtactgtgttcccttctgccacctggtggccggcggcaggaactatcagtagacagctgctgcttccatgaaacggaaaaataaaaatcatgttttcttaattctgaatctaggctgctgctttaactaacacttagggtctttttcatttatttttatttatttgtttttttctttttttgagacgaagtctcgctctgtcgcccaggctggagtacagtggcacgatctcggctcactgcaagctccgcctcccgggttcacgctattctgcctcagcctcccgagtagctgggactacaggcgcccgccaccacgccaggctaattttttgtattttttagtagaggcggggtttcaccgtgttagccagagtggtctcgatctcctgacctcgtgatctgcccgcctgggcctcccaaagtgctgggattacacgcgtgagccacagcgcccggcttctttcttctttttctttcttttttttttagatggagtctcactctatgcccaggctggagtgcaatggcacgatctcggctcactgcaacctccggctcccgggttcaagccattctcctgcctcagccttctgagtagctgggattacaggtgcgcaccaccatgcccggctaatttttgtattttagtagagatggggtttcaccatgttggccaggctggtctcgaactcctgacatcgtgatctccccgcctcggcctcccaaagggctgggattacaggcgtgagccaccgtgcccggccaacacttatgtttttgactattaggatgccctcttcacagtcctaaacttacggagacctggaagtaacttgagttcctatcttgcccatgtccagcatgtaaggctctggggcttagcaggaggagggttggaaatgtcactatgcaagtcacaataacattcaggcccacatttctccctttctgagaacactatattaaagaatgggaaggcaagtttcatctctgtttaatggcctatggcttggatacccctagtggtatatgcaaaccttcccaggggtgtgtcggcaggaccagttttaagggaatcagtttccagattaatatgtgccccccgctagaatgaatctcctgcttgtcctgggcctgaccagagtgcccttcccagagccgccaaaggtcaataggaaacaaatcaacctttcc

SEQ ID NO: 10842 - DNA, 14132 bp, Homo sapiens
catggtgttgagggaattgatcccactgcagtgggcgtcagtaagtgcagggcctcactgggaggtttagtgggggtctagccagaggccccgggggtcttcaggaggctgagcaggggcaggatggtcactgtcctgacaggaacactcagctgaggggagggaatctagccagcaactcccgtggctgcggctgcaggaaggagagcagccaggctgagggaggagctggacgaacattttctaccctgccttctggggacacgacacactgtagttctgggtgcgtcgttgtgccagcaccttgcagtcttggaggtgatggtgtctgcaggatggattagcccagcatggaatccaggtgcctcattcacgacaagaagttgctgctctgaagtcttgcaaagctaaaccccactgcagtgagcactgaggttccttggagctctggagggattcacactgaggtcggaggagtttccgctgattggggcccagccgccttctgccaggctccccgagtggcggcacgctggctctgcctctgaggcttctctccctcctgctttgcttaggatgttgagggttgagacgggcagggttgggccccccagcgtggttgggatctgctttaggaacacttcagagtgggcctgtcactggctgtgtcagggactgcaggcggcagtgctcatggccgggcatctgcagtgctcatggcccccgtgctctaggccacggacagcatagacctgttgagtgtcaccttgcacaacagtctcaggccaaagcctgggctcgctctcctgagatgttccatagatagagcagcctgttcccggcgcagacttgggggcctgcgttgggagagggaccggggagggctgctgctagagtgtcccacaagcagcagagtcgctggaggggcggggaggctgcgccacctgctggatgggcaggcttcaggcagtcgctggtgcgcgggttaccggctgggcctgtggtttcctggccaggctgaggctgtctccgtgtgcctgtggtcagtcattgcccccaatccttggcacttagataaagtagatgaaatccgtgtccattccctgtggcggcagaacatgctatcccacactcgatgccttaaggcaccccacccttactgtctcactgttgctgtgggtcaggggtccggactcagctgagctgtgtctctgcaggtggccatctcagcttcaccaggcagggcccgacttcactcagtctgggttgtcggcaggacagggggcctctctggctgttggccagaggctgctgctcctggtcccctgccacctgggcccctccacagggcggctcatggtgcagtagtggctttctccgggcgtgcaagcagagagtgctggcggggtggaggcccagccttggtgccctggtttccattacattctttcatctttgccccgttctgttagtagccagtcctcaggtccagccagggtgtgggtcccaggaggtgggcaccgtggggagccgtcccagaaggcgccccccacggtccaccgaggactctgggagtcacgaggtaactccctgctgcagggggcccgctgtggtggccgagtcccatgttcctgccccacctggcacctgtccttgttcccccatcacaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaaccgaatataccaggcaaaactccttggtgcctgcgctgtgtgtgtgtgaggtgcgcggtgtgattgtgcgctgtgtgtgtgtgaggtgcacgctgcgtgatcgtgtgctgtgtgaggtgcgcgccgcgtgatcgtgcgctgtgtgtgtgtgtgaggtgcgtggtgtgatcgtgcgctgtgtgtgtggtgcacgccgcgtgatcgtgcgctgtgtgtgtgaggtgcgcggtgtgatcgtgcgctgtgtgtgaggtgcacgctgcgtgatcgtgtgctgtgagtgaggtgcgcgccgcgtgatcgtgtgctgtgtgaggtgcgcgccgcgtgatcgtgtgctgtgtgaggtgtgcgccgcgtgatcgtgcgctgtgtgtgtgaggtgcgcggtgtgatcgtgtgctgtgagtgaggtgcgcgccgcgtgatcgtgtgctgtgtgaggtgcgcgccgcgtgatcgtgtgctgtgtgaggtgcgcgccgcgtgatcgtgtgctgtgtgaggtgcgcgccgtgtgatcgtgcgctgtgtgagtgaggtgtgcgccgcgtgatcgtgcgctgtgtgagtgaggtgcgcgccgcgtgatcgtgcgctgtgtgtgtgaggtgcgcggtgtgatcgtgcgctgtgtgtgaggtgcacgctgcgtgatcgtgtgctgtgaggtgcgcgccgcgtgatcgtgtgctgtgtgaggtgcgcgccgcgtgatcgtgtgctgtgtgaggtgcgcgccgtgtgatcgtgcgctgtgtgagtgaggtgtgcgccgcgtgatcgtgcgctgtgtgaggtgcgcgccgcgtgattgtgcgctgtgtgagtgaggtgcgcgccgcgtgatcgtgtgctgtgtgagtgaggtgcaggccacgtgatcgtgcgctgtgtgtgtgtgaggtgcgcactgcgtgaccgtgcgctgcatgtgagtgaggtgtgcgccgcgtgatttgggaagaggcttctgcaatgggcaggcttctgggtacatcacttaattcgttcaggccggctcctacctgctgtccagtgatgaagtctccacacaggaacaggttcatgctggcgatgactatgatgtggggtatcgctgggtactcagaatccttttgtgtatcaaaagctggaatgcttcaaatttttcataagtgccttgttttccttttaacattgatctggaaacagtgctgtctgcaaagctgaggcccactcctctctgctggggatcaggggtttcagaaggcaggggccatgctgggccactgtcctgtacaagcagcctggcctccttcacgctgccagggcatctggcgcagggcatgctttctcattcatagtctgctttgaaagtcttggttttaggagaggttcaggttggtcttgctggcatcttcacctaaaatagggtctggcagacaggcccatgcgctgcatcctgcccacggcctgatagatggcctgtgaatggcttttttacattttaaaagtggttgaaaacaaattaaaaatatatttcatgacatgaaaatcatgaaattcacatttcattatctgagaataaacttttatggatgcagccatgcctgtctgtccatgtcttatctgtgtctgctttgtgctacggctgcagagtggagtggctgggactgagacggaacgccctcctcacggggccgcgtctctccaccaggaccgcggggctactctgaggctctgcttcttccccagcggggttggcttcctgctattcctcagcatcctgccttggtcctgagttggtccctctgccaagagccgtttctgtgtctcagtggatggcgcagctgccttcttgctggtaccttgactgatagactggttcctgttcacctgcccgaagtcatcccagaaatacctcttacagttgcatgggttgaacccagctccgcgtgtatttagagttttgtctcttgccccttcacccagaacagcagcacccaccaccttcccgtcccctgtgactgcctcgcaactgggtctgttctgtgagatgtcgccaccctgtttgccatctgggaggatctcactccttcaatttaatctgctctcttccgttatttttttagtttctatgtattttacttttaggacattccttggactttgttctacctctttaattgatgaagaaaatttggtcattgtatctggtttttttttttgagacagagtctcgctctgttgcccaggctggagtgcggtggcacaatctcggctcactgcaacctccacctcactgcaacctccgcctcccgggttcaagcgattctcctacctcagcctcccgagtagctggattacaggctcctgccaccacgcctggctaatttttgtatttttagtagagatggggttttgccatgtttgccaggctggtctccaactcctgacctcaggtgatcctctcgcctcgcactcccaaagtgctgggattataggtgtcagccactgcacccaatctattgtatttaattctaagcactttcttccagacggtctcactctgtcacccaggctgaagtgcagtggtgtgatctcagctcacagcagcctcaacctcccaggctcaagcagtcctcccaccttggcctcccagagtgctgggattacaggcacgagccattatgcccagcccgtctttcttcattttgattacagtgtgcgtactgtacatccgagaagtgcatgtgaaatgctggaactgggatttcagcaactgaatgcacgtgtgtgactacccacgagaagcaggacacttagcacctgctgagaagcccccacgcccatgttcccttctaggcactgcacaggcatgctggccggcctgacctcagtttccctcttgctgtggccgcttctgctccactctctgtgaggctcatccaccttgttgcctgtggttgtggattgttcattctcagtgctctgtatgccaagtactccattgtgtgaaaatcccacagcacgttcattctattatcaatgggcatttgggtagtttccacagtttggctgttaggaatagtgcagtgatgaacatgctggcacctgtcttctgttttttttttatttttagagacagggtcttgctctgttacccaggctggagtgcagtggtgtgaccttggctcgctgggcctcctgggctcaagcgatcctcccacctcagtctcctgagtagctgggactgcaggtgtgtgcctgcgtgctggctaatttttgtagtttttgtagagatggtgtcttgctctgctgcccaggctggtctcgaacttctggcctcaagcagtcctcctgccttagtttcccaaagcactgggattacaggtgtgagccactgcccccggccagcacccgtcttctggaacatttgtaagcatttctgttgggtgtgtacttgcgcgtggaattgctggctctcagttatgcacatttcttagaagatcctgccagtccttcatcccagaccccgaccccagcgtggaaaacgcagtgcatcctcaacgcctagtgtttgcggctgtggcrgctcatgatcgacttggaaggcccacagtgtgtggtgtggagttttgcagggagccagtgacactgcccaccttcgatccagacctaaccttgatcctgttctctgaggccaccttaccaaaaccttgacttacccgtcttagatcacttaccctgggggaaatgtgccgcaagctcacgagggcactcagccagcctacaaaggttaccatggcagagaactgaggcctcctgccagcagccagcagcagctgaccagccgcgagggcccctccgggaaggagagctttctgtgtttcttcctgtaccccatatatgttgacgtgatacgttttactttctgatttcccttgtgagatctttggtctgtgggttatttggaagtatggtttaatttccaaacatttagggttttcctccagattttgttgttgtttctggtttctggttttaattccactgtggtctcagaatatactttgctgacttccctctctttagatttgttgagccctgttttgtgcttcatagtgggagggtgattgtatgtgcacgtgcagatatgtgtggcccccacacggtatctccagctatccgtgtcttgcctctccgtgcccagtgcacccttctcagccctgccgtgtgaccctgggctgggccctccctgtaccctcctttgcaggttggcacagtgtttggctctgtcactggaaggagctggagggactccacaggagggaggggcctgccctcctggttccagtgtgcttgcttttcctggcttccgtggtgtgtgcctgccagcctcatggtgggggcgggggctctcagtgacagtctgcaggagtttagcaacacccaggttcattcaccacggtgggaaggattcctgctaagcttccttgcctctgtccagctcccagggcgtctgcctccctcctgccccagggagagcttytgggtgagtctcgctggcactcctgccccgggcttcctgctctcaggccttggcctgctgcaccttggccaactgcaccacccggcacatcatagccccactcaggtcagagctgcgtctcagccgacgtggggttccgaggttctcaccaagatccagactcaacgcttgtgggtttgttgtctcagtcctggcggtggaggttctcccgaggcctcagcgcctccgttctcggaagtctctttacatgttagtggaaccctctgttcctgttgaatcattcttcgtgttaaatgtttctatctcttgactgatacatgatagtcatcatgtatgtattctgcggctgcttttgtttttttctctttatccctggttttctgtaatttgataagctttagggtatgtgtgtgtgttttgggggtttgtcaagatttgtaggctttgtcatttttatgcaatttggaaatattctagctattcggtctcttcccctgcctcctgcagtcccaggtactcgaatgggctgcttgctgtggactcatgggtccgtgagtctgctcatcttcttcagtttgcgtttcatttttggtagattctgtttccacgtcttcaagcccactgatcttttaagctgctgttaagctatggccattttctgtatgagccattgtgttttttcatctctataaatttggttttggtatttaaaaaaatgtcttccagctaggctggcggctcacacctgtgatcccaacactttgggaagttgaggcagggggattgcttgagcccaggagtttgagactagcctgggcaatacagtgagacctcatctttaaaaataattaaaaaggtcaggtgcggtggctcacgcctgtaatcccagcattttgggaggacagtggatcacaaggttaggagtttgagaccagcttggccaatatggtgaaaccctgtctctactaaaaatataaaaaattagctgggcacatgcctgttgtcccagttatttgagaggctaaagcaggagaatcgcttgaacctgggaggcggaggttgcagtgagccgagatcgcgccactgtactccagcctgggcgacagagcaagaatctgtcttaaaaaaaaaaaaaattagccaggtgtggtggcacatgcctgtagtcccagctgctcgggaggctgaggcgggaggatcacttgagcctgggagtttgaggctgcagcaagccgtgattgcactactgcattccagcctgggtgacagagtgacggtctcaaaaaaaaaaaaaaaaaaaaaagcacaccagtgtcttccatttctcttttaatcataatcatgctttaaaaaataccctcgagcatatggagcaaatttaagataattgttccttttctgctaattcattattactgtcatatctaggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaacatggtgagatttacattattaagtgtgaagttttgttaaggttcctttaaagaatattacgctttctggccggctgttaagccccatgtagattaatttggtctttttcaggtttgttttaagctcactagagtgaggctgaagtagcctttccttggatgatttagtccttcccaggtgtgaccctcctgctgtccctgcagaatcctgggtattcagaagtgtctgcacactggctggagggacgagggtgatttctgtgcaaggcgggaattgtttgtcttaccctccggaggattgttttttcctcaaaagctactctttggcgtcctggggttttacagaatgtgtaggttggtgttcatccgaagaccccaacgggacgctggtgtgtatttcctttcatctgtgcagctcccctcccctttgcgggtattctgtccccagttctagctgccttggccttacctataccagggaggccaagtggcccgctcgccccactccccttccagacagggtgcagacagggccctcccatctcctggacggcggcggcccctgtgcagaacttcatgggcacctggctgtctgggggcctcttccccagggagtctcctggtggtggccgtgttgcctcaggctcactgtgcactaggcaggtcacgtcaatgccacctgaggggcaggggttaccaccctgtggttcaggtgagaagcccgaggcccaggtgaggagtgtctggcagtccgtgcagtgtctggacagtatgccagcccctgcccggaggcccagcttctccagcccagcccacacccaccaggaaatgccccgattttactcccctggggcaaaggcccttggctggctgagcatcccctctcccagcactcggaggcacctgcagttgctcagctgttcattgagtgctgggagtggaaactcatacgctgagcggcagtgacgctgcggagctgacaaaccccacagcccgcccggtcacctgcttcaccgagggccacagcccccccggggtcaggtggccacaggggtcctggccatgtgggacatctgttctgtggccctgctcaggatggcacctggcggggactggccctggggtcgaggcatgggctcagccactgccctgcagggacacagccaggacctcttcccggcagagggactcccccactaatccccagaatactgaggggcacgctgggtgccaggctggcagggaccctggggattctgcagcgagctgaatggggtgggagttccttcttaaaatgtggagtctggaggccactcttggcgaagcgctggtgcccggggattctgcagtgagctgggcatggattcgtgaagctgctcatggtgaagcgctggggtgatggtggatgggccacagcgccactgtcacaaggaaggtgggtgacagcgagtgttccctgttcccttaccagcgagtgcctccctgggaacttgcccccaggctgtgctcttgggccatctccttcatcctcaccttcacagccacccctccttctcccaactgaggcacctgcagaggagaggggccccagacggggacagcagggcagaatcccagctcccagatccgggagaggggggattgggtgtggcggcagtttcgggggtagggggccaggtgggtgtgggacccaggggcgtggtttcaatcctccccccaggaccttgggaatggcctccaggagcctggcatggggaggccagggtcaccagctgaaccatctggaccagaattgcacagcagcgccctctcctctacagcaagacgtcacccaggggtccccacagaggaggcagggaagcttgagggtcccagaggagcgtggagcatgcaccatgctacgctataccacactacacacacgtgcaccatacacgtacatatgcatgtgccacacatcacacacgtgcacattccacaccatgcacacacacccaccacaccacacatgtacttacgcatgtaccacaccacatcacacgtgcgcactccgcaccatacatgtacatacacaggtacatcatgcactcacataccacacatccacatacacacatgtgccacaccacactaaactcacaccatacatgcacatatccacatacacacaggcacacaccacacagaacatgcacacaccatagaggcacccacacacaaccaatcacgtatgcacacactcgcaccatatatatgcacatacatagattcatacatcacacatcacagtacaccaccccacacaggcacttatgcaccatatgtgcacatacactcacaccacacatgcacaccaaacatcacatacacactcgcacaatatgtgcattgcgcacatacacaccacacattacactacacacaccacaccacatacgcacacatgtccactcatgcgcagacaccatacagatacaggtgcacacatataccacacacacattataccacgtactatgccacacacacaaaccatacatgcatacgcacaaataccataccatcccactcacactatacatgtacacatgcacacagacacaccataccacaaacacacgcacaccaccacatacagatacataccatcccacttacaccatacatgtacatacataccccacacatgcacacattcacacagcatcacagacaccacatacagctgtgcacacactgtaccactcacatcatacatgcacacacactacactatatagacaccatacacacacaccacatagatacgcatacacaaatacatcatactatttacacacatcatacatgcatagacaccatacacagacacaccacgcacactcatacacatacacacacacggtctggagatggagtcactgcagccagcaggggtggcgtgcagacaggagggcctaactcaggcaggcacagcaggtacacaggggcggccccctgggggcttgaggcggcccgggaaccctcctcctgcccagcccctcccatctgcccccctgggggcttgaggcggcccgggaaccctcctcctgcccagcccctcccatccacccccctgggggcttgtggccccagcctccttcccgtggcttcgaagcccctcgtcctcccaggccagccccatcctcacccacaggcgctcccagcactctgtgaggctctactcacggatggcaggcacttccccttactggtctcaaaggagaccctggagcagatggtcccgagaccccttcctgccagacacccctgggctggggccactccaggtcggggcatgcaagtgctgcccaccaaaaaaccaccgtggatgcagcggggcctctgcacatcacccctcggtgcactggaggcctcagcggtgctcctggctgagcatggggacttcactaccagtctgccctgggtcacgtatggaagcctcagccggaggcgtgggagctgaaggcccgacgcttcctgttctgctcagctcctccttggaggaagtggggtttgcaccacgatggcccttcacccctgccccctcctctctacacctgcactgatgtcagacagcaacctctcaagacaggtgggacacgccattcctcctgtgaggtcacagcgagaagtgcatcagcttgaaatgagaggcagctcttgggggcaggagtcagtggcagcaccaagcgacccacccaccacgtttgggggttggggacctccaaagcaggcaggggcttgcttccatcagatttgggggagggcaccattagggagaagaacacagaggccttgggagtgaaaactgaccttggaaagcaacaggaacaccttctgctaaggagcggaatgaaaaaccctggagagcaaattcctgagcaggagaatggagtggaggaagcagccaaggaggataaagagatgggaacaggaaagaaaacctgtaggatgagatgttgctatgttgctcaggctggcctccaactcttgggctcaagttatcctatctctgcctcccaaagttgttttttgagacagagtttcactcttgttgcccaggctggagtgcagtggtgcaatcttggctcactgcaacctcagcctctcaggttcgagattctcctgcctcagcctcctgaatagctagaattacaggtgtccaccacgcccggctatttttttgagtttttagtagagacggggtttaaccgtgttggacaagctggtcttgaactcctgacctcaagtgatccgcctgcctcggcctcccaaagtgttgggattacaggcgtgagccaccgtgcccggccttcattttgcctttaaaaaccactgcttggtagggcgtggtggctcacacctgtaatcccagcagtctgggaggctgaggcgggtgaggcgggtggatcacctgaggtcaggagtttgagaccagcctggccaacaggtgaaaccccatctctactaaaaatacaaaaatcagctggtcctggtggtgtgtgtagtcccagctacttgagaggctgaggcaggaggatcacttgaacttgggaggtggaggctgcagtgagccaagatcgtgccatttcactccagcctgggtgacagagagggactccatttcaaaaacaaatttgacagggaacagtcacacagtttagaaaggattatgcaaaccagaatcaatagtgacctgatgaaccgggctttctgacgattctaaaccacggaggctgaggggcccagctaaacaatgacagcacctcggggaagtgggtgagatgtgcagcgggctgtggaaggaggccagaaggaccagggccctagtccaggctgctggtgatgagaactaaacagggcgcagggcgacgagcaagtgctgtagtccgaggagcggcccctgggcgccagcgccatgggtggaggccgtccctcctaaggcgcagccggtgcatttgggaccgggggagcagatcccgtgcctccctggaccccggggtcttgggatcacccggccgcagaggcagaggcttcggctgcacagaaacctggggtggccgcagggaagcagcgccctcaggtgactggagagtgggtaagagaagccccaagaaggacctcgcccatccccgtaggcgtgggacggcacaggccgccaggacccccacgcacagcccagtctgcggggcgcgaccccaaggccagcagcagaggacaaggacggggccagggcaggggccggggttggcagagggcggagggtggggagggc

SEQ ID NO: 10843 - DNA, 35867 bp, Homo sapiens
  misc_feature (1)...(35867): n = A,T,C or G, or insertion/deletion polymorphism (see Tables 1-2)
tctcggaggcaatgcagcaacatgtatttaggctcagcaatctctcaattctataaagctgcaatccaaagagctgaatttgagatgtggacaaagatctatgcattcagatgttaatatttatttcatttactcattcatctatttactttgggcaggggttcacaggtgttcactgtattactttgctggcatacgtgaatatgtgttcttttgcatgcatcaaatgttacataattaaaagattttaaaacctgagctaaatatacacgttacatttctatagcacttccaaatcatttcatcctcgttatcttatttgatcatgaccttcctgtaagttgggtagggggagccttattctgggaaaatcatggacacgtggttcagcatgccacctttttccctgtcccttttctagaaaatctgatccacccttagaccttgaaaagtacagccccatgtagcacaggatctcccaccacaactgctggttagagtgaggctatctgcagcatcaaaactagaaccagccttacatatccaccagtaggaaagagtgacctccactttggaatgaaggattaacatgtagccagaaggcataatagttttgtttttgtttttgttttttgagatagagtttcactcttgtctcttgtcgcccaggccagagtgcaatggtgcaatctcggctcactgcaacctctgcctcccgggttcaagcgattctcctgcctcaacctcctgagtggctgggattacaggcgcccgccaccatgcccagctaattttttgtatttttagtagagacagggtttcaccatgttggccaagctggtcttgaactcctgagctcaggcaatccacccaccttggcctcccaaagtgctgggattacaggcgtgagccaccgctcccggccctggtaaatttttttaacagtgtagattaatgtagaatttgccccccaatgggtctgtaatttctttctcatttccttgtaatcccctagtactcgacctagaagacactcagacgtagttaagcaactgatatcctgagagagccctcggaaaatggagtgtgatttaagaataaaaaaacaagaaaaagaaaaaatttcacgtcaatttttctcttttcctactgctgcataaagcacagctctgttgcaaaataatatctaacatttaatttgataaacctgtgttggttgagcacttactatgtgccaagcactgagctatgtccttgagttgctacccaacgtgaaattcgagtctatccaattttctgacatctcgtctccacactggtgtccactaaactgttttccctactggttttgatgcatcactgaataatctcacttcctgggtgaaaaatactttacatttctctcttgacaactgtgtttcaatagccttccattgacctacatacctcaggtatgggcgtgtgtgtatctggcattttcctccttgctgggtgccaattttatgagacataatccacaaacagttcaaatacctacttacgcttaagaatctacctgtctatatatttccagaagcttcagtctctccccacccttatgtatattagtgctaatgaatatgagcattaaaactaatctgttcgtcacagactaacttctgattgtcacaaacaactgacagaatcatctttggcagtttgattcttttcaagaaaaaaacacgactgaaaacgattaagataaacttgagttaaaattcccccccaaacatactgatagacaaaaggtgcttaacctattgtaagattaacagcagtacaattaatagtaatagctcccatttactaagtgctttactttgtgctaggcactatgctactctcattatgaatatctaattttgacctcacaacagcccattttacagatgagtagactgacttcagaaagaagtatacggagctagggctccaatctcgggtctgtctctatccactaaatggcaatgtgtgatactaccaacactattttaaaaagttttcgattctacatgtagatagaactttttctatctatatactctaatatgtttgtttataaatatgcatatatatgaaattggtaaatttaccagagtacaattattctaataaacaacctcatagttctatagttaagatggacctgaactcattttgttgaaagtccctgctttttatctgaacagtgcctacaaaaaaaaaatctgtttgcattttactgaagcccctcagttcttaaggccttttctccacactgtccaggagagctcagaagagacacacttagggactcagtcgccatggcaactgccaagctgcagggcctccagctgggaggtgggcctggaaggttgtggaaaatacagaaggcagccccagggtggtttcaacagtttccccggcctaggccatcccaccaggaagcagaaggcaccctgaccagcgcccctgcagagatcaaccatggccagcctgggactgtttttcttctttttgaaggggttaatgggtaaaaggaaatggatcgctccatttatacttaagaaggacaagaagatcatttcttacggaagaaacgaagtacagaggaaccgtggccactgttgccctccactctctcgagggccttcccctcggccctccctcctccctgcagagccgcacttgcgcgaacttcccacttgggggttatgggaagggcctctgtggatgatgggaaagctccgcaggggataatgggaatgcctcgcgggggatgatgggagacccctgccagaggaatatggacagccccttttgatttttaagtagtgaaagaggatttcctctcattttccagtaaggaaaaacctcctgatgatgtcctcatctttctgcctctcatctccccaccactcccacgccccaggaaaggaggaaggtgggctgaacaagcattttgagggccttcagaattggaaagcgctgcttctggcatcaccaggcatttccaggtcactgtggggttaggagtcagggatcctggggctctgagtgaggcatcgacttggcttgatgaagtcctcctggggcttcctgggtgcacagagaggtgcccagagctccgactgcctcttggcagctgtggctctcagctggatctgggctgggatgcagcttctttctggaaggaggaatttagaatccagtccaggtgctgctgcaggagatgccgggaggcccatcctgttgttcaccccttcttgcctttggtgtcaattatttggataattgccaaacccacagtgtggtgaaattactatagattgactgaaagatttgggagggaagaccctggctaattcgtatgggatagaaatcaaattgtaaaccttaggatttaatagctatagctagacgtctagctgctaatgatgtgatccagaacagggtttgcttaaccatgtggtttgcttaagccactctctggtgtttgcaatccaaggcatttgaactagtggtcctctgcttggtagatggtttagtcactgccagaaaactatagttatttctttatatcacagatctgggaggcagtatagtgatgggcaacagttgctcttgggtcagctggcttgatttgaatcccactagctgtatgatcttgggtaaggatcttaactgctgtcgaccaaagttaaggctgttgaggcggaaattgataaaggcttattgaaagccaaatttgaagattgaatggggaagacacaccaacaaagttgggtgtgttccaaagtctgttacaagttgcagtgcttttataagaaagttgaggaatgggaaggggactcctcatattgcagttgtcttttttcattggagggacaatatagaggttacagtcattggctacagatgacaacatacaggctaaaatgttttctgcatatgcacaagacaatcagtgaaacgtcatgattcagaaacaaatcagtatccttttcagtgtcagtagtttacgtattaattagtacatcaacagtctgaggaactcatgatacgatttgagagattcacagtaagattgtttgctcaagtacaggatgtaaaacacgagtcataagaccttctccaggtagttaaaatatagtttattcttttaagtgtagggatgcatgacttaactcatgcctggcatggccttaggtcctgtttgtaagttggtatcttactgccacagcgtccattctgtcagtcttatgatctctattttaacattaatgcttgttagttgttgtgtctaaactgcacaagggtattagtgaggcatgttcgacctcccttcccatcatggctgagaacgcagtttttaaggtttctggggccctcttggccaagaggggtccattcagttggctgtggtggggcttaggaggttatttttagtttataaccccctataactccctttccttagatgttcaatggaggaatgatagtgaggatttaataagataactcataaaattcttaaaacagtgcccacacacagtgtcagaacttagtaaacactggttactgtcattgttaggacaaatttgaaagctaaatttctgacattttaaatgtaaaaaacgagtatttatttgcatatacttatgttaccattctagatttctaacatttaaaatgcttctggcattttattataaaaataggacatgcttaattgtagtaactgggtaactgccaatatgtagagaagaaaataataatcatctgttatccctaactccccacttttccccataagaaaagctgttaaattttggtgtttacaacatttttatctttgcatctaaaaaacgacataattttggaatctcgtgtgttgttgtaacttgtgtatttattcagtaagtaatatatttgggcctgatgatgggttatggttgtaacctttcatattagcattgggaagaatctctaggggatgtgtgctctggaagatcagcagcttattcaccgcgtggatttggcttctgggattctcccatcaagaccaaatcctatagttattcagtcactcctccccagctcctgcagcaacaacaaataacacagctttgcagtctgggatgatggcagaggaaatgggagatgtgaggggccttcggcaggcggagtgcgtcaggtaaagcagatttccaagcctgcacgtgtacatgcgtgtgcgtctgtgattgtgtgggtgtgtgacagtgtaggggagccaggagcgagaggagaggacggcgatcgtaggggacacctgagagtcagaggcccgagggggctgggactcatgtcgaggtcggggaaggatgtaaaacccggacggacatcactgtaggccgcacctgctgagaggccagagctgcctccttgagagtgaagttgtttacagacaagagaagagatcttggcggacacatcacagctagccgcgaatcccgaagggtcagcagagcctagaaaggtaagtgggggtgggcagcatccccggaggggcctgcgaggcctgggggcggaagggagcgggcagtgcccgcactgggcaggggtgaaaccctctcgagagttggcccggacgcgtttcccgcgtccttcctcttgagggcccagtacccaggtggctcctcgttgtggcgtcacagaacagccgacaaaagtgatggatttcaggggccagcgacggcgaggtccaggtcagagagccggtgggcagccaggcacagaacccgctcaggccctgcccagtccccgccccctcgcttcccgagcagtgattggccgaagcggcccctcgttgctatgacggcaccagagtgctgccactggctccacctcgtcccttccgccccgcccctccgtattcccgggcggtgattggtcgaggtgcccttcccgttgctatgacagtacgcaaaggctgccagtggctcctcccgcttcgtccgcgtcgcctgtccccgctccccatcttccgggctgggagggaggcgggaccggccgcgtctccatggcgacgcgggacgcggcggtggaggcggttgctacccacytgctagaggcgctgcggctgtgatccaggctggggcgagaccatgtcggacctgggctcggaggagttggaggaggagggagagaatgatattggggtgagagctcctggtgagaaagggcttcccagggtgcgcagcggcgggggaacctcgaggttgggtttggagagtgaggaggcgcagaaaccagaggtctgagccacagctccccaggatccccggcagggacgaaggccacgccagacacacctgcgtgcgtcctggaagttgatggtgaaaagtgaaacgctgtgacgtctggttaccacatgccgcctcgttcttcccccacccccatcctgcctcccattaaaggcaaagatttcccagcggaaggctttggaagtttcctcctccctgtgttaattcccatcgaggcagttttctcggatgagcagatcatcccacgctgccatactgcccttgaataagtcatttctgtagctgagatttgctcccccggcatttagatgcatggaggatagttgcttcctggcagcctccaagaaatgctgaggaggccctgggctcaggagagggttcctgaagatattaccttataggcgtatcctcacatgtgctttcttcagtccccatctgaactgacccaggtctttggagttatttcctgagttaggcagcagagaggagaaagagggcacatccagcctgtgagctgggttctgtgtgggaatatttctatcacccagagagtagttcctccctactccagagagtgacctctccatggctgacagatagggaacctcagccactatggtctgcatgcacagtacagagttgaggtactttcagaattaactgaaaaatctagcgactctgcagtggtgctgtcagtgcctgcccagacctttttgctagctctgggcactcatctcccagcttccgcctgatttgctactcaagctatcacctctgtgcgctggaactacctgcccagtatggagagccagaagtgcctgaaattcacatccggccagacagccagtagctagtgcaagaagcaggacaaagtctgcagtgcgattgatgcccccagagtccctgttggattaggccaagtctgggacttcacctgcaaaggcatccttccttagctgcctgccctttcatgtctacttccctgccctctttactactttctcccaggagagcacttaaaaaaatcaggccaggcgcggtggctcacacctgtaatcccagcactttgggaggccgaggtgggcagattgcctgagctcaggagtttgagaccagcctgggcaacacggtgaaaccctgtctctactaaaatacaaaaaattagccgggcatggtggcgggcacctgtaatcccagctactcgggaggctgaggcaggagaatggcttgaacccgggaggcagaggttgcagtgagccgagatcacgccactgcactccagcctgggcaacagagcgactctgtctcaaaaaaaaaaaaaaatcacttgttcagggtctgtttctaggtgaacccaacctgcaacacttgaccagcaagatttctagtttgtctcctcaaatggccccactgatttgtaactttttagtgcctataatttttaggttcagatcacatttggggtcattttaaaggatttctgtcttattcagccaccccagcggctcagtgttgggtgtattgggaagcctcttggatagaaggaggggacttttgtacattttgatgtaaactaaccctgaaacaaatctgtgaggtcgcagatttttaccttatattctaggcaggaattagtggtccaaacagtgctagaaaagggcaagaattgcacagacgtttatttctgaagtcctcaatgtagtgtgtcagtacttgtgttataataagtctatatacatccaattcaatttcttaattttaatttttaataaattttattatgtatatttaagaaatacagtgtgatgttatgagatacccatgttaaatcattactggatgctttcagcattttattatttactatattcactctatacccatgtattaggtgctaaggaacatttattttctgaaggataggaaaattgcaagctttgatcacattttttatttatttacttttaagatagacacataattgagcaggcatggtggctcatacctgtaattccagcactttgggaggccaaggatcgcttgagtccaggactttgagaccagccagggcaatatagtgagaccttgtctctacaaaaaaattttraaattagctgggaatggtggcgcatgcctatagtctcagctactcaggagtctgaggtggaaggatcactggagcctgggaggcggaggttgcagtgagctgagattgtgccactgcactctagccttggcaacagagtgaggccctgtctcaaaaacaaaaacaaaccacagatagatacataattattgcagcattgggtcatgagtgttcgaaccttaagtctcttgctaggggtcttaaaaataagataaacttaatcagcaagggagccctgtgtactcctcagtgccctccaacctgtcccttccatcggaaattccttgcagggcaaaggtctcttcaggccacaccccgccccagggatcatttgagggaagagttgcttctctctgggcatttgcctttgaaatcctggattactgaaggaagcaaacggggaggtatttgtgtggacttgaactgttctacccgcatgtactatttcaagcatgttcctactaagaacacagcttagagtatctagcatttttcacaaattggttaaccttgcttacagggtaaaggattatcacaatgaattgcaagctctgtgttggagggagggaangaggcttccgccctggacatgtgctggggtgtggccttggtccagtgcctyatctagcccaggcgttgttacctacctcaactttaaggtgggaaaggtgggacaattgagtatagtgccgggggtttagcatagtgggatgactcaagggtatgatatttacaaaatgcttagcacctggttagcgcttaatgaatggtagctgtaattgtgtcaattttcattacccaggaatatgaggggggtcggaatgaggcaggcgaaaggcacggacgtgggagggcacggctacccaacggggacacctacgaagggagctacgaattcggtaaaagacatggccaggtcagaaccgttgacttgactggatggttttctctatttaatactctgttagcaaatgctacattcagcaatgatatgaatgatataatcaatgtgtttcaggggatctacaaatttaaaaatggtgctcgatatatcggagaatatgttagaaataaaaagcacggtcaaggcacttttatatatccagatggatccagatatgaaggtaaaatgttatcactaagcagattttcgtgttacagaagtttttctttctttatgactgaacttgtctgtgaatactgacatgtatgagaaagcttaaagttctccagttactcattcaacgaacacagatcgtgttactatattcacagtgttgatgcagaaataggaaagccttgtaattaattaactcactaatgaatctgtagtgggaaatctgtccctgtggccagcatgtccatgtcctgggagcagacaaaagggaggctcctgagtggacgcaggcctcgcagctggtggacccacggcttcagctgctctgcggcattcatcttcctgaacctgtctttgcattttccatttctgaccaaccccgccatctgacggatgtgttatttcttcagatcgagtgtttccttacatcagggcttcctgtctgggagtcttcctgccttgttaaactgacttttcctacctgtgccataagtccttacaggccaatgttatgtttgaggaggattctttttcctttatttccaagaacctccctgccgccccttgtgccgttgtcacctggtgtgaccacattagtgatatcccaaacctgggcagggggaccggcagggagcgtgttgtgagtcttcagaaagtgtatataaaattctgtgttctgggctttttgttttttccctaggaagaaagaaattgtctagttttcttcagatttccaaaaagatctgtgaccctaaccttggactctggtgacaataggtgtgagcttgcataggtgacttcacatctccttgcctcagtttctcatctgtagcatgaagattcaatggataaacacagggagacacctgcaaccttgcctgatccatagtgagcactcagtaactggggctaggactgtgatgtaccacttgtgacagcatcacttcttagtgaggaggacatattcttacaaagtgcgagctatagttgcttgctttgctcctagataaaataagaaccagtaggtgrttcttattttaatagatgtcagtgatgattctgtccaattctragaccaagatggagggttttaataccatccctgttagatagaaattgttttgttttgtttcataaatcccagaaggcttgctctataagaagcaccatctgctttttaaatcaactttaaacaatttaatttggggcttaatttaattctttccaaatccttatgcacctaatctcattcttgtyacttttgattttagtgtagatgttgatacaatttgaacaacacacacacacacgaagatatttaggataagggatttaaggaattttgaatatgaaggttaaaaatgggtaactgtttctctgacaccaaatgcatggattttccatgctatgtacttctccagtcttctgtgaacaccaactgagtttccaatgatgcaactccattctgacaccacccagagttagcacagaccccacaggttaagggctcagtttccaagactgccccacttcagatgtcaacctcaagttgtggatccggagggtacccacagttctacctgactcggctacaaattgggggttcctacaacaccctactcaggtttgataatgtgccatagcggctcataggactcaggaaagcactttactcatgtttactgtaaaggatattataaagaatatggatgaacagccagattcagaggtacagagggcaaggcctggaaggttcccaagcacaggagcttctgtccttgtggaggtggagtgcaccaccctcctggcacatgatatgtttatcaccccagaagctcaacaaatcttgctcaagagtttttacagagcttaatctctggccccttccttcttctttaccagagttggtgggtggggctggaggttctatccttcttatcacttggtctttctggtgttcagtcccatcttgaggccatcctgggcctcatttgcataagttcaggtgtggtcaaaagagtctcattttgaataacaaaaacatttctatcagtcaggaaatgtcaagggttttaggagctctgtgctgggaaccatgaataaagaccaatatttcttattatgccacactaacatataaagctcttctggtaacagttgggatttttgattctccagatggctttgtatcttaaagggtgcaagatttagccactacccagagatttcttctctgacaaaagcttaaataagtgtcttacttcatgaaggcagcaatggaaactgaggtcagaagttataatattaattataacatagtaagccaatactcttccaatcacaaaatctcagttaatgtatggctgagttattcataacagtgtatcttggctggctgccatcacaatgggccagaatggttttgtgcagggcagtgtgttcaacgtcaggaccctgtggcataaagtccagtaccctacctgtctcccagatggtcacacaagtccaattagggagtccaggagccagcagaggctatagtgctgcaggagaggagtggggagacggtcctgggtggcgggtgacttggatacaggcaggaaggccgaggtttttaggggtagtgggggatgagatggaggggagggtgggtgccagatgtgggggaggcctagaccccatgtactgatgctgagggttgggggtgtagggccaactgaggactctgaggttaagggggagaaagagcatccctattccctgctggccttgttgcctgtcaaacagaactcatcaaaacaaagaagtttaagaatgacattgtggagaaagaagaatgacatgataacttgaacctgggttttttggaagcccccgaatggcaggagctggaaaaaatgagcacttgactgttgggatgcttgtggagaagagagcatggtgttagacagactccaattttcatttcagtcttgctacccaccagctgtgggaccttggggaatgcatgcagtctctctgcttttcaggttctgcatctgtaaaaccatatttcagcgattacacataccaaatgctgtggcaagtgcacggaaccctgcccagggtctgacaccgagtgtttccccataagtgtgggctccttctctcctgtgtttggctgacccagcagtttagggagccaacttggcaagaccatgggccagcatggcaaaccagtgaccaaccagcatttgaggggggaggagcatcttggagagcttctcattttaaattgtcttcaatcccaagtgccagacaaactgctctacccaaggagcacctgctccacaccagccaactgacccacaaccagccaatcaaacagccaaccaatcaaccaaccagccaactgactagccaaccaagcaaccaatcaaccaaccaattaaccaaccaactgtctaaccaaccaaccaattagccaaccagccaaccaaccaaccaaccaaccaaccagccaaccagccaaccaaacagctaaccaatcaacaaaccagtcaactgactagccaaccaaccaaacaaccaaygaaccagccaaccaaacagccaaccaatcaaccaaccagccaactgactagccaaccacccagccaaccagttaaccaaccaaccagccagccaaccaaccaaccaaccaatcggttagccaactaaccaaccagccaaccagccaaccaaccaaccaaccagttaaccaacaaatmaaccaaccaaccaaccaaccaaccaactgggagttactcctgagaagaaatatagttggaaaaaacctcagttgacaagttcaagaatgatcagaaagtataggattggggtagaaagactttaaaaaaaaaattaagtgcaaatttaaagccacaataataaagtttacaaatgtcactcacctcaaaaaaggaaacttgacttatagctgttagagatgtgcctcagcaggtgacttttctctgaattaccttctctatttgtgcagggtccctgtggtggcattacaaaatgctgggccgagcctcttaacaggttttttaagtagattgggactttaaaaaattttgctcaccgtcctcttggtgcaaaatttagtgtcttttgcaacttaactgttctcttttatttttgaaatttttctgcaaaatatgtaatatatttttctcaccatgacaccctggagatcctctgacatggccaagagaggagggatgtaataattttgtcatgaagttttgttgggaagaaaccaaatgatgtacctgtttcagctgaggtctctatgccccagggctgtgctggaaccccctcatagtagctcacaaaaacccattctgtgcatctcttcccagctccatgtgtagcttgaaattggccgcggtgtgagtatttacaccacagaacctggcaaatgttacaaatccaggcacatcactgccccttaagacccagacaaatccctctaggtatttgcacatcctcatggttaatttaggttcagggacctgaagtattttttactgaattatctcaatttggggatcttcatctctcttgttcacattgttcctgtcacacatcacatcatgggacctagtcctcttccttaattgttagcagttgccaccttccctctctccatgaatttttggtaagcctgctcttttctgaatgacttacccactttttgaaattgtgccatgcagcttttcgtgctgccttccctgtcctcagctgctgctcaggtgccaaccttccatcctcaggctggtgctcgygccctggggacatgcactgtcctttgtacagctcttcgttcatctcacaaagtgcccaggacattgtaggtgctgagtaaataatgggatgattgaggaaataaatatgtagaagttccttctgcagataaattttggggttattcacataaacaaatattacttgaataattagcattttcttagcctattgggtattctttatcttcatgtggaagtgggtccagtttttgtgtaagccagaagcttatgtaagttttgagaacctctttaaaaaaaagaaaatataaagttggtataaaagtgaattttcatttgcaatgataaatcaaaataagttaaaaatttaaaaataccacaaacatcacagaatctaagtagcctgagttttaatgtctgacatacttctagaatagcttttctctacctttgttagctaatactctttgaatgcttctccatatggcaaccattttgtaatgttttctatagagagaatagaaatataattccttcttttctctttgatcaacaaattgatcaacatttgctttttattattcatagtctcaaaacatatcatttagcttaatgacttggtgtaatatgcacgtttttaagagcagtcacctttgggagacctctattaagtttctttcctaagtgagctgtaagatttgaggacgttttgagttttctagtgcagggattcatactgtggttgacaaaagtagtttgcagttgtccacatcatggagtggtattatgaattttatgatatccttgccaatttcagtactgcctaccaagcctataaggacttagcagaagccgtatggaggtgaggaggtgagggaagagttcaaacagaggcatggcaccagcggatggagctggtgtgcagctggggttagagtggcatgttggagtcagatgattgggtgggagatagactgaaatgctgccaggtggctgaggatagatggtcaagccctggagttgttgctggatctctaaacatttgcaaggtaaatgaagtgtggtgttaggatcactggcaatgggtcagacaaccttggtttgtctccctcctcgttgcatcttcgtggtgcctctgactaacctgtgaaatgtgcttgtcagtacatgcaggtggctgtggcccacatccatacacctcactctgtaccccgtgaactcctgactcagccctctcttagcccactgtccaccgtggctcagcacctatgccatctggcacaaaaggaaggggtggagggatgtcagagtggaaacagatagcagccttggtcggtgctgttaaaaatctctcttctgcaggatttcctgagcagaaggggcctgtgtgtgcatgggcttcatttgcttcacaacacatctgcctttgccatggttaacaatttgaagacatggtacagggcatcgatcccttcttctcacctgggcttgcctttgtgttgttcctttcaggagagtgggcaaatgacctgcggcacggccatggcgtatactactacatcaataatgacacctacactggagagtggtttgctcatcaaaggttcggtttctatcttgggtcttaacgggatttgcttatgtaatgagaacatgatgtctgcagattgtttacacttactgaggaacagaatcataacaaaagcccagttaccaactctgccaggcaggtscaatctttctatggctttgaggcaaggatgcctttctgtgcaagtgtagactcaagtatctgacatctgcacctcagttggggcagagcacgtgagtctttcacccaagagtcccagggagtggagggcacagaagagccactgggggacctgagccacagctcccactagctctgcctcttccctggggaaagcagctgacacacaggaggcttgcctctgtccagctggcctgtcctctgtgcctctggcaatgtcctgtgcttggggcacactgagcaaggggcaccttctgactggacacagatatagaagctacatcgcttgtgagcctgcaacagcctgggcctccctcaatgtcaatgtctgtgttttaaacctgggagatttttcactgtgctggaacgaaataccatgttccccttgtcttaaccaggcatgggcaaggcacctatttatacgcrgagacgggcagtaagtatgttggcacctgggtgaacggacagcaggagggcacggccgagctcattcacctgaaccacaggtaccagggcaagttcttgaacaaaaatgtaagtccatgggaagtgacatttgccaatgaagtacaaaataaccccctctggcagcctgtgcaaatgtgtgaccagagaataccaaaaactcagagaaaactgagtccggcctattcaaatgtggagaacaggacagctgtgccattctctgagcctctggtacccacagagcacagaattgggggaagggagggattggcccgtttctctggatctcagtacaaattcccactgtctttcagcggggacctgttgcattgttatataacacgagagggcatctgaacctcttgtgtgtattccttctcatgggtaaatcagataccaaatatctatttcctgcaattgagcatagaggtgtttgggttttgtttccctggaaggggaggtgcgacatccctggggaggaagacccccagctccctcctcatgctacaggccagcctgcgtgctcctagttgtggtgggaattaaggctgccaagggcctggccctgcgtctggaggcttgccagcttctagcacccatggtgggccgtttctgtttggaagactcggtggttcctcttgcccttattgtacagagaaaccttgaataattcagaagctaatactcaggccatcgtggtagctttgatcaggggttgagcagaaactttccctgaagagagaatttgcggagcaaattgatggtgttagaagttgacagagggaatgtttagctgatacaacgaagtctcttcagactctcttagaacccagttttcatttacgtataattcatgccctaaccacagattttacttttagtrttcatcaaaacagcacattcccctcaaacccatacattgtttatataattcccagcaaactttctgtgggtctttttggaggagatgggaaggtggttgcagaggaagagaatttgatgaaaatgaatctggaagaatcaatcagcttgtccagcctaaaccagtctgaaaaatcggggtaaaaatggaggctttgttttgctagttagtaaaaaactttaaattatacaaataatacacaagtacattccaattgtaaagcatttaaacactaggatcctgccccaccaccctgggcccaatccttccacactatttctgtgtgtcatgtaagcacattctaatacagtcatctgacacagaattattgtttgggggttttaattacataattaggatcatactgtgtcaggatacaaaaatatacataaagatacatatttgtcattttgcacatttgggactattgtgtaggttagataatggaattgtgaaacctttgaggattggcatttagaatcacaatcggtagtgcccattttcctaaaaagtggtgtcagtttatactcttgccaatagaatatgagtctgtttatcatatattctcatcgatgttggatattctcagtctttaatgttgtttttgttcttttccaatcttatgggtaaaaaatgtcatctcattgttttaatgtgtacttccctgattactagtgaggtcaaacatcttgtcacatgtttattgctggtttgtgtttcttcctcagaaaattccctgtacatgtccttgtggacaagttatcaataccacaaaacttcaataattaaaacagtgtgataccaggatacacacacacacacacaccaatgaagcaaattaggaagtccagagacagttcccagtatataaaataatttcacacacaataagcgtgtcaaattaacaaagggatgatgggaggagtcaagacatagtgctaggaacacttgacaattatttgggaggaaaataatagttttgccttcacacagatgaagatactttctagaagaagtaaagatttaaatgtaccctaggaaatatagaaaaaaaatgtagatgaatattaaccttgaaatgaggaaagagaactttctaaacagaaatagaaaggaaaaaccaataggtttagctttataaaaataacttcttatagattagaaaatgctgtaaagaaaatctaagagatgactgttaaatggggagagaatatttgcaacatttaatatataaagtgttttatcaatcaatgtgatttaaatggctaaaaatcttgaaaaaaatgcaggcttactaacaactgaaatgaagtgaattaaaattgtgagaccctgttgttttatataaaaaaacatgtaaaaatagaccatttttacactcctaaaatcaagagtttgaggatctgggactcttaagtgcagttatgggaatgaaacgattagagcctcatctaatcaaagcacatgtatgcttttgtccagaaattctgagaatttaaggatggtatcaaaagcgtacataaagttttaactcagagtacgtttgctggagcgttctttgtaaaaaaaaaaaaaaaatcagtatcccaaataccaacaatagtaactgagtaaaataggttgcaatccatagatgaaataaagtaccaggtggcaactgttattaggaaagaatatttgtaaatacgggaagtagttcatgccatatttctcagtaaaaatagagtatgagttagtatgtataattatgatcagatttttatttaaccatgtatactagaagcaaagttacaaagaatgcatcaaaatattagtagtagttccatcggtagctagtttgcctatggatactgattcactgaggttttctgaaaatgaatacatcacttttataaaaaagtaaaatgtggttaaagtttccaaaagtaaacaaaacagggcatataagttccaatcccatcagccacgagttcacaaaagcattccttaatccatgttacactttacccaatttggtgatttgaggtgggtattgtggtggtgacatttgtattttgtattttctgctgggtgttgacacttaagaatggtttctctttgctcgtagcctgttggccctggaaagtatgtatttgatgttgggtgtgaacaacatggtgaatatcgtttaacagatatggtaagttgcggagcatgtagggttttgttacattaacagggaagtagctgctcaaaaatattgatcctgcaaggttggaggtgattcgcctaaaagttatgccaactcttaggcactttcacattttcattttccttatctgcatgtgttagtacagaactaaattgccagaagcaaacaatatcatttcccatttattgcagaactctagactttgttgatagataccgtttttgttgatagaaactaatcctggcagggcacaatggctcacgcctgtaatcccagcactttgggaggccgaagcggtggattgctttaggtcaggagtttgagaccagactggccaacgtgatgaatccctgtctccgctaaaaatacaaaaattagctgggcatggtggcgcatgcctgtaatcccagctactcaggaggctgaggcaggagaatcgcttaaacctgggcggcggagtttgcagtgagccaagatcacgccactgcactccagcctgggcgacagagtgagactctgtctcaaaaacaaacaaacaaacaaccaataaataaaaaactaatcctgagtgggagggttctagacagtgttaggtcctgcaagtgaaaactgaatctgtaactggtgttgccacagtttgtccagtgactgttagcttgtccgttgtgcagcatgctcctctgaacgtgccgttggtaagtctttctcttgttttttcctttccaatatctaacattaatattaacactacattgacattccctggttaatagtaaagctagtcagctaatattgccgttataaggcatcgagatgcgtatgtgtgttgaggtgggaatatatgtgttcctattcctctcattattaatgtctgatcaatccctctagataattagcaattcagcaacatttcctgaccctggtactggttttgatccttttgacttatttgtttagrtgaggtcattctcactgtaagaagttttgagttttaaggaggagtgtggaatcacgcttttgtttgttttttggtctctgaagttgttgaggtgtcccctcctagtgagttaagaatatattatcgtacacaaactctcccatgtctgcatactttctttctgaagaaagccggggaacggcttgtttgggtctaccatcacatcaatgccctttcaacctgggttagtcctttttgtgctgctataaaggaattcctgaagctgggtagattataaagaagagaggtttatttggttcacagttctgcaggctgtacaagaagcatggcacccgcaactgcctggcctctggtgaggtctcaggaagcttccactcatgatggaaggtgaaggggagctggtaccatagctcaaaagaggaggaaaagaggggaggaggtgccaggtatatatatatatatttttaacaaccagttcttgtgtgaactaatagagcaagaactcactcatcaccacagggaaggcaccaaaccattcatgagggatctgcccccgtgacccaaacacctcccaccaggccccacctccaaccccgggggtcacatttcaacatgcgatttgaaggggacaaacacccaaactatgtcacaacctgagccaagtcacctcgttttgtttttttgttgctgtgtccctcgtcaagcccttggcatcacccagaggccctgctttaaaccgactcctcgtcaccttgggctcaggtgtgaggctgtggaaagctatccttggtcacaggaggtagaagccacactgtggggagcttggaaggctgcgggagatcctgtgcatgagggcctgtcccgcacctgctctgtgccgcccactgctgtctctacctaatgctccatcctttcaccccaagggccctggccttgaatcctaagtctaaactcatcactaatttttcaattcaatgctcttcaatgctctccagacaggttttttttttttttttttttttttttgagatggagtttcgctcttgttgcccaggctggagtgcaatggcgtgatctcggctcamcgcaaactccacctcccgggttcaagcgattctcctgtctcagcctcccgagtagctgggattacaggcatgtgccaccacgcccagctaattttgtatttttagtagagacggggtttctccatattggtcaggctggtctcaaactttcgacctcagatgatccactgcctcagcctcccaaagtggtgggactataggcgtaagccactgcgcccagccctccagacagttttttaacttttctcatttttcttcctagagtttgttagattctaaaaccaaagggagtctttgaatctttatcccttaacctcccatgatcaagtgactgtccgtgctccgttgctgcttcccaagtggccacagtctggacatccccggggctctcggccctgacctcagccaccctcttttcctgattcccgctcctgtgatattctactttctgcacatcactctggccatggttatttagtttccccaaacagcccatggttgctcatggtccaccttcttggctgaccagaatcctgtgtggcctcacagtgatctgtcttccttgcctcttctcctgctttgctccagctaaaaggaaccactggctaggggcaggtccctagaaaaccagaaaatgaaatggccaaaatgcttgattttgttgctaagtaagaggccctacctcctctgagcacgaattcttcatggaccgcagggtgctctagtctgggtggaaggcagcttcctgtaagtcacctgcatctaacaaaacgtagaggaatttgacatactgtcctcccccgaggttccacttcatttakgtgtgtgtgtgtgtgtgtgtgtgtgtgtgtgtgtaacctcctacacacatagtcagaagcctaagaaagacagtcggctttaggatttgattgtgacagggaggtatttagtattttgctgggatttccatggggttggacacctctcatctgttccctgaaggaacctattggttaaattgatatcttgtcagcactggtaataactgtttagggttactggtgattgagcaagtttttacatttgtgtagtgataaaaataaagcccatcttattaagtgctttgcagctttagactctactggaaaaagttcctagaagtcagtatttcaggatgatgagaagaaggtagaaggagcatcagtaacatctaagagagaattactgatataagccccaagtcctgttgctgtttaggaaaaaccacccatgaaataatgcagcaacaacctgagggctttgtggaaggcctcccactgtgctgtggggatggattaggatggtggtggaacagaagggcctccgtgttctctctccctagtaaggggaatgtatcccttctagagtagggcttgccaagctgcagcccacggctcactccctgtttctttttaaattatggttttatatgtacgtttatagagtttgaaatttgccattttaaagcatgctttcagtggcattcagtacgttcagtgttgtgcagctgtgagaatgatgcatttctggagcttgtccgttatcccagacagaaactctgtacctattaagcaacaactccccattcgacctcccccagcccctgatagcttttaatctactttctttctctatgaatttgcctattctagatgtcgcatatagatgaattcattctgtatttgtccttttgtgtctggcttctttcatttagcacgacgttttcaaggttcttgcttatccatttgtctgttgatggacaattgagttgcttccacattttagctattatgaataatgctgcagtgaacattggtgtgcaagcatctggtcgaatctctgttttcagttcctttggttatataccgaggagtggaattgctgggtcatatggtgatgctgtttcgctttttgaagaactgtcaaatgttttctacagtagctgcagcattttacgttcccaccagcaatgtgaaagggttccacctcttggttttatacataaagtggcgtgcagttcccaaactagtgctgtcagcttcacctgggaatctgttaggaatgcagcttattggacgctatcccagacctgccgaatctgaaactctgggggtggggctagcaatctgtcttttaatgctttctgggtgattctgatctaagtcaagtttgaggaccctgtcctgcagcattggtgtcacccttcatgggtggccatattcaaacactctgagaccaaaatagagagtaattgatttcccagtgactcagtggaagaggcaggtgtctgcccctctctgtcatcggtattatcacctatgtggcagcgaagtgttccatagtcatagtgctgatgctcagatctttggaattttgtgatagtcacaaaactgagaagtaggcaaatatgcttggcaaaattggcacatgttggctgctcaccattgtcggaattgtacattttttattacaaagtgttccatgttcagacttgatgaactctcattctgctttccttgaattttatttttccccataatccttgacacttgagctttygcgtttatgcaaatccatatcatatggacatcttaggaacttcttaggcctaagcctaaaacaaatggctgtttcttttattatttatataaagaataatataaataattatgtttctactaagctcaatagacatataattatataatacacgattttttatattagagttgcaaaatgtggccgaacaattgaaaagaccacttactcctggtcactcagttctggccacttagtcctggccatgtcttagctattgcaggcgactgcgacatgctcatctgaaagccttttgtggcacccattataaagctcgctggcccagcattgctctggagaccttattcctcaccctggctctttcaagatccattctcaaccctgagattataccatggatagtcagcaactggtctgattcctgagtgacgtcctaaaaaggctgaaacacaagccaaaacctgtctttcaaaacttgtccttcctccctcacttttaatattccagaccaagatgacacaaatgttggtaaatgtacatttttgcacttaaaataggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgtggggcacccccgggctgtggggtggagggggcagagggtgtggggcacccccgggctgtgggacagagggtgtggggcatccccgggctgtggggtggaggggtcagagggtgtggggcatccccgggctgtggggtggagggggcagagggtgtggggcatccccgggctgtggagtggagggggcagagggtgtggggcatccccgggctgtggggtggagggggcagagggtgtggggcacccccgggctgtgggacagagggtgtggggcatcccccgggctgtgggacagagggtgtggggcatccccaggctgtgggatggagggtgtgggcgcctttgggctgtgggagttgtggacatcctgttttcaggccaggtgtggttggactctctgaaaatcagatgctgggtcagttgagtgtgcgggatgttattagggagagcctttgggattggaggacactcccggagagcggaggggagaggaaagaaacagagttgattggacagaggcggaggtgtggcctccacaaccttgcttcattccatggggagcactgtggcgtctcggggacccttatcccctcacctaggtcagtgagtgaatgtgggtgtgaccccgggctggcactgacagcagctgaggggacagcccttccctgaagaagggtccgtgtggcacctccatgtccaacccagtggtctttctggaagtccttaatgtgctggggaaagttgaaggtggctaccccgggtgagatcccttccatggcaagcggaggaaagccaactccgattggcctccgtgaaagaatactcatgctgctaagaatttcttggctcatgtgactgggaagctccgggacagcccccagaatggccgggcagcctctgccctctgtcccagctctcctctctgctggctcccctggctggcactctcaggaaccccaggggacttctctttctcaagagtctcatcaacaccctcaggaatgaaagttatcagactacctgctcccatccccaagccactgactacagtggggactgggctgctcccctggccaggcctaggctgggctgggtggatgttgagatggggaacatgaggtgctgccagtgggagggggagggtgggggcacggcagcccaggggacagctgccctgcacaggtctgcaggctccatttttcccaggaactcaggcttctgacttgtgttttatctcaggtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggtgaggtccctgcgcagggaagtggggcgagggcccgcacttaggggccacgaacagtgggattccccttcccttcaccaaggcctgccttcagctgggccccagggactcgaggaaggcttagggggccccctgtgagcgctcactggagccatctcagaacgttgctccctggcaggccctcctgcaagcctggctgcagtgggagaggcctgggtgtgcagcggtgcccatgcgcgttgtcacaggaggaccgaccccaggctggagagccctgtcagacatgcagagcctggctttcttctgttgcatgattttttttttttttttgagatggagtcttgctgtgtcacccaggctggagtacagtggtgcgatcttggctcactgcaacctccacctcactggttcaagcaattcccctgcctcagcatcccaagtagctgggattacaggtgcatgccaccatgcccggctaatttttttgtatttttagtagaggtgggtttcaccgtgttggacagactggtctcaaactcctgacctcacacaggaggcccgcctcggcctcccaaagtgctgggatttgcatgatttttagcagggctgactaacaggagtatggtttcagactagtggtgtcgggaactagctctttttcaatgggtttggatgtaagattaatctagaaacttctgcctctgccagctcatagggcagggatttgacctcagttctgactgactgaagcctcaggctcctggaatctttaaaaatctttccccaagtgcttgtgggcacttgcagaaagtctggagagaggactcgcttcccttaacgcacttttcacatctgactgaaagagggtgtcgtgcttgtgagggaaagggccatctgggaacagcctgggcacggcggcctcaggcacggggtctgcagtcccattccacttagtttgtctctgttgtaaattaagaatatacttcccattcctttgaaaataatacctgaaataatgaaatcacataaagcagttttctcttagatgcttgaagcacacatagactttcgtgatcggtaattcccctgagcgctggcatagactttcgtgatcggtaattcccctgagcgctgtagcaatgcacccagtgacgcagtgctgaggtgggacgtggggtcaggtggaaacctggctttacaagtgagcatcgtctctgcttctctgacttgcacagggagggtggatagagtgagccctggtaggtagggagtccacaggattctgttaggactgagtggctagagtatgcacagtgttacagcagcatctagctgtgcccacagatgtcagtccttagtcactgtggagcacagctggagggggagacactgggtttgataggcagtgtgggagtgaggggctgggctctcgccctctagcacctaatgggaagctggaataaaggaatcagtgagttccctgcagtgacagggacgtgttaccatgtacccaggagaggtgatgactcacctggggcaggaccaggaaactctgggttagctgggagggaggtggcaaggaatgggtgaaaccaggaaggaaattccaggcagagagcagagtctgacagcagaagagtgtgggggtggggaggtggcccctttcccttggaaccagatggcctttgaacttgatcctgagcccagtaggcgggacctctgggagctgtggggattgcctgtatcaggcttgctctctgagcttctctggggcaatgaggatgggtgccctggagccaggcaaggcaggaggccccagaaacttggtgggggagataacggaggggatggagcaggaggaatcctgaaaaccggactgggagagatggggccgagtggacgatgcccagtaccagcgggcgtctgagactgtgggttcatgcaccagccttggacagagggaacacccccttaactcagtggttttggggctccaggggacatttggcaatgtctggagacttgggaggctggtgagggaggtgctgctggcatcttcctgggtggaggccggggacggtgctgaataccctgcagggcacagaacagcccccagcaaagggtcacccaggccacagtgtcaggrgggccctaagtgaaaagggagtaatacaaaataggcttagtcggcagaacatttaycaaaataatgcaagttcagcatgtattcatcatgaatcccacattacattggagatttaccctgctaatttcttctttaatatacccaacagtgaaagttatagagtttaattaataataaaaaatagctctacctttcacaaaacatttaaatatagcgtcttataagaatgtggcaaatttctgctttttttttttttttttttaagatggaatcttgctctgttgctcaggctgaagtgcaatggcgtgacctcggctcactgaaacctctgccacggggttcaagcgattctcttgcctcagcctcccaagtaactgggttgacaggcatgtaccaccatgcccagctaatttttgtatttttagttgagacggggtttcaccatgttggccgggctggtctcraactcctgacctcaagtgatccgcctgccttggcctcccaaagtgctgggattacaggcatgagccactgcgcccggcctgcttttcttttaaattaatagccaagcaattacatgttttagccacaaagctggctgttttggacaggtgtgcaggcataagagaattactgatgttacatggatagtcttgtcttagcatttactttgagtaygtattttgcttattttatgtcgggtaccaaaagaaaaaactgttgaagtgcatatgagataaaatttaacattcaatttttgactgatgaatgcttaatagttacaataatttttttcggcaaaagatctgttagtgaataaaggctttaaaaatagaacaaagtaaatatgagatatactcatgtttctcttttcttttcaggaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgygccactgctctccagcctgggtggcagarcgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaatagcctctgcttcaagttctgtaaactgaaggttaccacgtggttttgccatggtttttcagtggtgtcttctccttggatagagaaaactgtaaatctgcgggagacggtgaatggaagtttggcttctggctgagctgggagagtagttctgtacccaaacccctctctcagatttcccacaagggaggtaggaagcacttagaacatgaggattgctgtgtgcaatgctcctcgaatgcagtgtgatgggtacacggccggcttgggtaggagaccgcccgctgccccgcagggttccctcccactccttcgcttctccatgtggagcccaggcctactgtgggggccctgcaggtggctggggagaagggctgcccacaggccaggctttggcctgttttgcacacgcttccgtttcttagtgtactggaggctgccacctgcacctcattcttatttcttgaggactgtctcagactctgcctctcctttctctccccaatgccaggccacccccttgttcctgggcagataagcgaggacctcccaggggagcccgactccccatcgtgcatggctctcatggctctgcttcatgtatcctcccctcccctgggttactcagagggcaagtgtcttcagttcaccccaaaatgtcctttagagttagtttaacaaatgtcaaggacattttcagttcatcccagacatcttcagttcaccccgaaacagttcaccccagacactatcagttcaccccaaaatgtcctctagagacataatctgggggctatgtctctaaacagggggcccctggagacaaaagtggctccttcttggatgctaacccaccatgttcacgtctgatcggccccagtcccttgaatgcctcctggtgtccgctttatctactgtctctagtgtaagaacctgtcaaccttgacgttgccgcacaaattagaggccacagtgcacatggcattcttgctgtcctggagagttgcctttgtcttgctggagcgtgtacgccctttccctgcagtatataagccccaggtctggggagtaacagtgcagagagccacctgtcctgtggccgcccagggccacgcttccatgtgtaagttccccaatatatcaaccaatatccacaaactggatttgtctgccttctcctttggtttcttggctcctttggcatttggggtctactttgcatacacggccctttcatggagcagggcctctttaagacaaagcacacaagccgagtatagtggcgcgagcctgtagtcccagctacgtgagaggctgcagccggaggaccatttgagcccaggagtttgagtctagcctgggcaaaatagtgatacccatctctaaagaaatacatttttttttgagatggagttttactcttgttgcccaggctggagtgcagtggcgtgatcttggctcactgcaacctccgcctcccagtttcaaatgtttctcctgcctcagcctcccgagtagctgggattacaggcgcctgccaccacgcctggctaatttttgtaattttagtagaggcagggtttctccatgttggtcaggctggtctcgaactcctgacctcaggtgatctgcccgcctcggcctcccaaagtgctgggattataggcgtgagccactgtgcccagcctaaagaaatacatttaaaaaaaatctaaaaaagaaagcacatacagcattatgaatataaaattagattaaaacaaatgtttatttagaataggaaaataaattataataaaattacaaatgaaaagtggataagcagcacaaaatctagaaaactatcagaatattgttatgaattcactgcttaatacaactctgtaatacgtcttttcctgcatttttttccagcatactctttgattgcctctttttacaactattttgtaatattttctatagggatattagcaagataattacactctttctttagtgtggtttgttcattactgataattgaggggcataaaacattcatcttcacatacaaacataacaccgtgcacgaaactgctacaggattgcaaatgacaaacaggtgtgctgatgaatccaattgcatggattcttatccaaaattagatatgacaggggcagggcactgtggcttacttctgtaatcccaccactttgggaggccgaggtggatggatcacttgaggtcaggagttccagaccagcctggccaacatggtgaaaccctgtctctactaaaagtacaaaaattagccaggagttgtggcatgcgcctataatcccaggtactcgggaggctgaggcaggagaatcgcttgaatctgggaggcggaggttgcagtgagctgagatcgtgccactgcactctagcctgggtgacagagcgagactcaatctcaaaaaaaaaaaaaaattatatatgatgggctggtcatggtggtttacttctgtaatcctagcactttggaaggctgagtggaggattacttgagcaccaggagttcaagaccagctgggcaacatagcaagaccccatctctacaaaaaatacaaagattagcctggtattctggctactcaggaggctgaggcaggatgatcacttgagcccaggaggttgaggctgtagtgagctgtgatcgcaccactgcactccagcctgggcaatagagttgagacccagtctcaaaaaaagaaaaaaatatatatgatatatcattacgcccctgacaggagatattctggttagaagcaggcatcagcgcactcttacagttttccacttctgatgattgaaatgatctccatagcccagcttctgactcagtgcactttgaacctaatttcttctgcactcccacacgcaatggtgctggagctggaggacaggttcatactgggatttgaagtttgaccctgcacttacgtgtctcaattctaggtaagtagcaaaatgagtgttagaagtatttctggaagtgatactactccaggacaggtggcagaaactgtactacatatgaaaattactgcaaaccagtggcatacacaaatactctctggaacccaaaccaccacatccacccttgattcaattcaattagtgcccctgaaacagattctaaaagtgcctgtggccacttcaatgcccttccacctgaggggacacatgtctgattgaaattagaggggaaagtggcagaggcacgattatggttaaaatccttcactaatgcaaaatagatgaaacacagggccaggtggacaccctgtctggaccttgcaaggggcctgtgcctgtgcagagtctgaagctggaggctgtcagcttcatggaaatccctgcaccccattcttttcattcagtgcagtccctttcatgttgctggctttgaagggactgggcgggctgcctggcagaatatctcatcttctgggcttgtctgggctctcttgttctttaagctctgggcacttcttactgccaaagaagctggagctaaaggtttggtggattcacggtaatgttcttagctggaattcacatttgtggtgttacagacttcctccttcattacagcctaaggcatagcctatctggttgatccactgttagttaaccccagataacgattagggcctgatatctttgcggtcatgattcagcccactacaagtatggtttgcgagatggtgtttttccaactccactgttccttctgaatttattaggctgtaaatcatggatttatttggttcccatgaaatgcagctcctcctagaaaaacagaataaaacctttcattctttcccttgtatgaccaattttataagcgaggtgttagtttagcagatgcttcaaaggtgacaagtccctttgttctggatcttttttgcatagtcaccatgggcttgtggatgtcactgagtcaatgcatttcaatccactccaatcacttttctttatgatgcagagacagacacaactttggccagtggtagcttcttcatgccactgttttgtccggttgacaagaccccattggtccttgaaaacttcagtactttttagtgtttttgatgttttgtaatttatttttgtataattttaaacttaaagaaaacttgcaagaatagagaatgaaactcctctatactccttaactagactcagcaattatttgcgttttgccccatttgttttatcatcttgctgagagagagagagagagacagagggagaatagcatgtagagaaggtataaatacacggtagacatacaccatttcttcacaaccttttgagtatgataggcctatttcagtatctattttgtaaaaacaagatattatatagagtataattatcaaattaagaaatttcacattgatataatttttgtaatccatagtgcatattcacattgtaccagttgcccccatcatgtcctttttagctaatattaatgacactgggcattcattcatgtacttattgaatatttgtatatcttcctttgggaaatgcctgttcaaatatgtttcaagtttgtattgggctgttttgttctttggattgtagaaatcctctacattttctgtcctttgtcagaagcaaggttttgcttaatttgtggctcaacaacaaactgttgctgttttctcaactgcgtccttgatgagaagtttgaatattgtttgtttgttttaaaaagaccttggtattccactctgagtttcaattaggacagctgggagcggtggagagtcggagttgggggaagagctcagcccagtggctggaagtctagtgcacttggtttttgtatggggaatgctcgctttccattttgctgggaagacgtgcagatgagggcttctgtcaccaaaggctgaagctctgatgatctaatttgggcagagtttacccacaggatttgaggctcctccttgtggccttttctgtcctgggtgctcacttgctttttatcagctgcggctgccatgagcttagtctgctggctctgcagaccagaaagcctgcggttttctgttttcctttggtcatttgtcatggctacgaccgccaccaccacagccttcatgacagaagctccctgctgccctcctttcttccaagtgtcaacgcccttccagaattggtttcatcttattcactctccgctggcatcaggcagttattttttgtaatttctccagcgtggacagctgctgtctgcagaagggttggctctggcaggagctgaccagatatggagactgcagcatgtgactgactctgggtagagaaaagtttcgatcaccaaatgtctttatcataagctgaaatattaagatattcatcttgatctcaagatgtgcgtgattcctatttcaggtatctctaccaccttgggctgttcccggcctttgccagctctcttgagtctccttggcgtcagcatcctcagagcaggcccccggccagtgtaatcgtccgatgggctcttcctgtccactgcacagacaaaatcaatttaccgaggccacggcattgcagtagagaagaggtgtcactgacacgaggctggcccacgcagaagaactggagttactactcaaatcattctccccaaagccttggacactagggtttttatggacagtttggtgggcaggaggctagggaatgggtgctgcttattggttaggcatgaaatcacaggggtgcagaaaatggtccacatgtactgagtctgcatctgggtggggccacaagaccggttgagtcatgagtcccagatccccaaagggtcagtctggaaaaataataataattaaaaaaaaaaacacttaggttttacaatagtgatgttatttatagaagcaattgggaaaaatcacaaatccccatatggcccctggaaagaagggattatagaaactatgcctacattt

SEQ ID NO: 10844 - DNA, 77483 bp, Homo sapiens
ttctttcattcagaaataaaacacagctggttttagtccaacagtcattataaggctaaaaagatctactttaagcgtgtctaatagtttttcatctttttctcagtcacattagtaatagtagagttgacccttgaacaacacagatttgaagtgcacaggtccacttacgtgcagatttttttcaaaaaatgcgttgaaaaatcggagatttgcaacaatttgaaaaaagcacacatatgtagtctagaaatattgaaaaaatttaagataaaggatgtcatgaatgcataaaatatatgtagattgtagtcttactcataaaatgcacacatctattataaaaaattaagatttatcaaaacttatgtacacagaccatacatagcacaatttgaggtcaagagaaagatgcagtattaaatcataactgcataaaattatcttttgtaatagtgtaatacagtaagtccatagccacctcttgttgccactgcagggagctcaagtgttataggtatccacttaaaatgccatgtgacactcatctctgcatgagcagttcctcgctccagtaaattgcaaatcaaagtaaaagcgatccctctctgtctcatgtattttttgtgtttaataccataccacaaaactttgaataactccatgggatctatacagagtgccactagtgatgctggaagtgctcccaggaagcagagaaaagtcatgacattaaaggaaaaagttgaattcttgatatgtactatagattgaggtctgcagctgtagttgctctgatttcagacacgactaatcttgtaaacagacaacctaaacttagaatctaaataaatacggtatagtactgtcaatgctttttctctctgtgattttcttaacattttctctagcttactgtgttgtaagaatacagtatataatagataatgatacaaaatacatattaatctattttttatgttatcggtaaggtttctgtgcaacagtaggctattagtagttaagtttttggggagtcaaagttacatgcagatttgtgactgtgcaggtgtcggggcccctaactcccacgtttgttcaagtgcggggtattttcatttccacttaagtatatagaggccaaaaatgcaaaaaagaaagaaactattacataaacagatgtacaaagataatactgcatttgaaatacagtcacttgaaatgttcactaatcagcttacatattcaagtataaattcggtgaacaaaatgatttagggacagcgatatgtaatgtaaaaattgtgggttgttggaaagtagagatctgtctacatggaaagaatactagaattaggatttcaatgtcctagattatagtttcagctctgctatttatcatgtgactatgtgagtcagattttttagttgcaaacaccaaaatccaattttgacagaaaaagaaaagtattttattaaaaggataacagggagttcagtatcaccaggaggcctagagaattaggcttggagagtaggcaactggaacatcaccctttgttccttggtcatactccacagagctggggcagtgaggacgccatttctgctgaacattaggtgccaccacttactttgccaaagccacatgcacagaaccctggatcatggcagccagtgttgctctaagaacttgccgcacttgccatggtcccagagaaaattattccagagactttattgtgtctctggtacttaattcaaaatcaagagtaatttgtagcatgatagaatcacaaggagaagcagagaaaatacctggaatttccacttctatagtgaaaggcatgttctgcttcccagcaaactcataaacaaggaattcccaaatgtaggaagggacctcagatgctgggcagccaaaaagcatggcatgtccactatgttgacctgggacaccactctgtgtgagcctactttttctggaaagcaaagtaaataaagctcccatggctgaggagattttgtgtgttcacttatacatttgccagtaaacaccagccaggtgccagtgtataaagatgagtaagtttcctctcgagtctaatggtaggatagaggcatgcagaggtgagatgagggcagaaagaagagagggctcaactgtagtttgtgaatgatgttcttatatttaagtagttatatttttggctgggcgcattggcttacacctgtaatcccaccactttgggaggccgaggcaggtggattacctgaggtcaggagtttgagaccagactaatcaatatggtgaaaccctgtctctactgaaaatgcgaaagcctgtagtcccagctacttgggaggctgagacagaagaatcgcttgaacccaggaggtggaggttgcagtgagctgagactgagccactgcactccagcctgggcaacagagcgagactctgtttcaaaaaaaaaaaaaaaaaaaaaaaacccctggccaggtgtggtggctcatgcctgtaatcccagagctttgggaggctgaggcgggcgaatcacctgaggtcgggagtttgagaccagcctggccaacatggtgaaaccccgtctctactaaaatacaaaattagctgggcctagtggctggtacctgttaataccagctacgggggaggctgaagcaggacaatcgcttgaacctgggaggtgggggttgcggtgagccaagatcatgccattgcactccagtctgggcgacaagagcaaaaccccatctcaaaacaaacaaaaattcccatgtggcacgtgatgcttgcaccactaatagggaagacagcttgctcttgtaggacactgctgtagcactttgaaagtcagctgttttatacaaataccaaaatgataatgttagctggcacaaatccagaaactcaagcttttgattgtttattgacagtcatatctggactgccagtttcatggagtaagatacttttcaaaggattaaatatggcatagctttgtcagtcagcaaggtaaatcatcaggctcattgcagtgtgagactacccctgtggtctttctactatacctagctactgtacaactttgtgtcttaaaataaattgttggctttaggttttagtgtttggttttcttatttataaaagagaccagctacatggtaacttagacctcacccagaatcataccacattcaccatatggtaataatagatggaatacatttttatggaatatattctatagaaccagggactgaaaaaggtcagtaggaccacggggtcaattatttcaggccacaatttcgtgtaataatttctttttcatagtattcttggtaaattatgtttctatagctgatattctctcgtaaattccggaggtctgtatccaactccttttcttttttagagacagggtcttgcttcgttgcccaggttggtctcaaactcctgggttcaagcgatcctcctgcctcagcctcctgagtagctgggattacaagtgaactgcttttttttttttttttttgagacacagtctcactctgccactcaggctggagtgcagtggcgcacgatctctgctcactgcaaccaccacctcccaggttcaagcgattctcctgcctcagcctcctgatagctggaattacaggcacgcgccaccacacccagccaatttttgtgtttttaatagagacggcgtttcaccatgttggtcagtctggtctcaaactcctgacctcgtgattcgtccgttcgacctcccagagtgctgggattacaggcgtgagccaccacgcccagccgtgaattgcttttttaatcactccacttggatgacacacaggcatctcaaaattaattatttttaattgatagataattgtacatatttatggggtacatgtgatatttgactcatgcatacaatacgtaatgatcaaatcagggtatttagaatatccatctcaaaaatttatcatttatttgtattgggagcatttaaatctagctattttgaaatatacaataaattattgttaactacagtcaccctactgtgctattgaacactaaaatttattccttctatccatgtttgtacccattaaccaacctctctctatccccttcccctcccagcctctggtaactgtcattctacttgccaactgcatgagatcaactttttagctcccacgtatgagtgagaacatgtgatatttgtctttctatgcgtggcttatttcactttacataatgacctccagttccatctgtgttgctgcaaatgacaggctgaatagtattctgttgtgtatatatgccacattctttttatccattcatctgttgatgaagacttaggttgcttccatatcttggctattgcgaatagtgctgcaataaacatggggatccaggcatacctttgacatactgatttccattcctggataaatatccagcagtgggactgctggatcatatggcagttctagttttacttttttgagaaacctccatgcatttttctatactggctgtataattcagtgtatgaaagttcccttttctccatgtcctcaccagcatttgttatttttttgtctttttgttaatagtcattctaactggcagtgtcaaatttaacaagttcaaatgggagttcttgatctccccccgcttccaaatatattccccttacaatagttcccatttcaataaatagcacctccacgggcccagttaataggttaagctaccaatctctgcttccacccttaactcctgtcttcacatagtagctgacatactgctttaaaaggtatcaaatcctccaccccttcgatggcttcctgttacgtacaattttaaaatccttatcatggcctattaagtgctgcgtgatctggcccctacctacctttctgacctcacttatattgttcttcccgttaaaaagcttcagacaagctagacgttttccatttccacaaagagcgatcttttctcctccaacccaacccacctggtccaagagttttcacagggcttaccctgcccctcttccatttggctaactctttatcttactctgagaggtcttccttgactacccttccttggtccctaatttatttagttttatttttgaaacaagagtctcgccctgtcacccaggctggagtgcagtggcacaatcatggctcactgttaacctcgaactcctgagctcaagtgatctttcctccagcctcggcctgcaaaagcgctgggattacaggcatgaacacctggcccctatttttaaattacagctccttccgtgcattttctacaattttaaacacatattggtttaaatgacacttgattaccgtctaccttctccactacagaattaacttcaggagaagaggaaccatatctgctttgttcacttttgtgcccataatagtaacggcaccagcagcaacaaacatacagcatttactttgtggcaggcattatgctaagcgccatacatacaactaatttaatatgtactcctagtacattgtctggcaggtagccaatggtcagtttgttcagtgaatgaacccagaccctacatgctcatctacagggtgcctagcaccccaggaaactgctccttatactgttagataactggtgctcgcaggaatcttatttacactgtattggccttagcatgcctccctgcagtttccacccactggttctatttctgccccttctggggccacgcaacacgagcctgaatcgtccttccgcaagctcgcctttgcagtacccgaagccccacgcgccccctcctcgtctgccttcctcccgcctcccggtgcccctcctgcagatacagcttttatgcgcggtggtcgggaagcccagccccggccagccagctgctcccggcatccttcgccgccttgcgcgtcacatgacggcggcggctccgcacgatccccaggcagctgtccgcccccgggcggggctggccgcacgccgcaatcctaccggctgctgcggctccagcgggggcggcgggtggcttccagggcaccggcggccgcggcccggactccgcggtgggcgagcgccctgtgaggtaagcggccggtgcgcagaggctgcgggcgaacttgggcggccgggggaggggacccggggcgcttccccaggcgaccgacccaggaggcgccgctcaktcctggcygaggctgagcgtctggtcgggcttcgggcatcaggggtctggcaggaccatgaggcgtaccctcaggccgcccgcggctccgcggtcccccggcatccggaggctcaggcgcgccgacggagagctatgccttggtttaccctcccgtaaaactaccggacgcggagcatgtatctccgcggtgcctccagccctgagatttttcgagtgtgtaagtaaagtcgaagaagaagaagctgactcttgggatgggaagagccttcacctaggaacgcaggggcaaatatggggctgggcacccactgtgtattttatgcaaatctcaaggggcaaatatggggctgggcacccactgtgtattttatgcaaatctcaagcctctcagacggttttttcatctttaaacaaaaagtgataacccctgtcctgcctcgctcttaggactacagtgaagaacagaggggaaagtcatttgaggagccagaactctggagtcagttagctctggttcagatcacagttctgccacttactggctttgtgaccttcagccagattgattcctcatctgtgaaaaggaggtaataagctcatgggttgctgggaggattaattgtaaagggtttagcacacagtgtctggcacaaaagcctcagtagataatgctgttaatataagcattattagtaagctagagattgccccacgtgaagggctttttcagcagaataatcacatttgtttctatatttttagtcctgaaaactgccgttttggtttgtaagaccttttctttttctcattctgggccccctttgccttctcttttacaattggcatatgaacctgttgttcctaccatatgagtcaggctggatgggaacatcaatttacttgagcagattggtatcagattccctctgaggggagagaaaagtgccaggcatgtgtagccaccgaaaaaaaaaacacagtacggtgattgactgtcagagctggaggatgcctgggaaaccatctaatccagctgtctcctttgcaaatggagagactggacccagaaggacgacaggactttgattttgctcaggacccaacagagtgctggcagtgggtagtggagaggatggaccttttaccaggcactgtgctttccctcagttctaatctcattccgcatttattcagcagctatatggaacccctactctgtcttgtacacctactaggatctggacatagagctgtgaacaagacacacatggtccctgtcctcaaggggctttttccagagctagctatgttagtttgaggttatataatgttttatatatatatccatctccctgcccgttctcagtacattttaaaataacaataagctgcagctcccagtgagcttacctcataacagctggcctccagggataggagcacacagagaggcctgaattgtttcctgatccctcacaccagttccagagcccttgctggagcctggtgagatttgagagactggagaaaaagctgctttatcagggcttttaagaaaggatttccttctgccctggagcacttggatttctttgtctttctggtttcaagcctattattgtttttagatttctgagaagagccgccttcaccatagtgccatcattttggttgccgtggttatcaggggaattgtatttttatgatcgcacaagtagctgttaagcaataaatgctcaagcagtcaccaggtcaccatgagtttccgttctctggtttctttcagttgcagtgcagttacactatcccttccttccctccctccttttttccttcaataaacgtgcattggtggcagtgccaagaggagtgggagtgagtagaaatagataaaaacatacgtagactctggccttagggacctcagattctttggcagggataaaactgagggcagattagtgggggctctgatgatgtagatagggagtcagcaagagctctcagagatgggagggatggtgtcctgggcaaccaagaagacatcacttgcttttcacaggaagatgtgaagtaaacaaattccttgtacctgcttcagtcaggaaatagatggaacaagtgttttgttctttcagtttgccttaatgaatgaacctattcttgagttacctgtcatgggttttgtttgaaatgtctgctaatttctctcattaccctctttcttttagtttagtgattattagtttcccactcgtctaaaatgtttgatactgtatacataaaggaatgtacacaaagagacatttgattaagattttgtctatttcagtttagatgtttaacatgtgtgtctcatttcacaagttgggtttacattcactcttgtctttccttatttttttctaagtagactcccaagtcctctctaatgtccttattagtgagaattccagtgtctccttctccagcctctctgggggcttatacattccaatggggtcagtcttactgtcactctccagaggagagagaactgcattgtctgagcagtccacacacattgtcattcctgacacagctatatggcataactgttgaagagctgtcctacacagtccacggatgtgtgatcactgctgctcaatgcccttattggaccaaatctctgccagcatgattccatgcttggttttccaaggttagagcttgtttcatttatgcttgcgtgctcagccattctccccaaagcacctcactctgggcttttgttgagcttktcaccaggctgggttcccctggtgtcctggagagttctcttttagggcatttggggcccttcctgctagcaaccttggtcatggtcatctagaccacccaagagatgtctcygttttcaaacttcttatcagagtttgtgggctcagtcccttctcttcttaaccttaacccaaatccctttggcaaattggttccacatactctccagggttctgcctaccgatgattctcaggaatgacagccttcaacaagatagctaccccaggactttgggtgcctactcaccttacttttccatatgtaaagaggggtcgtcaggtcaccctgagccacacagatttaggcattctggaaaatttacttggcatgtaccctgttagggattttgcaggcaaggttttaatttaaaaataaaggattttagttttctcaatttttctaagaaacaataatcagtatatttatttcatttatttgttttaaactttttgaatatgaaatacagcaaatatgcatggtaaaaaacacaatatatagtttagcaaataactctaaaggaaatacacacgtaatcaccaacatgtcaagaactggaacattgccaatactcagtacctgcttccaaatcataatttcctcccctagaagaaatcatcttgtgataatcatttttttgcttttctttgtaattatatcacctatgtatatatccctaaacaatatagttttaagttttttaatttcatacatatagaatcatacttttgcattttgtgttttgcttcttttgctcaacttgtttgtgagatgcatccacgtggyggcctcacttattttcgttgccaacagtgtttcatggtatggctgtgtcacaatagatgtattcatcctgtggttgatggatacttgagttgcttatagtttctgactgccaagtacatccttagatattttctgatgtatttgaacaagtttctttaggttatatatgttagagtacaattgctttactagatagtgtcgaacagtttactttcctaccaggagtatatgagagttccagttgcttcatatcctggcaaatagttgcttttattggttttaatattttaactattttcatgtgtgtgtcttgatatttcttgtggttttaacttgctctccttggttactcttgaggttgagcacttttttcttttttcttttttttggaaacagggtcttgctttgtcacccaggctggattgcagtggcgtgatcatggcttactgtagcctcaacctcctaggctcaagagatctctcccacctcagccccctgagcagctgggacagccagataattattttatttttttttgtagagaccaggtcttgccatattttccaggctggtctcaaactcctggactcaaactattctcccatgtcagcctccccaagtgctgggattacaggtgtgagctaccatgcccagcccttgagcagttttttgttggttaattggattgcctcttttgtgaactgtctattcatgtctcttgccatttttaaattttttaaattgatttttcaataaggaaatatatatatatatatatatatatatatatatatggctctcttttcaccctcttaaatggtgatatcttcgatcccattctgtagaagcagggcataaaatagagattcttgttcaagtgagactgtgggagaagccctcaggaagaggagtatgaggaaagctggattgggggaggagaggcacagcctggtgagggggcagttgcagttttctggagaaagggacatctgtgagttgttctcagctgacaccacatctcagtgacaggtgtgctaaccagtaaagatgatctggatggaaccagtagtattctccacagtccacttcttgtaccatacagataggcttgcttcttatattaagttcactgtatccaggtacagcttctccaggattctggttagtcacaaatcctgggaaaacttataagaggaagattagtgagacaaattacaacccttgctgctgcagttggtccagaaatctaacaaatacccatatcatcctcttccaccatccattttagtttccccttctttgtcccttgaatgtatgatagaacttggtgatgaagccacctgggctcgcaggtgtgttttctttgcaatcttatttttgaccacagactcaatgtctttaatggttctagggtgattttgtttttataatttcttaactaagtaatattttcctaggagtttatcccttcatatttacttatataaagttgtttataatttttttttttttttttgagacggagtcttgccctgtcgccaggctggactgcagtggcgcaatctcagctcactgcaacctccgccttccggtttcaagcgattctcctgcctcagcctcctgagtagctgggactacaggcacgtgccaccacgcccagctaattttttgtatttttagtagagacggagtttcaccacgttggtctggatggtctccatctcttgacctcgtgattcacctgcctcagcctcccaaagtgctgggattacaggcgtgagccaccgcacctggccgtttataatattttcttatcatttggtgtacagcatctatagagatatcccctctttcattctgatttcattttaatgcttttttttccttcttctttggttttagtagaggttcttttcagagaacctgctcttatcatcagtgatagtcttcataataaatttgttttctgtttcataagttctgctctgttctttatttttctcttctattttccttggatttattttgttctttttctgacttcttgaaattgatgtttagtttcattaatttttatctttttgattctctctatttaaggttatacatttttttccaaattctgtttcagcaggagttcacaagttttgatatgtggtatctctgttgtttatttcttttcttttttttttccgagacagactttcactcttgttgcccaggctggagtgcaatggcacaatctcggctcactgcaacctccacctcccgggttcaagggattmtcctgcctcctcagcctcccaagtagctgggattgcatgcatgcgccaccatgcccagctaatgtttttgtattttagtagagacagggttttaccatgttgctcaggcgggtctcgaactccttacctcaggtgttccacctgccttggcctcccaaaatgctgggatacaggcatgagccactgcgcccagccttctttgttgtttatttctaaaaatattctaatttccattgtaattctttttctttaaccaatagatattatattcgagaaatgtgttttgtaatatccaaacatactaacattttctaattatcctttatttatgactaattatgactgtggtcagtgagcttgttctgtttttggttggttggtttgtttgtttttgagacagtctcactgtctcccacattggagtacagtggtgtgatcatagctaactgcagccttgaactcctggctcaagcaatcctcctgcttcagtctccccaggtagctggaaggactacaggtgtgagccactgtgctcgaagctgtataattttaatcctttgaaatttcttgatacttctgttagagctctgtttatggtcagtttttataaatgttccatgtgtgtttgaaagtaaaatgtattctacagttattggattcaatgtccaatgaaatgccattagatcaagtttgttaatggtgttcaaatcttctttatccttactgggtgkttttttttttcctatgaattatagagggatgtgtttaaatatccaagtataattatgaatttgtctacttcatcttttaattttttttttttttttttgctttatatctgtaaggccgtattatcaggtgcatatacaaatataaagttgttttatcttcttaattcttaattcttaattcactttttatcattatgaagctgccttttttgtttctaataatttttttttttgccttatactttacctgatagtgtaatctttttaaaaatctacacaaggtattttttttccattagttgcatcttttctgtaactgtgttttaggtaagtctcttatgaatagcatataattgggttttggttttttaaaccctgggaaaacttataaggaagttttaaagtcagggaaaaccctgactttctctgtcttttaattagaacatttagtccattttcattamtagcaccactgatgtatttttgtttaggtctgccttattttatgctctcaatctgtttgtcctgacagttctccatttcattacagctgtcttcccttctttggagctatttttcatcattcaccttttttttctactaatgtggatgttatacactttttcttaatggttatgcttgaaatttcaatttgaccaaagttgatagatttccgttataagtggtgaatatccttgctcttttggacagacagtacagcgaccttagaccacatgaactccgaccttagaccacatgaactctgaccttagaccacatgaactccgaccttagaccacgtgaactccgaccttagaccacatgaactccgtttatcctttttccaccttagggtagaggagatgtaaatacaatgtatcaactttgattggagtcttactagcctacagagagaaaaaggaagagagtaaataatttacctgagaaaacaaagtaaattggtttcttgaaaacaaagtaaattgggtgggtggggatgtgtgccagtggctcacacctgtaatcccagcactttaggaggctgaggtgggcggttygcctgaggtcaggagttcgagaccagcctggccagcacggtgaaaccccatctctactaaaaatacaaaaattagtcaggcgtggtggcaggcggctgtaatcccagctacccgagaagctgaggcaggagaatcacttgaatccaggaggtggcagttgcagtgagccaagatcgcgccattgtactccagtttgggcaacagagcaagactccatctcaaaaataataataataataatttacttgagaaaactgtcaggatttgtttgcttgtaggtgatcagcttaaagtatctgaacttgaaaaagaacatcagttggctttaaaaagaaaatgttactgtgtccctggccctttgatctcttgcagtctctcaccttaattgtctgagtttggcttcattcctcatatggactcttttgagttgccccattccttgcaagaggatgggggattcttactgtcttctttgggtcaagtatccatcctgtgaggtagaggactgcaacactctcagtggcagccccagcaggactaaatagagtagaagcggggttcccctgaggacgcagaagagggaaggtgctgggcagacatagctaaggtcaggtgcagtggctcatgcctggaatcccagcactttgggaggccgaggcggacagatcacctgaggtcaggagttcaagaccagcctggccaacatggtgaaaccccatctctactaaaaatgcaaaaattagccaggcatggtgcctcctagttcctttcttggagtactggggttcctaacttgtgaagtgatgatataggaacttctagccccaccatcacatatatataaactcacagatcatgaaataagaatgaatttgatcctgcaattgttatgcactaaaatattaccacacaataaatgtttactcataggaattgaggataagcatactacgttttggttgttataagtgctcattaagacgatatgtaaggctgggcatggtggctcacgcctataatcccagcactttgggaggctgaggcaggaggatcgcttgagcccaggactttgagactagcctgggcaacatagtgagacctcatctctaaaaaaaaaaaaaaaaatttagctgggtgtggtagcgtgtgcccatagtcccagctactcaggaggctgaggctggaagatcacttgagcccaggagattgaggctgtagtgagccaagatcacatcactgcactccaatctgggtgacaaagcaagaccttgtctcaaaaaaaaaaaagaaaaaaagaaaaaaaaaagacatgtaaaaarcacctggcatttagtaagccctcaaaacacccttgcctgccccttcaaggacatgcaataaatttatgtgagaatcagtactaaaacctggatctggggacccccctgcaactccccttctgtctcctaagtaaamcaaaatgaacaggcagtgcattgaaaggagagagggtccttatggctccaagcccactcagaaagcaccatcagaacacagctttctggtttatgtcatcaaatttcaaagctgaaaataagaaacagatggttatttctcacgctgaagagagctacggtttgaagaaatgatgaaaagcccagctgaagtttttctcatcttcaaatttaagttttgtctcatttccgatggtgtgtgtaggtgtgtgtacagggctctttggggttataatattttactattactttagaacagtttactccacaaagctagggacatttactttgatttgaagaaagattttaaatcattaatccattacagttgctcagttaatacagtttgtagttatttacgctgtgcctgtgaggcttgtgtgcctcataatgttggaagagaaattttttcttttcctgtcaatactaaatagggttctgagcagcccttgatttttttttccacttttttttttttttttycgagacagagtctcactttgttgtccaagctgcagtgcagtggtgtgatctcagctcactgcaacctccacctcccaggttcaagcgattctctgcctcagcctcccaagtagctgggattacaggtgcccaccactatgcctggctaatcttacttttttattagaaactaaattccaacactttgatactagtatggccctctgtaggtagaaagtgtgtttcccttgttatacaaatgtgaaacaagagttaagtcacctgccgtcatgattagtctgcaagggagaggcagagcccaaactagagtgtgaatgaagcctgttgggtcccttttgtcagagtcatttcagcacgcatagggccttttgtgctgggactcatggcagctccccatggtcccccaaattaactagaaactgtttacctttggctaagggtgttccatgtgaactaatacaggtggcctttctcactgatcccttcagactcctggagctgcagccagactgaacctcccaacatgtcctaagcccagctgaaggttttctacctcaggagcttttgctgatgctgtttcctctgcyatagccccctttcttcctcctctgaatgtcccagtcctatgcaaatttcagagtccagttcagataccagctcctccatgaagcttggcttagtggttaaaaacaagagtctctggggacrggctgggcttcagtggttctgcacctctctaacgagtgattggggcaagccatttgtcacataagtttagtttcttgaactgaaaaatgaagacagtattaatttcagtcattgcttctcaaatttagggtgcacatcagttccctggtgatgttgttaaaatgccaaatctgatccaggaggtacacggtggtgcccaatgtctgccacttctaacaagctcctrggtcctgggagcacattttgagttgtaaggcttgaagagatcttcagggaataggatgaaataatgcatgaaaagcacttaatattgtgcccctcaaatagcagtactgagtaaaagctacctgctgctgtttttgttgtcttccattattattggtttgtttccctagctggaggtcacatttttgttctttaaacaagggctttcccttttttatggcactgtgttagtctgtgctcacgctgccatgaagaaatatctgagactaatttataaagaaaagaggtttaattgactcacagttccacatggctggggaggcctcaggaaacttacaatcatggtgaaaggcacctcttcacagggtggcaggagagagatgagtgcaagcaggggaaattccagagacttataaaagcatcagatctcatgggactcactatcacgagaacagcatgggggaaaccgtgccccatgatccaattacctctacatggtccctcccctgacaaatggggattgtgggaattataattcaagatgatattttgggcggggacacagccaaaccatatcattctgcccctgggccctcccaaatttcatgtcttcatatttcaaaacactgtcattcctttccaacagtaccccaaagtcttaactcattccagcattaacccaaaagtccaggtccaaagtctcatctgagacaaggcaagtcccttctgcctatgagcctgtaaaatcaaaggcaagctagttacttcctaaatacagtgggggtacagacattgggtaaatatacccactccaaatgggagaaattggccaaaggggctacaggccctatgcaagtccaaaatccaataggttagttattaaaccttaaagttccaaaatgatctcctttgactgcatgtctcatatccaggttatgctgatgcaaaaggtgggctcccagccttgggcagctccacccctgtggctttgcaggrtacaacccacctcctggctgctttcacaggctggtgttgagtgtctgcagcttttccaggcacatgatgcaagctctcagtggatctgccattgtggggtctggaggatggtgaccttcttctcacagctccactgggcagtgcccccgtggagactctgtgtgggggccccgaccccacatttcccttctatactgcccaagcaggtgttctccatgagggctccacccctgcagcaaacttcttcctggacatccagctgtttccatacatgctctaaaatctaagtagaggtttctatacctcagttcttgacttctgtgcacccacaggctcaacactatgtggaagccaccagtgagtagggcttgcaccctctgaagcaatggcccaagctgtaccttggccccttttagccactgctgcagctgaagcagctgggatgcagggtaccatgtcccaaggctgcacagagcagagggtccctgtgcctggcccaggcccatggaaccatttttccctcctaggccttgggcctgtgatgggaggggctgccttgaagttctctgacatgccctgcagacattttcyrcattatcttggtgattaacattcctcattacttgtgcaaatttctgcattgggcttgaatttctccccagaaaatggggttttcttttctatcacatccaataggccagtcattaaaccttaaaattccraaatgatctcctgcaaattttccaaacttttatgctctgcttcctcttgaatgctttgtcrtttagaagtttcttctgccagataccctgaatcatttctctcaagttcaaagttccacaratctctaggggagggacaaaatgctgtgagtctctttgcatagcaagagttacctttactccggttcctaagaagtggcttatctccatctgagaccacctcagcctggacttcatggtccatatcactatcagcattttgatcaaagccattcaacaagtccctaagaagctccaaactttcccacatcttcttgtcttctgagccctctaagtctctaggaagttccagactttcccacatttttctgtcttcttccgagccctccaaaccattccagcctctgcctgttacccagttccaaagtcgcttccacatttcaggtatctttacagcagcaccccactctctgtagtaccaatttactgtattagtctgttctcatgctgctgttaagaaatacccacaactaggtaatttataaacaaaagaggtttaattgactcacagttctgcatggctggggaggcctcagaaaacttacaatcatggcagaaggcacctcttcacggggtggcaggagagagaatgagtgcaagcaggggaaatgccagatggcttataaaaccatcagatcttgtgagactcactcactatcatgagaacagcatggggaactgccttcatgatctgattatctctacttggtcacacccctgacacatggggattatggggagtataattctagatgagattttgggggggacacagccaaaccatatcaggcactaagcatttttccccttgaattgtgggatttctttggttttctttttgtcttttgggtgttttttggtagacatatctttgttctgccagacttgagagcagggtctttatctgattcccactgactcacaaggtgctaaccacttggtcttatacacagcaagtgttgaatacatacttgggttcttatttacttctttttttattccacagggatctgtgtggcagcagggaatctattgctaatgatttgagtagtctcagctatgctaatataccagataatgatgagggtgattatttattcagtaaatgattgttgagcacctgctatgcgccaggcatagttctgggcatagtgcaaagcagtgatgcaaagtttctgcccttcaggagcttacattttactcaggggagacagacaataaatgaagraaaacatttaattccacagggaatttcctcctagaggtgcccaggctctgtcacctggcgctctgggtccacaggtgtgtttcccttttcccgtggttcatccctgtggaataactcagcacttcctgtgtcccctctgccccctcacagatccactcacacaaaagaatttgtgagcgaccaagacattagagagcttacagggagccaaagcaagggcttcactttatactcaactgttaataccaaagcgttcccctgttgccacttcctcccaccacacagctcccaagtgcagatccctgagggatgtttttattcctgaccccagcctgcctgcccatcttggtgcttggtgaacgggcacatggagcccacccttcccagaagcagtgggagtacagacagcaaatgaacaaagcagcagccttccttccagtgcctcacaggtgcagagctctggacagtgctgtgagggaggttgttcccactttcccctttacagatgtgtttccatgtcatgccgttgagatgttagactggccaagggcttgttcatcagattgcttctctctcttaactccttcaccagtgatctcagtccatgccatggctttaaatgtcattcaggtctctattcaaatgtcacttcctcagagaccttccttgacaaccctgtctgaaatagcacatgcatgcacatataccccttaacctgctttatttctcttcatagcatttatgttaatatctttttcgtttattgtctgtctctgaaggtagggactttgcctcatttactgcttttcagttcttggaacaatgctyggcacataggcaatcaacgaatgtttgttgaataaatgatttttttctctggaaattgtcaaaatctgcatgaggtgtatcaggccagccattgtcagcctcagtttagaggcaaggaaataggttcagaaaggttcaaggacgtgctgaagtcacagggcgaggcagcagcagagagcctgcttgttgagagccaagtcttatgggacttgcctccttctctcccactgaggctggggacaccaggtggcccagaggcatgtggatacctccagtgggaggttaggagagtgctacacagaaactctgagttctaacactcttgggaccataaaaaatggaacaagtctgggcatggtaactcacgcctgtaatcacagtattttgagaggctaaggtgggaggatcacttgtggccaggagttcgaggctgcagtgagctatgatcctgccactgtactccagcctgggcaacacagagagacctcacttctttaaaaaaaaaaaaaaaaaaaaagttgrttttgttttgttttgttttgtttttttgagacggagtcttgctctttcgcccaggctagagtgcagtggcacgatctcggctcactgcaagccccgcctcctgggttcacaccattcttctgtctcagcctcctgagtagctgggactacaggtgcccaccaccatgcccggctaattttttgtatttttagtagagacggggtttcaccgtgttagcctggatggtctcaatctcctgacctcatgatctgcctgcctcggcctcccaaagtgctgggattacaggcatgagccaccgcgcccagcaaaataaaaagtttttttaatcaaaaaacggaaccacttggggcctacttcaggccatactccctccatcccagacaggcttccatcattgtttttccagttctttacaggcatcacactccaggtgcacaggctctggggacatttgttacttttaattccacatgcagaggccccagtggtaaaacggaaaggcaaaacttgaatgcattaaaaaaaataaaataaaaagtgttaccttgttctaagaagtccctgttgtttcatgaatctccatggattagtgtaaagatatagtaaataaagccaaatggaatgataggaaatgtgcatgtgtgctcggagtcaagagggggcaattgttggcttcattctagatacagagccctggagttgggtacacaggcaagtttgggggaaaacaaatgctgaagggttgacagtaacctgctaggaaatcccccttcccctgagaggccagtgactaaaccatgtgcttcctactataggtgggcttcttggaaccccaagaaaccgaagctccagtagtttctacgtcaggtggcttggccccaaatcccccagacaccctcacatcatcctaagggaaagaaattacaattaatatttgcaaaattgtgagttcctgccctcactgttccacctaaatacctctcctggatggatctccttaaaatatagctctgatcaggccacttcccttctgaggaatctataatagacagtacaagcttcttagtctggcattcagggcctttcccatcatgcaacttgtgaaagagggtcgagcaccagtggctccaaggggtcagaactgacaccacctggggaagagtagtgaagtcaatctcaaggtgtccgagggctttataataatgccctttagagtttcatatgctctttcagcctctgctatggtaacaaacaatctgcaagttcttagtgccttaacccaaacaaaggtgtatttttcatgcatggtgtttgtccatcttggcttggtcgggatctctgcttactctaatcatttaaggatccaggttcctagagtaaccgtcatctcaaatgttgccagttgctgtgccacagagaaaagcaagctgtggatgatcctgcataggcaatgaagtgctctagtcgagaagtaacgcacatctcttctactcaaaacccattggttagtactagtcttgtggccccatytgacctcaggagggatcagatgtacaatcttgtcatgtgcccagaaggaaagaaaactggaagcagttgatgaagagcattgattcccaatgtaatgtgctttcaattttttaatcatcacagcaagcctttgggtgctatcaaggtccccaatttatatatgaggaacctgaggcccagagaggttaagtgacttgttcaaggtcacctgcaacttgaccccaggtcttttggctttgaaatgattggtctttgcatgatacagagacagctgcttcactgaaagggttgaagctgaggaagaaggatgctgcatcaaagtgtgggtggggccctttatcacaatcaccagggagcttgttaaaaatgcacataattggttccactccagagattctgattctggaggtctgagatgaagctaggaataggccccaggtgattctcaggtgatgactgaagagccacgattaaagaatcactgctatgggaggtcctactaagtctggcttaaagattttcttttttcggccaggcgcggtggctcatgcctgtaatcccagcactctgggaggccgaggcgggcggatcacctgaggtcaggagttcaaaacaaacctgaccatggtgaaacctcgtctctactaaaaatacaaaaaattagccgggcgtggtggtgcgcgtctgtaatcgcagctactcgggaggctgaggcaggagaatcagttaaacctgggaggtggaggttgcggtgagctgaggtcacaccattgcactccagcctgggcaacaagagcgaaactccatctcaaaaaaaaaaaaaagattttctttcttcttgatctctataagctkcagtagtgcttaattccttctatctcacattgttattagctatgacagcaaatggttgctatcacctaatgggtgatacattaattattcacctaaaatttgaggtgggggcatgatgggggctcatttctgattattcgtttacttaaaaacactgttattaagcctgtactttgtgctgcatattggatggtatgtggggttcttgctgtattctctgtaagtgaattatgatagcctagggtattcattattgatgagctactatgggaaatgggggaaacccatctgggacagaaattgtcagtgctggatactatgggatgtcacatggggcacacaatgcattgactgggttgaacacttatatagtaaagtaaactaggctcgagttgagaagcagagatgcatttatgagggttggtggttgcaatttgggtctctcttattccaagtccctcctgagacttggwataccaaccattagcaatagatcccaggagaaccctaatggaaagtcctgcaaaagaccatatggaagcctctcacctggaaggtggtatagattaggttcctttagtgttagctgattcactcttgaacacctgtcagagttgccccttgtagaaggaaagaacatcatggataaagcatctcagaaagtgcgcagtatatggtgctccctgaaagaagagtatatggttatactcagaggagctcagaaatcaagagcagcctgtggggacgatgagaatacagattctaacaagtacgtcaaagctcttagcaatgattaaaaatactcctttcagatgcagcagttggtcctggttaagatgagatcgcccactgggaggaaatgtttgggtagttgatggttagcatactttcatatggaaggttatgaaaatggggataatgatgtccttctggtggttttaaattgaagtggctaaataataaggaaaaaaatgaaaccaggacagctagaaaagtattatagatgagcccctctttatagggaaatagataagaaatgtagaaagataaatgtaaaccrtgtggggacatagtatgtaagctgttatgtgggagggagattatctgagctagctagaaatggactttgtgaacggtcaaggccagctagatgaaatgtaatatgtgaagtcactgaattcagagtaccacgtataggtcaccaaaactttatggaaagacagcaaaataacattttaaaattacttctcaagtgaggcaagccaagaacatggttggaggagaggtcctaactgaggctgaactgcatctaccccactcaggtcctggcagagctccttcctcatgagaatgactttgtgaggagaaaagcaacattcaaattaagaaaagwataatyagaggcagagccatccaaggcctccraaggggtaaagaggtctggggtaaggctcagaagggatgtagagtgcaaggatatgaagttgtgagggaaagagtgagttacgtgagagttcaatataaaagggttcatttgagctgccagaggtactactgtcttgtgatgatggtcgggtcaattgtaagtaatcataaatcatcacttattggcatcattgcctraaagaacccatagcctgggaaaaatcagaatcctactctcatagtgcatggacacgtagacccagtattggaataatgtaggcaccctgtagctaagaatgctctccttgtcttttctgttgccctgaatagttgtaatagagaaaggagtcaacaccaggtattgagtcttcagagagaaaagtacccagtccctatcgtaaacaatccagtggaggatgcaaaaggcttagaaacaatgaccaagccagtagaaaaagcatgtctaatatccagattgtggttttgacatattccattaaagaatacagaacaggcyggatgcggtggctcacgcctgtaatcccagcactttgggaggacaagacggacagatcacctgatgtcaggagttcaaaaccagcctggccaacatggtgaaacccccatatctactaaaaatacaaaaattagccgggcgtggcggcacacacctgtaatcccagctacttgggaggctgaggtaggagaatggcttgaactcaggaggcagaagttgcagtgagccgagattgtgccactgcactccagactgggcaaaagagagagactctgtctcaaaaaaaaaaaaaaaaaaaaaaaaaaaatccagaacaaaaatatcctcaactgatttatcattttttgacaaaagtacaaaagcagttcaatggagaaaggataacctttttaacaaatggtcctgggacagttggataaccataggctaaaaagaaaaacttcaacttacacttcaataagaaattaactcaagatggaccataggcttaagtatacagtgtaaactataaaacttttagaaaaaaacacaggaaaaaatctttaggatctagagctaggtaaaaagttcttaaacttgataccaaaagcataatgcataaaaggaaaaaaagtgtcaaaaatgtggtgatactgtggtgctggcataaggattgacaagtagatcaatgaaacaaatagtccagaaataatcccacactaccattgtttgttttttttgaaaaaggcaccaaagcaacccaataaggaaaggagactgttttcaacaaatggtgctagaataacttgatatccacatagaaaaagaatgaacctcaaccactacctcataccataacaaaaattaattcatgatggatcatagaacagtatgtaaaagtcaaaaccacaaagcttttagacaagagattatatccatgacttaggaattaacaaagctttctcagacagatagaagaaaataatcataaaaagaaagaaatggtaagttagacttcatcaaaattaaaaacttctcatcaaaagattccattaagacaatgaaaaggcaaaccacagattgggagaaaatattcaaagaacatgtatctggcaaaggacatataaagaagtcctataattaaatatatatwaaaaaaaacaattaaaaacagacaaaaggaccaggcgcagtggctcacgcctgtaatcccagtgctttgggaggccaaggtgggtggatcacctgtggtcaggagtttgagaccagcctggccaacatgatgaaatcccatctctactaaaaatacaaaaattagctgggcatggtggcgagcgcctgtaatcccagctactcgggaggctgaggcaggagaatcgcttgaacctgggaggtggaggttggaggttgcggtgagccgagattgcaccactgggcttcagccaggatgacaagagcaaaactccgtctgaaaaaaaaaagacaaaagatttgaacaagtacttcaaaaaggagatatatgaatggccaatgatcacatgcaaaaaatctcaacatcgtgtattatgaagaaaatgcaaattaaaaccaaaatgatataccattacatacccaccagaatgataaaattttaaaaaccagcaacagcctgggcatggtggtttactcctatagtcccagcactttgggaggccgaggcagcaggatcacttgagcctgggaattcgaggttgcaatgaactgtgatcacaccacagcactccagcctgggtgacaaagtgtgaccctgcaaaaaacaaacaaaaacaccacaacaaatgtggagcaactgtgtttcttattctttcttggtaggcgtgtaaaatagtatagcctctctgggaaaagaacctaggaattccactcctaagtattgactcaagaaaaattaaaacgtgtccacaaaaacacttatataagaatattcacagcagyattatccataatagccccaaactgaaagtaattcaggtttccatcgaggagaattaattttttttaaactgtgatatattaacacttaatacaatgaaatactactgagcagttaaaaagtaaactacatgcaatgaaatgaatgaatctcaaaatattatgctgaatgaaagaagccttacacagaagaatacatactgcatgatcccatttatatgcaattctagaacagacaaaactaatctgtagtagaaaatcatgatagtaggaatttgaggagataagagaaaagaaaacagtggttgcctcttggggtcgggggtggaacttgatggaagagtcatgagagaactttctggagtattccatttcttggtagggggttgtattgcacatatgaatgcatctgtcaattctgcaaatacacactactggatatggtacatccatagcacgaaatagtcctcagcatcataaacaaactattgatgcacaccacaagtaggatgagcctccatcgaattacactgaatgaaaaaaagccagtctcaataggtgacacactgtataattccacttatataacatttttgacatgatacagttttagaactggaggacagattaatggttgccagtggttagggacaggagagaggagggagaattgagacgtgtatagttacaaaagggcaacacaagggatccatatggtgttggaactgttcaccgtctttactggtcatagatacacaaagttacacaggtgataaaattgtatagaacttaatacacatacacaagtgagtacaagtaaaactggagaaatctaaattagaccttggactatatcaatgtcaccatgctagtgggatattatactatagttttgcaaaatgttaccattggggtaaaccaagcaaaggatctctattctttctttctttctttttttttttttttttttttttgaggcagactttcgctctttttgcccgggctggagtgcaatgccatgatctcggctcaccgcaacctctgcctcccaggttcaagcgattctcctgcctcagcctccctaagtagctgggattacaggcatgtgccaccacgcctggctaattttttttttttttgtatttttagtagagacggggtttctccatgttggtcaggctggtctcgaactcccgacctctggtgatctgcccgcctcggcctcccaaagtgctgggattccaggcatgagccaccgtgcctggccaggatctctattatttcttataactgcatgtgaatctacaattttctcaatgaacrttttttaaagacaacttcttaaagaaagaagctgttatgctatctagccataccacatagcaaggaagctatcagagggtacaggggttgtgccaggaggactgaggaaccaatgtggggccaaagatagcttaatttgaactttaataaaagtagggatttcaaagacttgaaacccataaaatacgtgtcagtccatgacttcataacaatttaaaaacatacatgtggccgggcgcggtggctcacgcctgtaatcccagcactttgggaggctgaggcaggtggatcatgaggtcaagagatcgagaccatctggccaacatggtgaaaccctgtctctactaaaaatacaaaaattagctgggcatggtggcgcgtgcctgtagtcccagctactcgggaggctgaggcaggagaattgcttgaagccaggaggcagaggttgcagtgagctgagattgcaccactacactccagcctggtgacagagcgagactccatctcaaaaaaaatacacacacacacacacacacacacacacacacacacacaacctgaattggtcactgctgtggtctgaatatgtcccccccaaaatgtatgtattggaaacctaatccccaatgcaacagtgttgggaggtaaaaggtcataagggctcttccttatgaatggaagggtttgtggggatgcatttgccatccttctgcagtgtgcagacacatattttcatccctcttgcttttctaccttccaccatctaagaacagagcaaggacgtcctcaccaggtgccagcaccttgatcttggacttcccaggctccagaactgtgaaaaataaatgtctgttctttttttttttttttttttttgatatggagtctcgctctgtcacacagactggagtgcagtggcgcaatctcggctcactgccagctctgcctcctgggttcctgccggtctcttgcctcagcctcccgagtagctgggactacaggcgcccaccaccatgcccggctaatttttgtgcgtgtgtgtgttttcagtagagacggggtttcaccgtgtcagccaggatggtctcgatctcctgacctcgtgatcctcctgcctcggcctcccaaagtgctgggattacaagcgtgagccacctcgcccagycataagtgtctgttctttacagattagtcagattcaagaattccgacatggttgcactaaamagactaagacataaattggtactggaggagtggggtgttgctataacaaatacctaaaaatgtagaagcaacttggaaacggataatgcatagaggctggaacagttttgaagcaaatgctggaaaatccttcattgacatgaatgccacattaagggtggttctggccagggcctggggaaagaagggatataggagaagccttgttcttcttacagattgcttgagtagttgcaacagtgaagrctagtctgatgaggtctcagacagaaatgaggaacaaggtattggaaattggaagaaaggttatctttcttataaagtggcaaagaacttggctgaatcaatgtctgtgtcctaggactctgtagaaggcagaaaggagagaaagctagaaaagctaggtgatttggcagaagaaatctctaagcagcagagcattcacgatgttgcatggctgcttctaactgcttatagtaaaatgggaaaagaaagaaggatttaaagacaatttataattaaaagggaagcagaacacaaagatttgaaaaactctcagttctggttatgtaaagaattttttaaatggtttagaagagaaaaccaagggtgtggccaagtgaccatttgattttcaaggctgcttgtgccgtcacttcaatgctagtgctatgagggcaaaccagcttaaagggccaggcccggggcactcttggaaccttggagctcattgctcagggatgcttcaggcctctgttccctggtcaccccacctgtggctcaagcaggcccaggtgtggctgggctacagaacccagggcacaagcagtctaccttggtgctatccccgtggggctaactgtagacttgcagagtacaagagctgtggaggcttgtgtgcctctacctagatttcaaaggatgctgcagggagcccctatttgggcattacctagtggagtcttggaagcagggctgcccccaagactccagacctgtagagccaccagcacacagcaccagcctgggaaagccacaggtattgactgcaacccttcagaactgtgtgggctatgtccagcaatgctgtggaggcagggctttccagggccttggagacccagcccccaacacgttgtgtccagaaagttggacatggagtcgaagaagattattgtccagccttaagatttagtgttgtttgctctgttctggacatacttcaggccagtgacttttttcttcttgtctgtttctctcttgcaatgggaatgtctgtcctgtgctatcccaccactgtattttggaagcacatagcttgtttgattttataggctcacagctggaggggaatttgcctcaggatgaatcatgccttgactgtcatccatatctggtttagatgagactgtggacttagactttaaaactgatgctggaacaagttaagactttttggggctattgggatggatgcactttgcatgtgagaagaacatgaattttgagagccagtcaccttcagagaacaacagggaacccattcattatcttgagaactgagaaataggctgggtgcggtgcctataatcgcagcactttgagaggccgaggtaggtggatcacttgaggccaggagttcaagaccagcctggccaacatgggtaaaccccatctctacaaaaactacaaaaattagccgggtgtgtggtgcaggcctgtagtcccagcaacttgggaggctgaggcagagaatcgcttgaacctgggaggctgaggttacagtgagccaagattgcgccactgcactccagcctgggcaacagagtgagactctgtctcaaaaaaaaaaaaaaggccaggtgcagtggctcatgcctgtaatcccagcactttaggaggctgaggcgggccgatcacttgaggtcaggagtttgagaccagcctggccaacacgatgaaaccccatctccctactaaaaatacaaaaattagctgggcattgtggcgggtgcctgtaataccagctactcaggaggctgaggcggaacaatcacttgaacctgggaggtggaggttgcagtgagccaagatcatgccactacactccagcctgagcaacagagcaagactctatctcaaaaaaaaaaaaaaaaaaaaaaaaaaaaaaacctgagacracaaaaaaagaaaactgagaaataaaatgaaagcattaagctggctcttcctatatgtactgtgccactggataaccaaatagtggatgaatagaattataaaatcttcttataaaattatttcagcttatcaaagccaaatgagttttgattgggcttggtttttgttttgttttgtactgtttttagtgttctttggtgaattaagagtattaacatttcgttaccaccagtgaattgctggatagaggcattgagcaccactggctactaacatcaaaaaagagacaaccagaaatgtggctcctaataaaaaggtacaatgccacttgtagtattgctaaaggggttgaacctgggtttgagcaagcctctggatccagtgccagcatgcaggaagtgcaggtgacaggaacaagtgagctctccttcaagtaatgcatgcagtcagcaaaattgagaccatgagaaactctggtcagatgagtcagggttttcaacaaataaattgtaaagaaaagatagaggggaaccagcagatgaaatgagaatcaaaagacctatcaagccaaaaacttaaggacaaaactaaaaactatggcctctaaggatgtgtactgaggtgataaaaccataaagaaatgctcagatgtgatttctacacaaatcaagactgaacttactttttgaggaagcgttggaatgggggacacagagaggcttttagggggcttgcaaggttttgtgtttgatccaggtggtggtgaacaggatacttgccttgtaaaatgattctctaaactacacatttgctttgtgtgctctgtgttttgtttcacatgtttaaaatgttggctagagctgttctctgggtgctrtgggagcccaggggaggcacttaatttctgaggggagaggataaggaaaggtcctctgaaaggttattattgggagggtgagggtaggttgggatgaatgtcagagatgaggctagagaaaaagacaagctcacaactgatcttctgtactaggcttgacccaggactccatggggaaccactgaggaattttaagccaacaattgacaagatcagaggtgtattttagaaagatccccaggtgcggtggctcacacctataaccccagcactttgggaggccgaggcgggtggatcatgaggtcaggagattgagaccatcctagctaatacggtgaaaccccgtctgtactaaaattacaaaaaatgagcagggcgtggtggcgggcgcctgtagtcccagctacctgggaggcagaggcaggagaatcgcttgaacccaggaggaagaggttgcagtgagccgagatggcgccactgcacttcagcctgggcaacagagggagactccgtctcaaaagaaaaaaaaaaggatctgtcatagtaatccaaaccaaagaagtaatgcagggacagggaggatagtgaagaaagtaatcataggagagattgcttaaggaggcagaaacacaggacttcagagagtatctggggtagagagggagggaaggagggagaaaagaaatcaaggaggtttctctagttctgacttgggcagctaggtggaaaatgatggtgttattaaccaaggaatacagtacaggtggtggagcaagaatggggagagatgataataaatactattttaaaaatggagatgatgtttacatgcaatgatatgcacagagctgaagcatacaatccagggaggtttctatttttttattttttattttttgagatggagtctcgctgtgttgcccaggctggagtgcagtggcacaatctcagctcactgcaacctccgcctcccgggttcaagtgattctcctgcctcagcctcctgagtaactgggattacaggtgcacaccaccatgcccagataatttttgtatttttagtagaggtggggtttcaccacgttggccaggctggtctcaaactcatgacctcaggtgatccacccgccctggcctcccaaagcactgggattacaggcataagccactgtgcccaacctctggtgagggtttttagatgtatgcacccatataactaacacaccagtcaagatataaaacatttccttcaccctaaagttccctcgtaaccccttccagttaatctccaccttgctggcaagcaccgttgtattgtgtttgttttttgagacagggttttgctgtcacccaggctggagtgcagtgacaccatcagcttattgtaacctcaaactcctagactcaagggattctcccacctcagcctcccgagtagcttggactacaggtgcacaccaccatgcctggcaacattttttaacttttttgtagagacggggtcttgctatgttgtccaggctgatctcgaactggactcaagctgtcctcccacctcagcttcccaaagtgctggcattacaggtgtgagccactgtgcctggcctaagcactgttttgatttttatcaccatagactagttttgtcttttttgttttgttttgttttttgagataagagtcttgctctgtcacccaagcttgagtgcagtgatgcgatcatgtttcactgcagctttgatttcctgggcttaagtgatcctcctacctcaaccaccctagtagctgggactacagttgtgcgtcaccacactcagctaattttttgttttttgtttttttgttttgttttgttttcagagatggagtctcagtatgttgcctaagctggtctcaaactcctgagctcaagcagtccacctacctggacctcccaaagtgctgggattataggcgtctgccactgcgcccagccccagcatattatttttgaggttcatacatgttcttgtctacatcaatggtttatccctttgtattgctgaatagtactctattgtacaaatacaccagaacttgtttatccacacttctgttgatggatgtttgggttgtttccagtttgtttgtttgttttactattatgaatacagctgctgtaaacattcttgtgtaagtctttttgtaaacacctattttcatttatcttgtataaataactaggagtggaattcctgggtcataggataggtatgcatttaactgtagaagaaactgaaacacttttctaaagtgattctaaggccaggtgcggtggctcatgcctgtaatcccagcactttgggaggccaaggcaggcggatcacttgaggtcagaagtttgagaccagcctggctaatatggtgaaaccccatctctactaaaaatacaaaaattagccaggcgtggtggcgcacgcctgcagtcccagctactcgagaggctgaggcacgagaattgcttgaacctgggaggcagaggctgcagtgagcaaagatcatggccactgcatccaaaaaaaaaaaaaaagacatctctaggagttactccatgatttttcaacctactagtgaaggtcttttgccaactttgttttgtgtttcactatgtcttctcccctcttattaaactatcagcaacttgagcacagagaccatgtcttaataccgatttattaatattttctcttaggacctgttacataataaggcttaatagatgtctgtcggatgagtgaatgaacaaaattaaacacagaagttaagtggaaaattagaataaattttcatagcaggtgatccctactacatctgatgaagtcttgccctgtacatgtgcagcccagccttcagcctaggaactgcccctcctccccaccccctctgtgctattcactttattctggtaccttgcctcacaaatgccagcctcttcagcagcacagaactcaaatctgcctgcttggtgggactgccactctgcttgggcaccatcttcttacaccatagtaagaaagtgcctcagaatgaatgccaggatgttcttggcactcacctcctatgtttcctttctttcaaaaatcacagtcttttttttttttagatggagttttgctcttgttctggctggagtgcagtggtgtgatctcagctcactaaaacctctgcctcccgggttcaagcgattctcctgcctcagcctcccaagtagctgggattacaagtgtgcaccaccatgcctggctaattttgtatttttagcagagatggggtttcaccatgttggtgaggctgttcttgaactcccgacttcaagtgatccacccacctccgcctcccaaagtgctgggattacaggtgtgagccaccgcacccggccaaaaatcacagtcttgagcagcttgctgctcagtgcctgaaaacacatattcacttgcctcatatattttgtccagctttatagttgtttatggcaggaagggaatatccagtttccgttattctgtcatggcctgaagtggaagtcagagttccattttggacatgatgttgagtttttgttatctatggaacatccaggtagaaatgcccaaaagagaattgggtattcacgtgtggagctagaaagatgattggggctagacatttggattttgtagtcatgcatttccagtggtagttgaagccaagggaatggatgtgattgctcagctacaaaatggatagagaatgagtagaagaacaattttctcttaaaaagcctgagaggccaggctcgatggctcacgcctgtaatcccaggactttgggaggccaagatgggcagatcacaaggttaggagttcgacaccagcctgaccaacatggtgaaaccccgtctctactaaaaatacaaaaaagttagctgggcatggcggtgtgcgcctgtaatcccagctactcaggaggctgaggcaggagaatcacttgaacctgagaggcagaggttgcagtgagccgagatcgcaccactgcactccagtctgggtggtagagtgagactctgtctcaaaaaaaaaaaaaaaaaaagcctgagaatgtataactaaagaaataaacgaagaacaggaaacatcagtgtcatagaagccgccataaataaactggtgtccatcttggggagtggcagatgtcaggagcccagcctttcccctattatgcttaacagtccagagcccagcttttctctctcttttttttttttttttttttgagagagtctcgctctgtcgcccaggctggagtgcagtggcgcgatctccgctcactgcaagctccacctcccgggttcacgccattctcctgcctcagcctcccgagtagctgggactacaggcacccgccaccacgcccggctaattttttgtatttttagtagagacggggtttcaccatgttagccaggatggtctcgatctcctgacctcgtgatccgcccacctcggcctcccaaagtgctgggattacaggcgtgagccaccgcgcccggccgcttttctctcttagtaaagtctcgctggtgatcattagagaagaacctactcatctgggctccagtacaaatctgcagaattaaagccacgccagtcttgaggaagctcagcatttcttccagacataatcagacatttgtgctcctagccttcttggggcttagataactgacaagtatgattagcattttcataaaattgagaggatacccaaggctctagagaggtcaacaatttgatgaaggtcagttgtttctagtcctactttatttatttatgagatagggtctcactctgtcacctaggctggagtgcagtgaagcaatcttggctcactgcaacctctgcctcccaggtccaaatgattctcctgcctcagcctcctgagtagctgagattacaggtgcccaccaccacacctggctaatttttgttttgttttgagacagagtcccgctctgttgcccaggctggagtatagtggcacgatctcggctcactgcaacctccacctcccaggttcaagcaattctcctgtctcagcctcctgagttgctggaactacaggcgcacgcccccaaacccggctaatttttttgtatttttagtagaggcagggtttcactgtattagccaggctggtcttgaactcctgacctcaagtgatccacctgcctcggcatcccaaagtgctgggattacaggcacgagccactgcagccagccaaatttttgtattttttagtagaggcaaagtttcaccatgttggccaggctggtctggaactcctgacctcaagtaatccacccaccttggcctcccaaagtgctgggattataggcgtgagccaccatgtccggccatagtcctactttctagttgtctagagacttgggtttcagacttggaagttgctmtaggtcatctacttggccctttgttttttaagtgggaaaattgacactcataaatgagagaccttgaactaggtataaaaacaagtaaatgaagccagcttacatcatcagggatatctgatggcattcaaagggcaaggataaagctgagctttgagaatagactagagctatgacctgcagtgctatagagaaactggatgccccttgcttctgcccttttctctgcttttttctgtgtctctaatttattcttttctcaatgtagatcagcttcttctgtcttgtctcctcctatgccccagcctggggaaaatgatcaccagaggctattcctgagtttatagcttagaaaaggggccactcattccccaccattcaggaataaggccatcctgattctagaattgcaactcctgttctcctggaaaagggctcgatggcccctttagaaccatccagagtccaatcagttgcagtcaagaggtcggggatcctttgttctacatatacatctgctgggaaccttacctctataatcatgtgatataaatcactggtaggggagaagaagattttccagaaaaagcaagtaggtagatggctgggcagccagcccataggtgttcagaataaccaattaactgctcaggataaccaatggcagagccaggaccaaaacccacagcatctgactcagcagtagtctgtcctggggctgccccacgtggggaaacagtaattacttgatctgggaacaagcagagacagacagatggacagtcactgcctcagttctcattcctaatagtgtaaagagatagaggtctcttccttgagagtgtaggggatccagagctctaggaccctaacagccaaaggtgggttccctcttagaagtccagactcttctagttgcaagtcacagaagcccaaatcaaactagcttgagcaaaagggggatttagtagaaggccattgggatatcctacaaaattgaaggaagaactgtagattccaagacatctttaagaatctggaatcagtactatcaggatacacacacacatgtgctcaccttgttttcttcctctttttaaaggtcatctttctgtttggctcttataccagaaggtttcctccacatggtggtgaacctggcagttccggagtcgtatcctttttttttttttttttgagatggagattcgctcttgttgcccatgctggagcgcaatggcacgatctgggctcactgcaatccctgcctccctgggttcaagcgattctcctgcctcagactcccaagtagctgggattacaggcatgcaccaccatgcccggctaattttgtatttttcatagagacagggtttctccatgttggtcaggctggtcttgaactcccaacctcaggtgatccacctgtctcagcctctcaaagtgctgggattacaggcctgagccattgcgcccggcctggagtcatatctttataacatctgaccatagagaaaagagagtcttccttgctaattcctggtggaaaaatctagagtaggattcacattgaaaggatggagtcctctgactggctgagccttgtttatttgctcacccttgggctcaggagatggcagggggtattttaagaaagggactggaggccgggtgtggtggctcacgcctgtaatcccagcactttgggaggccaagccgggcagatcacctgaggtcgggaatttgagaccagcctgaccaacatggagaaacctggtctctactaaaaatacaaaattagctagttgtggtagtgcatgcctgtaaccccagctacttgggaggctgaggcaggagaattgcttgaatctgggaggtggaggttatggtgaggccaagatcgcrccactgcactccagcctgggcaagaagagtgaaactccatctcaaaaaaataaaaaagggggactggtaagtaggatagacagaaatctcttttgttttgtgtctgtctcctaggtgmccatggaggctggtggcctccccttggagctgtggcgcatgatcttagcctacttgcaccttcccgacctgggccgctgcagcctggtatgcagggcctggtatgaactgatcctcagtctcgacagcacccgctggcggcagctgtgtctgggttgcaccgagtgccgccatcccaattggcccaaccagccagatgtggagcctgagtcttggagagaagccttcaagcagcattaccttgcatccaagacatggaccaagaatgccttggacttggagtcttccatctgcttttctctattccgccggaggagggaacgacgtaccctgagtgttgggccaggccgtgagtttgacagcctgggcagtgccttggccatggccagcctgtatgaccgaattgtgctcttcccaggtgtgtacgaagagcaaggtgaaatcatcttgaaggtgcctgtggagattgtagggcaggggaagttgggtgaagtggccctgctggccagcattgatcagcactgctcaaccacacgcctgtgcaacctcgtcttcacgccagcctggttctcacccatcatgtataaggtgggtatccacatcaatagacggcctttctagttctgaccccagaggcttgccctcttttctgggcttttaatccctttttttgttggaattgaaagttaagagttattattatactcatactcctctgagtgctgaaccagttgagaaacaggcacagtsatcagtagagttcagaattctgctttattcttggtaaagcagtatttaaaaatggcttgggcttggaaccaaaattcttttgcacctcttccctttccarctggaccaactggagccaccagtctagcagcggcgggaaagccaggttctggaagcatgccacttggtgacaggaagcagagagcccattagctgctcatggaggcatgcccagagtgagagccacagaggaaaaaggctatacaggactagtcaccttcagcacatgaaccccaccctgtgtgggatcaaggaagggcaggcttttaccatgatttgctagttctcaagggcaatggtgagaaggttagaaaatatttgtccaacatattccttccgtgaatgcagagccagaagatggttcaaagtaaagcaggtatccaggtgttggtagttcctggcagaacagtctatagcttatacattgcctagaaacttggattatgtaggtagtcaataaaaattatatcgctttcctgcctgctcataaaaaataaaagatttttggccaggtgcagtggctcacacctgtaatcccagcactttgggaggccgaggcaggtggatcacctgaggtcaggagttcgagaccaacatggtgaaacctgtctctactaaaaatacaaaatcagcggggcatggtggcaggtgcctgtaatcccagctactcgggaggctgaggcaaaagaatcgcttgaacccgggaggcggaggttgcagtgagctgagatggtgccatcgcactccagcctggaggacaagagtgagactttgtctcaaaaaaaaaaaatcatatatatatgatttttaaaagtatattgccaataacaattgtctctcatgtttgtaatgatccttataccactggtcatttgtgacagatgtagtgtgtgcatgccatatgccttatagccattatctcatgggttcctctccacatgcctctgagataggtaatgtcatctgattttatagatgagaaaactgaggctcagcaagattaagtgacatcaaggtctcagacttagtaagatccaaagtctattcataatctaggtgactttccatctgtgacctcattggacccccacagcaaacatttgtgtaggtgaagtagatgtggtatgcctattttgcaaatgagggctactgaaggtcacagttggtaagtaactttctcaagtgggtaattagggaagttagatctcaaattcaggccttctcatctaaatgcttataaaattacatcatgctatgttacctgaaagcttaaaagcttgtgttttagccctagagcatttcagaagaactgatgaacttctctggtgctggtctgcaggcccagaaggagagtttgtttctagaaagaaataatgttccagacccttcacattttgtaatacatttattcttagagtaatattttgatttcagcctctacttctccctcagaagtatagtcatagatcctcaagggatgaggcctggcgttagacttgtttgtagcctgccctgtggcttagtgcttagcatataacatatattagttagtgttcagtccatgattgtttttcaactaaaggagacatgggggcctgggatggctttgcctgaaaaatgcaaaggccaaggcgatttcacagcagttttcagtgacttcyaaggagaaccttagcagtggctctgcatctccagagagctggcttttttatctttagagagaaaatggatttaaatagcaaggaaaaattaggttagccataaggaagaaattagaaaagttaagggggcttaaattctgggacaatctatcaaaggtcaattttaaaacttattcaaggggtaggtacgtctggattattaaatggaatcatgagatactccctcatttgatgattcaaatacatctgatgaaatatgtataaaatccagaaacagctctttttcaggaatagagagtgagtgggcctcaccaagactgcttctcagttgggcccacagagccaaggggcccaaatgaattaggcaggagagtttggcactgccccatccccactccagactcttgaggacactctgctccttgtgtccctgaccccagatgataataactgacttttattgagtgctaagtttgtgcctagcatggtgctttgtgaactagtgagccccatgctgcagacaaggaaactgaggcttaaagaggtgaagtcatttgtccaagataacacytgcagtcaacccccggagcccatgctttttttttttttttttggacaccgagtcttgctctttcgcccaggctggagtgtactggcgcaatctcggctcactgcaacctctgcctcccaggctcaagctattctcattcctcagcctcccaagtagctgggactacaggcgcacaccaccacgcccagctaatttttgtatttttagtggagatgaggtttcaccatgttgacaaggctggtctcgaactcctgacctcaagtgatctgcccatcttggccttccaacgtgctggaactaygggcgtgagccaccacacctggcagagcccatgcttttaaccactgttcaatgcttcctggtaatggcagtataccttgtcccctctctttagagacatattttgctgtgcaccacgtgcatcagttgccacacagtcagaactctttgccagcacatgcggctaggcctctctcactgcctgtcctagccctggcacgtgattgagacttgaggttttaggaggagtcatgctgcagtgtgaacttttctgccatcatctacttgtctcccttcctttgagattagaaggatggaggtgcgggcagctccagtttccctccctctctgatgcagagcagctccccagttccttttggggacagctgacatccagaccccagtggggaggggaagatgatcagcagaacaaatggcctttccatgttctaccctccttaaagggcagctagagtccaaaaccaatctcatccctcttacagccgttttcttcttttcattccccagacaacatcaggtcacgtccagtttgacaactgcaactttgagaacgggcacatccaggtccatggcccgggtacttgccaagtgaagttctgtaccttcaaaaacacccatatcttcctgcacarcgtgcccctgtgtgtcctggaaaactgtgaatttgtgggcagtgaaaacaactctgtgactgttgagggtcacccatctgcagataagaactgggcctacaagtatctactagggcttatcaagtcctcacccacttttctccccacagaggactctgactttttaatgtccctggacctagagagccgggaccaggcctggagcccaaagacctgtgacattgttatcgagggcagccagagccctaccagcccagcytctagctccccaaagccaggctccaaggctggctcacaggaggcagaggtgggtagtgatggtgaaagggtggcccagacyccggacagcagcgatggaggcctgagtcccagcggtgaggatgaagatgaggaccagctgatgtacagactatcctaccaagtgcagggcccacgccctgtattggggggctcatttctgggcccacctctaccaggagcatccattcagctgcccagctgcctagtgctgaactcactgcagcaggagctgcagaaggataaggaggccatggcactggccaactccgtgcagggctgcctcatccgcaagtgcctcttccgggacgggaagggaggcgtcttcgtctgctcccacggcagagccaagatggaaggaaacatcttccggaacctgacttacgcagtgcggtgtatacataatagcaaggtgctgtcatgactttagattggtcagggggctcctgtgrctrtatgtaggaagggtttgatggggctattttgcattttaaaaataattttctttaaacttattcacrcacgcttgacgtcatgcccatcatctgatttggaaaggacagaaacgctttttctcatttcccagaaagagaggcccagagagagaacgtggcttactcagggtcacatagcaagttaggcagaattgagactagaaactcgggtctcctgcctcttttcactatgtcatgctgctgctcacatatctcaccatgtcggagtaggagaaacaaagcctggataagagaaaattcagggagatatgattactaccttcactccaaactggagtagggttgttgaggaaacgtctgtgctgggtacaatgagaagaaggtccagggaaaattggacacgtgataagaaggggtggagagtgagggtgtcccaacagcagaaacatcctacgccagagcctgggtgtgaggttgaattcaaccatgcggtggggctaggttgaaggatgaagctgggggtgagcaaaagctaccttacccagacctggaatcccccttgagacatttgggccttatgctaagaacagtccttctagccactgcgacaatcaacaccttctatgtgctgggacttagggyaccacaggacaatctgcaaatcctgtaaatggttgatgacaggaaggccttctgaagggaaagacagcccatgcagaagaaagcatggcatagcacctagattcgagtctcacctctccactaactcactatgaacatgaccttcactttcgtaaaatgaaaataagcatccctatttttcttctctcactggctattggaaggtcccatgccggaagtattcagtaaactaaagaacattgtacaaaggtcactcatgagtgttgcaggcttctaaaatggttaatagcaatcacattttaattaatttaaatttaattgtgttttacccagcccacttccaaagaggatttcaggtgatgttactttgaaagcataatgcaagactcctgtacacatacataaaagaaaatggccaaataaaaagggaaaggtaatagctttgctgtcgtgactaccacgatgaaaggatctggctcaagccctcaaggagggcattcttccttgcatagttattgagaatatggctttctagttaaagtctggctctgccccttaagtcggcagggtgaagacgcgaggcaaaggaggtgtgtgtgaaggcccagaagtaaggggagacacaccctttcaccctttcaagcaaggccttgatccttgctcccccacagaaggctgtcacctggctctgtcctctagaacatcccaggagggtaaaggctggcaggaggagcctggttgcttgaggctccaagaagaaaagtgtcagccgggtgctgtggctcaagcctgtaatcctagcactttgggaggctgaggcgggcagattgcctgagctcaggagttcgagaccagcctgggcaacacggtgaaaccccgtctctactaaaataaaataaaaaaaaaatagccaggcatggcagcgggcacttgtagtcccagctactcgggaggctgaggcaggagaattgcttgaacccgggaggtggaggttgcaagtgaaagccaagattgcgccactgcattccagcctgggtgacagagcaagactccgtctccaaaaaaaaaataaaaaaaaagaagtgtcaccgactgtgattttcttctttatgtgtcataaattttagttggaagtcagatatctcatgtaggacagtggggactgagctctgtagtatttagtttggaaatgggcacacctcttcttttgcctggctcttaggaggtcgatctagttaggagctgagcccgtttgaattatggtgatgataggattatcctcagcgtcccgtaggcttcagctctctccagcattacctcgtgctagttttctccgcttcagatcttcctttgtgcctgctgctcagaggcgatctccgctgctctcgccctccctcagcagtagactgccattatttgtcaccctacgtgatggcagggtttctctcttgtcctgggtcatccttagtctaggtaggtgctgtgtctgtggtcttgagagcaggactttttcagtgaccctggctctacccccagcactaggggacctctgatgatctgggcctaagtcactttcctcccaacacccccagagataagagtgttttcccgctgtttctctgtgcatacggtttgttttgtaagagagttagggggaaagaacacaggagaggggcttaatgcctctctcacttttgtccccagcctgcgtcaggagggtgctgtctccagtctctcatctgcccccagttttctccatgaacacctagtgaaggccacagagaagtgaacaggtgcagctactcccagagtttctgcactcacactaattcacagctggtctttaacagtgcattgaaaatgttagctgagttcttactggcttgtatgacacatgcagccctgcattcagcagggaagtgctcaggcctcgtctccttggaggcgcctgtctttctttttttgagacggagtctcactctttcacccaggccggactgcagtggcacgatctgggctcactgcacgctccgaaaggcacctgtctttttgtagcattcaggctagccggttgtccagcagcctcagctctgatgggttccaccagaaagtccatgtttgtgtatattctttctactttctccatcctaagcagaagctgaaaccttaccatttatactcttgttctactttagtcttcacagaattttgtcctaatgcaatatattattagtagtacacaatttataataatatattttattattaatctataattgtttaagacagcatagataaacattccagattttttatatattatcatgctttggtatccgtgggggcttggttccaggatactaaaatccacagatgctcaaatcccttatataaaatgttatagtatttgcacctaacctgcacacatcctcccacacttcagtcatctctagattacttataatacccaatacgatgcaaatgctatgtaaatagctcttctactgggtttttttgtttgttggttgtgttttttttgtttttttttttttgagacggagtctccactgtttagcccaggctggagtgcaaagatgtgatctcagctcactgcaacctctgcctcctgggttcaagcgattctcctgccccagcctcccaagtagctgaaactacaggcatgagccaccacgcccagctaatttgttgtatttttagtagagatggggtttcaccatgttggccaggctggtctcaaactcctgacctcaggtgatccgcccgcctcagcctcccaaagtgctgggattacaggcatgagccaacacgtccagcctatactgttgttgttttttttaattcaattttattttatttttgagataaggtctcactctgtcgcccaggctggaatacagtggcacaatctcggctcactgcaacctctgcctccctgattcaagagattctcctgccttagcctcctgagtagctgggactacaggcatctgccaccatgcctggctagtttttgtatttttagtagaaacgaggcttcaccatgttggccaggctggtctcaaactcctgacctcaagtgatccgcccacctcgscctcccaaagtgctgagattacagacgtgagccaccacacctggcctgtttttcaattttattatttattatttttaataatgtatattcaatccacagttggttgaatccatggatgcagaacccacagacatggggagacaactgtacttattaaacataaaaagaaaatgtaattggaaatatatccctttattagcaggttgctggttatgggaacttgtttgaaggaggctttgttataccaatatctctaatcatcccttcatttggagtctcagtagttttccaccccagggtgatacaccatgaaagatttaggatgtgcaagaacaggcctttgttttataaagtggaagggaaggtgggagaggagaacctgtgtggtaccttactgtccgtgccgtctcagacaggtggattttagtgaaggtgcattggaagtggtggacctggaactttatttcattaaaagtagctgcaccctcgacccctggggaaatcttcatgcaaacttagtgcatgtaaagtttgaagaccactcagtcccatcttcccctaagcgtcctttctatcccatcatccagctatgctgcttgcaggttctgaatatagagcacagggccaagctttggtccaggttttagttaaaggaccagtgtgggccaggtgtagtggttcatgcctgtaatgccagcagtttgggaggccaaggtgggaggattgcttgagcccaagagttccagaccagcctgggcaacatagtgagattccatctctacaaaaaatagaaaagttaacaacaaaattactccagcccacatccatagtaaaaataaaaataaacaaaaattcaaaaattagcctgtagccccagctatttgggaggctgaggtgggaggatcacgtgagcctgggaggcggagcttgcagtaagccgagatcatgccactgcactccagcctgggcaacagagcaagaccctgtctcaaaaaaaaaaaaaaaaaaaaaaargaaccaatgtgagaccgctaaggagcctgcagggcaaagccaggtagggcctggagatggctgtgtcctgggagcacacagtgggagcgtggctgtgccagcattgaggcgtttctcttgcctacggggtaaactgcatggatcaggtggtgcggaaaagactcaggtgttcctccagtggtttctaaaaaaatatttgtaacaggaaaataaatggctttctcttttctgcttaratcatcatgctcaggaacgacatttaycgctgccgagcgtcaggcatctttcttcgcttggagggcggtggcttgattgcyggcaacaacatttaccacaatgcagaggctggtgtagacatccggaaaaagtccaacccactcatactggtactttgtgttcgttccctattcagggtgactyttggttttcagaaaccatttgtgaggatatttaaatacacgttgccctcttgtatttacgtgcttcctgtttgcaggtggctcctgctctgtcctctgcgtgtccttgtgactctgtgtctctgtctgtgtattagcagtgactttggacaagtcattttctggtcatctccccgttaataaggaggaggaccagaaagacagggaaacctcacagggccctcagccctcatatgctgtggttggctttgagtttgataaggttaaagagagtgatgtctgccctaaagacacttggatccaacaacaaacaaaaacaacagcagcgaacccaccaagttagtttattcacttgtgtaagaggacatttcgggtatttagttctgaagattgtttcgtggttattgtgagggcatattgagtttgattttctacccgtgtgaaaaccacttaaaatcctagactgtgtggccagtgacacgagagaccagctccttttctgctctggctcttcctgagaagcaggtttggggtttgggggttttttattttgtttttacacagatttatggggtatgggaggaattttgttacatgtatactgagagacagatttcctaggagttgggaaatataacagactttttatgggcttgaaaaaataatagccaccattaatrcataatgcttattatacgccagatgcttttttaagcacttcatagatatttacttgtcatttaatgcttacagaaccctgtgaagaattattatcatccctattttatagtaaagatatagagcctgaagaggcagaggatcctgcccaaagtcctacacctagtgacagagctgggatttgaatccaggcagtctgactcacgggtaatgctgaacccaycatatcttaactgcccataaagatacagagagaaggctgggcacagtggcttatgcctgtaatctcagcactttgggaggccaaggcaggaagatcacttgagtccaggagtttaagaccagcctgggcaacatagcaagaccctgtctctacaaaaaattgtaaaaattagctgggcatggtagctcacacctgtcgtcccagatacttgggaggcggaggtgggaggtgggaggatcacttgagtctgggaggtcatggctgccataactatggcatggtcrtgagccatgattgtgccactgcactccagcctgggcaacagagcgagaccctgtctcaaaaaaagaaaaagaaaatacacacagctagccagtgtctcctgccaaccccttcccctcactgtgtttctaccatgcagctggtggttgatgcatggctttggcttaggaaattattgcccctctggctagagagatgaggggtttgcccttctgaggacagagggatagcaggtggagggggaagggagtgrtatattttagtcctggcgttgtgaaagggtgtagggatggaaatgctgctgcatactccttttggagctcttcagccctgtgcgggacttctcttaggcagtggttgctctgatgagcctgccaaatccttcaggaaaaatctggaaagagtaagaataaggagagtttgcacacgaaacactttaaagccaactagaactttatttctgcgaaatcattttggaagagatacagctaacttcccaatttacaaagtatagaattggacttcagctataaattaacttagagtgagataattttattattattctaatctaaaaatattaagtcactgtgcaaaagcaactaactggaatgggaaagagaaaaactagatttcagatctggcttttccacaaatgtactatataatcgtgggcctgttttcccattcgcacaaagagatattagaaatgaatatcttgccgggtgtggtggctcacacctgtaatcccagcactttgggaggccaagatgggaggatcactggaggccaggagttcaagaccagcctgggcaatgaagcaaaaccctgtctctaccaaaaaaaaaaaaaaaagatatctcttggcattctgtagctcatacaccttctaagaccttatgccccatgggacagcttggccccccagtgtctgcatcttccgctggccctccctaaatgagaaaggactagaagtcaaacaactgtgacccctctctggatgtggcccctttaggactgcagttggccaacatttggttgcactggggtgctgcctttcctcaagagatggcctccctggaccctagaagttatggcctggccaaatgattatgtgtttaggggactcattagaggctctgaaactttcagtagcctgccttgcaggtgaagaccaagagccctcctaagaggctgggcagcgaagactccagtcttcatagtctcccttacaggttttcatgtgtgtactggtgcaggaagggcagggcggcagtgtgacccattccctttgtcacgggctagggctcttacagtgacgtcattttctccactgtgttcatccygccgcggaggtgtgggcggcacctgggcactctgcttcgctgacgtgtctgatctggyttctgtggtgtctcattttcacttgcagtgtaaccagatccaccatggccttcgctctggcattgtcgtccttggcaatgggaaaggcatcatccggaacaatcaaatcttttccaataaggaggctggcatttacatcctgtaccacggaaaccccrttgtgaggtgtgtgctgctgtttccctccttcatctttgttaacctcctccctgtctctcctccatttgaaaacactctttacggaaacaactgtacagatgcaagcagagaagagacttcactcatcatcccaccccagtaacacagcggcttttktgtttatgtgcccttccagtgaactccgtgtaggcgttctattcggcagtcactactgagcacttccaacatgggcaggctctgctccctgggagcttactctagcctggagaaatgggcacagaagtacccccaggcagggatggaacagagatttcagctcacctaacagtttcagttacttgctagtggtgcctgggggtgctgtgtcaacatcctggtgctgcacctggcctcagcacaaaagcatgctgtggtcagggactgatataagtgataggtgggaggcagcagtggcagtcctgggaccctgtctgccatcccagctctagtatggggcagactgtrataaatgctgtcagagtggtaccagaaggagagactcattctgactrggaggatgtgggaaggcctcatttaggaggtagcatcagagtcagactttggaatatgggtaagacttggactcatggagataggggtagggaggggtcggtggatgttcctagtaatgraacagcatgagcaaaggcagcagggcacagcagattcaggggttagcaaacygttgacggtggcttgagaaaaaatctgacatggtgtgacagtgctatagaatattttaaattgggatggtcccagaatatcttgggccctgtggtcactgcagtgtgacccttgacgtccttgcggcagaccatctgtgccacacagcagagtggaaaggaatgatggaaagaaaggcttgggccagatgaggaaggccttatgtagaccaagctgaggcgggggagcctattctgtctacacagcggggactcattaaaggctctgagcagaagactcacacagttatgtctgtgctttaggagaatagctggcattaatgggcagcaagtatattcagagcgctttcccccagcattattccataggtactttgtctccatgttgttgcatgcatggcctttacattcatcactttggaaagtttcaccatattccagtatttcgatatgccataatttttgaaccagacctaattgctggttcaaaaattacggaatataatcctatttttcactgttacagacagcttactaaaaacaattagtggtcatagagctctttcccttcttctgcattattgcctgaacagaagagtgtgtatttgtatgtgtgtgtgctgttcattgaacacacattccagccactctatataagggggcagtgatatacaacatgtacaagaacagtccctgcctgccccatggagttgacagtcttatgctggagatggacacacactcacacagccatgatggaagactcaccaaaatgagcactttactaggcattcatgcagactgaccaaggaactcagccgtgatctcagctgagcatgtcagggagctgacatttgagttgtgcttgaaagataaataggattttatggccagggaaaaggcattctgggccagaggcagtgaaattcagggtatgtctgagaaaatggtgagaaatgtggtgtgtttggacacgagataccagagggatagtgcaaaggcaggttgttgctggacagcagaggaccttgaatgccaagcatgataggcagaataatggccccaaggatgtccatgtcttagtccctgaaccctgtgcatatgttgccttacaaggcaagaggaactttgcagatttgattgagtgaaggactttggagaaagatgaaaggaggttattttggatgatacaggtgggcccagtgtaaccacaggcccttatgagaaggaagcaggggaattagattaagagagcaggggccggggcggtgcctcatgcctgtaatcccaacactttgggaggccgaggcgggcagatcacttgaggtcaggagttcgagatcagcctggccaacacggtgaaaccccatctctactaaaaatataaaaaatagccaggtatggtggcaggtgcctgtaatcccagctacttgggaggctgaggcaggagaatcgcttgaacccgggaggcgaaggttgcagtgagccgagatcgtgccactgcactccagcctgggtgacaagagcgagactccatttcaatwaataaataaataaataaataaataaataaataaataaaatattttaaaaaataaataaataagagagcaggagatgtgaggacagaagcagaagtcagagtgatgaggccacagcccaagaagtgcaggcggcctctaggagctggaaaggatgaggagtggattctccccggagcctccagatagaacacaggtctgctgacactttgattttagccctgtgaaacccattttgaactcctggcctcctgaactgaaagatagaaatttgtattgttttaagccaccaagtttgtggtaatttgttatagtaacaataggaaactaatacaccaagctgaaaagtctgggctttaccttggggatgctggggaaccatgaaagagttttgggtgaggaatatcataaktagatcagtgttgggtttttaaaacatagtcatcttgagagaataggttgtgcttttttcctttgtttctttgcaatgagagataagagtctggagcaggatacggaatgaagtttaagatccctgtaatggcctggatgagacaaaccataggatctatttttgccacagaaagttatattttttgtctttttatatgttatatatgtttctcttttttccttggatgcagagaagcacaggactcaaattgtgctcatctgcagttaatatcccatcctgggctcttggtacactgatctgtccccttcttctaagtgttttctcatccctcctgtatctttattctgcttgccccatgtacacacatacacacacttctccaggtggccacggatcctttctggaggtgagatttgtagtaaaaatatgccagggctcagttactcatgctggtagtcccagctacttgggaggctgaggtgggaggatcacttgagtgcaagaggttgaggctagcctgagcaacatagcgagaacccatgtcttaaacaaaaaaattgtaaacattttctggttcaaacatttgagggttggataaaatacatataaggccaggcgcggtggctcatgcctgtaatcccagcactttaggaggctgaggcggatgggtcacttgaggccaggagttcgagaccagcctgggcaacgtagcaaaaccccatctctacaaaaagtacaaaaaattagctggatgtggtggcgcacacgtgtaatccaggctgaggcacgaacatcgcttgaacccaggaggtggaggttgcagtgagctgagattgtgccactgcactccagcatgggcaacagagcaagacctcaaaaaaaaaaatgtatatatatatgcatgggtatatatgtagatgacagtcaagtgaggctacagtgaactggatatcattgtgcgtgtatagcatagttgggggtttagtttttggtcaagctgtcccagtgacaactaaacatttctatatgcctggcttataaagggactttaggaaatgcttttatgcccctgtggacttgagccatagggaggctcaagtgatcctccaccccagcctcccaagaagctgggactrcaggtgcacaccaccacacccggctaatttttttgtattttttgtagagacagggtttccatgaaagaaggcagtctcctggaagcatgacattgatgccctgggctcacctctttgttttgttttccttccactttagcgggaaccacatcttcaagggccgtgctgccggcatagcagtgaatgagaacggcaaaggcctcatcacaggtacggatgggaactgcctggcacctggcagccaggccaaggtcccctggcgtcaccccccagcttcaggacctcacactgctcctttacccccacagactatggcctctttctctgactggtgggctggagctcagggacgccagctgcatggtggctgtgcttcttacaggagggcctaacacagagtgggtgtctgctccttccaggcccagagccgacaggccctcacaaggtggctcacagaacagtttcagaagcactgatgcccaaccacctgtccaaatccctcctcttggtctttgtgcggacctctgcctgctytggaaacctccgcccggctaacccctgcttatcctttgggtcttagcttaactgtcacttcctcagggaagccttccctgacttccccattgtacacagatacactcactatacccaggatgcctcctctctagggcctttgacttaatttcttagtggtttgtggtgtccgtctcctctgttataaagtggtaaattccacaaggtgagggtcaagtccatctggtacatcaatgtagcctcagcacagagcagagccaggcctgggatatgaaagggattccgcaaatactggtccagggaatccccctgactgaacttatcagacatggattgagcacgtgtggtatacaggccgtgttccaggagctacaagtgcagcagtgaacgaggctgtcagccactgacattttaggagaggaagcgaataaataaataaaagcctaygtatatgagcaaaaaacatcccatctgagggtgacaagtgctctatggataattaaggcaaaagagggactgggtaggcatttgggattgtgtggtcagggcagccctctgagaaggtgacaaggaaaccagaccctgagtgggagtggctggaggagctgggaaagaaccttccgtgtagggccgcctgtgagaacagacttggcatggccgagtggacatcgcttgtgggactggagtgtggtgcacaaggggcctgcagtggggacatggagacaggaagaggccagtcacacagagactcctgagccattgcaggtgaggctagcgccttctcacaggcttgtgggtaaatggccacattctgcctctgaggactctaaagccagtttatttatttattttttttgagacggaatttcactcactcttgttgcccaggctggagtgcaatggcgcgatctcggctcactgcaacctccgcctcccaggttcaagtgattcttctgcctcagcctcccgagtagctgggattacaggcatgtgccaccacgcccaattttgtatttttagtagagacggggtttctccatgttggtcaggctggtctcgaactcccgacctcaggtgatccgcccgtctcagcctcccaaagtgctggggttacaggcgtgagccaccgcacccggcctattctttgttttgtttcctttttgtttggttggttggttttttggacaccagtgtcactcaccaaagctagtttattcttttttttgaggcagggtctcagtctgtcatccaggccagagtgcagtggctcgattatagcccactgcagccctgacctccagggttcaagtgatcctcccacccagcctcccaagaagctgggactacaggcacgcaccaccacacctggctaatttttttttgtatttttttgtagagacaggatttccccattttgcccaggatggtctggaactcctgggctcaagtgatctacccgccttggcctcctaaagtactgggattacaggcatgagccaccatgcctggccaaaactagttcatttttaatcatcagtcctcaaggccattgggtatagtaggtgccggggagataggagtgcacaagatagacacaagccttgcccttggggaaaggagtcagcagataagtccctgaaacatcagacagcagacaagatttacagtgctaattgctggcagggtaaggccagggccttctggtctggagtagccttgatcaaaactgtccaagtcctatttgccagcactggagctggcccttgggtactgaccttcttttctgcttctctccatagaaaatgtcatccgtgagaatcagtggggaggtgtggacatccgccgtggagggatccccgttctcaggagtaacctcatctgctttggctattcagatggtgtggttgtgggagacgaaggcaaaggcctcatagaaggaaataccatctacggtgaggagcytgttcccaacccagccggggaggcaggaagcccaggttccatctccagcttgtgggtcctgagaaggtcactgcctttccctgtgcctcaaagacctcatctgaacaggcactctcaggccacagtcacccaggccctcccagaacaaagagcctcttacaaatcacattgtagtccagattgaccccgtggggttagcaaagcagaaggctttatccccttttaaaatagcaaaagacaggagttgtgtcatgtcttaaggacaggaccatttcagccctggctcatgtgcatctaactcctcttatcctttcttttgatcccagagaacggaaaatataatgggaaaacaagataatcacaggaagaaaactcttctcactcacgcagtgactttgggcagagccttcatctgtctggactctatctctaataatacrgtgataataataaagatgactcaggcccacctctctactcagccctttctatgcatgatcacatttaatcctcatgactgccttctgaaggaggcacggttattaaccccatttaaaagatgagaaaactgagggacagagagaggtctggtaacctgctcagggtctcacagctgggaagtggtagggctgggattccaactgaggctgcctcctatgcagggagggattggtgcccccttggcactgtcactgtgggctcatgtgcttctgatgtggacatgtggcctgacagtcctcagagcactttcacactgtgtggaacgagccgagcttgtgaggttcacctgatcctgatgacctctcttgtgtgaaggtgaagtctgcagctagagccatcaggtggcttktccgaggtcattagcaaggcagggactctctcccaggccagwggcttttgtttcccctctcagggagactcaggtgccgcttcacctgagttcagtgtcggtgaccagctcctctcactgtcccagctaacaagggctgtggtgtgtggatgatgtcgtccagcctcccccatgtcaccagcaaycacgtcagctacaatggcctgtatggagtggcagtatttagccagaaggatggctccagcgagttacctcgaggccacagggctcaagagaacttcagcgaggatggggacgccatcctctgggagacagagctggagaaggaggacgacccactgcgccggcccatcaccatagctcttgttgagtctaacagtattaatcacaatggaggtgagtataccccctcagcccctgctcaagaaccttccatggctccccactgtctttttttttctccaatttaaaacttttaatttaatttaaatttaaaagtaaactttaatgtcaaagatgcaaacctgggtagggcagaaaaatcacacacaaggttgccacttcacacttggagggttgcacagcggccaggcagaggcgctcctcacttcccagacagtgtgggggccagggagaggcgctcctcacttcccagacagcgtgggggccagggagaggtgctcctcacttcccagacggtggggcggccgagcagaggtgcttcttatttttgagacggtgcggccgccaggcagggccttctgcagactgatcccaacttgccctcaggcctcatcagccacttcttccagcctgatccccaatcctcctgtatttattcattaaacttgaatccattctttcctgcctcctaacctgctgacctcactcatgcctttctcccatccacacgtcccaaactaacttgaacttcaaaacctgttgtgaatatcccccttcattccttcctcctttgaactgggccctccccatccccactggcacttgttatgaggcctcgcgactgtatttatttctgtggctgtttcatcaacactgataggccaygaacttgagacaaagaactgaagcccacccagctcagtgcccctgtccctgcagtaccaaatcccacctctggcacacatgcttttaatcaactctaggatacatttctcaaaattcaacatctcccacgagatgcatatcatggtttaattggcagtgagttttccttcttagagaggcagaaaataaaagtgttttaaatccatgttatcctaaacctgatgaaaaatggaggccaggtgccagggatcaagcctgtaatcccaggactttgggaggccaagactgggggattgcttgaggccaggtgttcaagacccgcctgggcaacataacaagacttggtttctacaaaaaaaaaaaaaaaaaaaaaagaagaagaaggagtagagaaagaaaaattagttggatctggtggcatgtgcctgtggtcccagctactcaggaggcgggrggatcgcttgagcccaggagttcaaggctgcagtgaggtgtgattgcaccacggtattctaggtgctcagagctcaggagtgacaggagcaagaccctgtcttaaaaggaaaaaaaaaaaaaaaaaaaagatggtagaagatgtttgatatttcttgaattaaaaaaaaataattactgtgtagttcacctaactccagggctcccaaagcctcctgattatcaaaatcactgtggggtgggggtgggagggtaggatggatgggtgggtcgggaaatggaggaaggcttattcagaacagattcctgggccaggcgcagtggctcacacctgtaaccctaacactttgagaggccaaggcaggaggatcgcttgagtttaggagttcaagaccagactaggcaacatagagagacctcaatctctactgagaaaaaaaaaatttttttcagattagctgggcatggtggtacatgcctgtagttccaactactagggaggctgaagtaggaggatgcttgagctcaggactcagagttcgaggttgcagtgagctatgatggtgccactgcactactgcctgggcaatagagcaagaccctgtctctaaaacaaaataaaattaaaagagattcctgggcctggtaagcacttgcttctggtagtggtagaggacagggagatggataaccagcagccccaacccacttattcagaaaatgagttctgtcccctcccaggtcagaggttcctccatgtggccatgctgtctgtccggtacgacaggcaaagccacctacgttcacaaatacttatttttgttgttctcaaccaagccaggagaagcaacaggctggtgccaccaagagatttgagcttgcaggctcatggctccagacactgctgcagggccccagtcattgtcctgcacacaacctcccccagcactgccccaacccttgttgctgttgtggtgggcagagggacctaccgcagagccctcctctcctcgcccccgggtctggctgccctgctttcttttcctgacaagccatggagctctaatcctgctgacttggggtttttctcctcatgtacctagtgtctctaagtacacacaaccgcaagcgtcagttttcctttcccaaatttcaaacacatttttgacacatattactcgcttagtaagtttttgtactccaaaattacagaactwacattaagaagaaaatttccggccaggcatggtggctcacgccygtaatcccagcactttgggaggccgaggcrggtggatcacgaggtcaggagatcgagaccatcctggctaayacggtgaaaccatgtctctactaaaaatacaaaaaattagccgggcgtggtggcgggtgcctgtagtcccagccactcaggaggctgaggcagaagaatggtgtgaacccgggaggcggagcttgyagtgagccgagatggcgccaccgcactccaacctgggcgacagagcgagactccgtctcaaaaaaaaaaaaaaagaaaatttccccaaacagtagggaggcagattccaggttagtgtaggaaggagagcaaagcaaaaccctctaatgagtagatctgcctgtccagagggggagtgagcagccttgaggcggcagtgagcaccccgtyagggaggtgtaagyggcagtaggatggcggtggtgcaggaggcattcaagcacacggtgggagctcaggccagaggagccttctcacatggtgtttccctggctacactgaataaggacttcatgcagaagaaccagagttttgttgacgcacctggatttcctcctgctgtttcatcagcttggaagacgcaaactcaagggttgtttctgagtgttggtacctcttcttctccactccgttcycccggagtgcacaattcagggaaggcttttcctgactggtggtgtcagggctgaccctgggaccccctgtgctttccaacccttccacccatagcctcaggactctatgtccagagcagcgaggcactgcatgtcatcaccaatgtgatccacgcgaatggggacagaggcattactgtggcccagagcagccaacccacccgagtggccaacaacagcatctcctgcaaccggcaaagtggggtcaaggttgaggcccagtgcaaagtggagctccggggcaatggtatctatgacaasagaggccacggcattatcaccaagggcgacagcaccatcgtcattgaaaacgatatcattggcaaccggggcagcgggctgcagctgctgcccaggtccgacactaaagtgagtatgtctgcatgtgtgtgacgtgtggtgcccacacagggcacaaccctgggatagtcctcgtggcctctgctgagaacagaaccgtaatcactcagcactacaagggacagtatccctcctgccaggactcagcctgggaaatgtgggtgggacttcccacagggggggacggagaagctgagtcctgaaggatgaacaagggctcaccagcaggaagccagggatggggtgtcccctccttgtcatggtgttgggagcctcccgagttatcttcatggtctccgggtcaaggtcaggactatttcagctctctttccttaacagaataatcatgcacagtgcctgctgtacagtagatgcttcatgaagagagagatcctgccttggggcctttgcatacactcttccctatataccctgcatacctcctgccccccttgcactgcagtcctgcagcttagctgtatctttgttcaggaagagtccctgagctcccacctcccaccccaggctgtttgagttatctcttgtctagtgcttttgtccacacatacctcacagagcactccccacagggcttggtcctcacagagcactccccacagggcttggtatctcttcctttacctatttgtctccccaccggactgagctctgarcacctttctatgcagagctccgtttcactgtggagccaaacagatcttgttcctgcccttatggaattacgatcccaagggctctatttttatttttagttcaacagtttttggggtacaggtggtttttggttatatggataagttctttagtggtgaattctgagattttggtgcccctgtcactcaagcagtgtacactgtacccaatatatagtcttttatccctcaccctgctcccacccttccccctgagtcaccaaagtccattatatcattcttatgccttttcttcgtcattagcatagctcccacttataagtagtgagcaagtaaggacataggatatttggttttccgtttctgagttacttctcttagaataatggcctccaagtccatccaaattgctgcaaaggcygttatttcattctgttttatggctgagtagtattctgtggtatatatataccaccttttttttgttttttttttttttgagatggagtttcactcttttgcccaggctggagtgcaatgacatgatctcagctcactgcaacctccgcctcccagattcaagccattctcctgcctcagcctccyaagtagctgggattacaggcatgtgccgccatgcccagctaattttgtatttttagtagagataccatgttggtcaggctggtctcaaactcctgacctcaggtgatcgatccacctgcctcagcctcccaaagtgctgggattacaggtgtgagccactgcacccagcctataccacatttctttatccactctttggctgatgggcagttaggttggttgcatatttttgcaattgtaaattgtcctgctatcaatatgcgtgtgcacatgactttttttcctttaggtagacatccagtagtgggattgctgggtcgcctaaagcctctttacagttctgcagcttcgtgggttagtgactttaggcaaagagtaaaaatgctggggctttgcctctgagcactgtgggagcagaggaagggagagagggacacactttcgtctcagttgggttgccagtggccctgacttctgacactgcctcccctctctgccaggcctttgcatattgtttctccttcctgcaacagctctccstgttgtgcatctgataaatgcctacaactcacctatcacctcttccaggaagccttccctggctcccccaggctgttcttggtgcccttctttgagctcataggctcttcactgacctgcctggcatgttcctgcctcttggttttagaactgataattcacttgcccagctctcccactcagtctgtgaatccctgaggtgtgacaatctctggctgcctctcccaggtaataaagaaccggatccactcgttccgggcctacggcatcgccgtgcggggccgtgccaaggccctggtgcaggaaaacatcatcttccagggcaaaaccagtaagaccatctttcagcagatctcaaacaaccgagaatgcatcatgcaaaacaacaagttcctggtcttcaagaaaaagtgagtgcttggggttgcctgaacgagtcctctagagccacagtaagctccctgaagaagccaggcccacacccagggattgtggctgccygggctccctgcaaccctgccagctgtcgactccagtcagaaaaaggcctgtgcctggctctatgtcaggcccgggctgaggactccccaggagggaacaagctttttaagagtcaggggtatgtggtttcagatctcagctctgcaggttactggctgtgtgaccttgggcaacttacttcacatcttcgagccttagtaaaatccatttaataagatcacactatctggctgaatctctgaggggctgtaaaaatgttagttgatgctgctgctgtcctttagtcactctgcctcaatgtatcacaattgccgccacccatcttcctcaaacctctctgtcctttcacgttctccatttcagcgacatcaccatccactcagtgttctgacaacaaaacttctgctgcctttttctccctaatccgaagatgtccagtcagtcagtcaccaggtcttgttgattctgcttctaaaatgttcctttttccagcacctcctcttccccaactgcccccatcctaattcaggtctcagcaccgctcaccctaacctgtaccgcctgtgttactgcaatgcacagctgttccagttgcttctgcttgggctgtgttctgattggtccgtgctttcgctttcacattctggttgtaaaatcatactgatatttgctgtagttggtatcactcctgcaccgccaatgtcacctgtccccctgcagcagcctcctgccagtctccctgcccgtggccaccccctgctccactctggaggttgtcccatgcatcctgccaggttaatctttctaagtgagagctctggtcagtcacatcacatccatggtttaaaacctctcatggatcttcatgttctgttgtaatgatctccatactttttgtattacacacactctcgggaaaaaatattctttgaagaaaccccccgatgtaggtatacctaattatttatttatttatttagagaccaagtctcactctgttgcccaggctgcagtgcagtggtgcgatctyggctcactgcaacctcttcctcccagattcaagcgatcctcctgcctcagcctcctgagcagctgggattacaggcgcccaccaccactcccggctgatttttgtgtttttagtagagacagtttcgccatgttgaccaggctggtctcgaactcctgacctcaggtgatccacccgccttggcctcccaaagtattgagattacaggtgtgagccaccgcgcctcaccggtatacctatttataacttatatatgtgtattctagcagtatattatttacattataaactatccccaaaatagaaaattttaaagtatacagttaaaaaaaaccaaaattctagtattttcttccaatatcccagcagattatattgtggactccctgggatccacctcctccttccctttggagaccccagggtacaggatacagcccggactttgccaatgccagctctggtattgtccgctgtgtaccctgaggtcctaattgtcttttccagcctctcatttcatcactccttttcagtagtgctcccctgctgccaaactcaaatacatacagtcctcccaacatagcttaggcctttttattcacatgctagtagccaacctctgattccgtccacacctttccagtcctttcattgtaacatcattatcataaaaatacatataagacaatgtgttgccttaagcaaatggagacttagtgtgtaaagttggttccttgtaactcaagcatcagaaaactctgaccacagcttcactatcattttattttccctggccctccatgctctctacaagagtttgggtgactggaaacccaccaacttctatcccccatagatttgcattttcccaaatgtcatataaaagaaatcgtggccgggtgcggtggctcacgcctgtaatcccagcactttgggaggccgaggtgggtggatcacctgaggtcgggatttcgagaccagcctggccaacatggtgaaaccccatctctactaaaaatacaaaaattagctgggcrtcatggcacgcaactgtagtcccagctactcgggaggctgagccaggaggatcactygaacctgggaggaagaggttgcagtgaacccagatcacactactgcactccagcctgggtaacagagcaagactccgtctcggaaaaaatatatatatatattaaaaaataaaagtaaaaacaaaaaaaacccagaaatcctgcagtatgtagtcttttgagtctggcttctttcacttagcctaacatgctggagattcattcatggtgttgcatgtaaggcgttcattcctttcaattgctgagtagtcttcccctgtatgggtgtactgcacagtttattcactcatcagctgaagcgtatttaggtagtttctagtttttggtgattatgaataaagcttctataaacatttgtggtcatagagctgaaaagaaatgaaagaggaaaagctggcaccgtggcacacacctataatcccagctacttgggaagctgaggcaggaggatcacttgagcccaggagtttaagaccggcttgggcaacataatgagaccctgtctcacaacaaccaccctatgatcttatccagatccttatttaaagtggagaagtcggctggatgcagtggctcaagcctataatcccagcactttgggaggctgaggtgggaggatcacttgagcccaggaggttgaggctgcagtgagccatgatcgtgccactgcaccccagcctgggcaacagagtgtctcaaagygggaaaattgaggcctacagagggaccttgtccaaggctacatgcagagttgaaggcagagctggacgtggaatgcagggcttttgctccttagtttctcaacagcccacctctttggactaacactaaactggaagataaaacctacacccagatttaaacacctggatccaccgatctggaacccaagttaagactgtgcagggcattcagccagcactgcacacccctcagaagttcactgactttygttttgcacctccaggtctgatacgtggcgcctggtgaacccaccagcacggccccaccttgaaaattctctcagacgtccctcggcagcccacaatgggcagaaggtgacagccatggcaacgaggatcacagcccgggtggaaggtggttaccacagcaaccgcagtgtcttctgcaccatcctgtgaggacacagacctgcttcagggccaagcctggatgggtgctcagaggagctaaggtggaaatactgcctgaaaagactccgcccctccccctccccctcgaacaaatgggtcccgggcctccaaaacacggtacctccagaacacttcagctccacagcccatagcaagaagaaagtgggcaatgtttttcagggagaagggatagaagctggtgggtttccagtcactcgaagtctataaagattgtgaagagcgggggaagctcaaatgctgaagcttttggtcagsattttctctgagttctaaggaactgtgttttacacacaccaaacccagactcttctcaggaaagagcagatttacttctgatggcgggaagtgattctagtgaggtggagagagacaactgctccagaattktcccctttgctagagctgtctccctctcaatccctccagggaccccaccacaccctcccagctgtctctggaggctggaggagttgagtttggttgacttgaggacttggacatggacctgggaggaaggaaggacctgggagcaacaggagaccccatggaaaggctgccccagggatgacaagagggacatgctgaaacaggtggggctgcagcgtgcaggcagatgctaggctgggtgggcagggatrcacaaggctctactccatccccagagagctcccaaatgcagaaggattcaaaccccatgtgagcrtgcccacaccagccgcccctcctgagcatcagcctgttcagatgagggtacctgggcctctcgttcgcatctgtgttctcatggatgagcgctggtctttactgaccctcccaagcctccccactctgtgccttggctcatgctctttcctcctcccggcatgcccttctcccccatctccgtgtcctcgttcctcaaggtttagccgagacactgccacctccacatagctctccctgccctctttccccctctgggcctcagtggcctttctctgctccctctcagggtactgagcactttctgccttgtcctggagctatctgggtccattgcctgaccccccactcacctgtgtgctccccgtaggtagggccacttctgactgtgtgtccccagatccagcctggggttggggtaggattagtggcctgagtgaggagaggaaggccagctcccagaggactttactgaaccgtactgtgaatatgtccaagtcccaaagccaggtgaggtcagaccccactgcctgaggaagagggctggatgcagggccagctcaacctgaacaatcccctcccactcggcctttcctgtggggccttcaccagcctgctggggtcactgtcgtgcacttggctgcgtggctggttctattggccctaggtgctgctctgttgggtgggatgggagggggtagagggagccaggagcactgggttctccctgagaacactgggcacaagagtactggcctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatattttaaaaaaggcacttttggaagcctttccttagtctgggcatatactggggctcccagctggccaggcccagcactgtttcctctgaaggagacaggagaatcctggggccatcttgttgggtcagcttgttcctgtgacagttccagatatagggctgaagggctcaatcgggctataattccactcctgcctgctctgtgaagacaacagaaacaggccgtccccatggatcactggactgtcagcttagggacctcagaccccggagcacacttccccaacttcacttactcagcatcttagaatttttgctatatccatatgtcacctgagaagttagtacttttttctttaaatctacttaatttttagaagttttaaatatgcagaaaaattgagcagacagatgattactagagttcccatatcacccttgccacccccgagtttctgtgttattaacatcttatgctatcagtgtacatttgtaaaaattcataaactagtactggcacattattaactaaagtccatagtttattcagatttttttctttttgaaacgggatctcactctgttgcccaggctagagtgcagtggtgtgatcatggttcaccgcagccttgacctcctcaggctcactcaggtgatcctcccacctcagcctcctgagcagctgggactacaggcatgcaccaccacgcctggctaatttatgtatttttttgtagagacggggttttgccatgttgcctagcctggtctcaaactcctgggctcaagtgatccgcctgcttcaatcccccaaagtgctgggattacaaacatgagccactgtgcctggcctcagatttctttagtttgttacctaatgtcctttttccattccaggatcccatcctacaacatgtctttttttcacacactgaaaagactttttatattactataaacatacattaaactattaaaatgaaaatattcattggttttggtagttactgtttgctgcccctcagggagagtacatgccctctcacgttgccatgggacctgatttgcccagtgaatgtaggcagaagtggttaatggtcacttctgggtagaagctttaagggccagcagaacttgccccgatcgtgtgtccctctgccagtggaccaccacgtgtcagacatggcagcccgagtcccggggtgaagctaacccggagcagggtcccaggtgcctgctggctgacagacatgtgccagacattcaacaaaagcaaatgaacttttgttgaaaccagacatttgagggccatttgtcacttcagcttagcctaaccagcagaacacaagtactttactacatccctgagccacctaaaatcatcgtaagttctgtcaataatgtattaaacattgacttggtgagctcattgtccccattttggaggctgggagtgctgatgctcctgagatccggcaggggaaagttccctatcagatgtggagaggtgtgaggagggctattacctggagcaaaggtggcagggaagggaacagctgggacacaaattccctccaggtcatttggaggcagaagtgggaggaacagaacacccaccttagctcttgtgtttggggaagagtcagggagtgcgggtgctttgcacaacaggccagacttgcccaagaaaactgagcccatctaactttttacttaattgagccaaagtctctctccctcgctaaattctacccctccttcagaagctccttagtcactacttctatggaacaccttcccctgtctctacaaataacagttaactgcgccttctccatgctcctgtgcccactcagccacatgccacctgcagatggcactgaatcctctcttttcagtctgttggttgagggcagggactttgcccatcttgttcactgttgattctctatgcccagcacagagcaaagctcactaagtgttggatggatggcggacagacaggcagacaaatgaggaaacaaacccaacctcattcccagaatctctacctcctggggcccccaaaggacatctcttcactctgttctgtgacaactcttcagagatttgcaggcagcaccctcatccccctggggtctgctgccctcctgggttcctctcgtatgtgccagtttgcagggtgtctcttcaccaccctggtcatttctctagactcactccagtggcctgggtaggtctgggagagcccaaagaagcagagttgaggcgtcctgtcctgtatctcaggaggaatggcccagctccatgggcagcactcacggatctaaagagaattctctaaagtactgtgtttccttggaatcatttgctttcagtctgcagtagcttccctcccacccacaggaatactgccatgggtgaaggcttcactctggtgcagagttcacaagaggttccagctgacctctacccaagcagcttatactgtgtcctccctggacttccctgttggccagtcaggcccaaacacggatgtctgctgatgggaatgtacaagcacagcaaacaccagtatgatttcatcatctaggcctccaggtcttggtgaggccactgccctggtgcccagaggaagtcctaagtacagcggatgtggacatggtatggccagaccaggcaagagccagagatgagccttggaacagcacatgagcctatactgtcaacagcacccctgggcccaccttcttcaatctcccttctgacaacacagagcaagctttctctccaaatgcttcctcatggtgggctcatgtggggcatgctgggcttattcctacccggatcagcctcccgacacaggcatgctcgccccattggtaccttctcactaccctccagacctctgcagggtgcccttcatggagctcctgagcccgtcagctgtgtagtgtgctttttaaatgaagtcaaacctagcatggcctcctggtgcagcctgagctccccatcacagagctgtcacctctaccccgagcctagttcttgcctgagtgcagctgaagatcccatctgtctggtggtcaggattgcatttcacttcctgcttcaggcccatcattcatgtcatccgctattctccgctaaaaggccagagctccttggataaaagacggattcaaagctgggcgtggtggtgcatgcctatagtcctagctactcaggaggctgaggcaggaggatggcttgagcccaggagtggagtgagctgactgcaccaccgctctccagcctgagcgacagagcaagaccctgtctctaaaaagcaaaaccacaacaaaagactgactccagggctgcagcagggaaagtacaaggtaggcctggaatatctcatgctagaaagtaaggaagcacccttaaaatgatgggatccaggaggtttcctgaaggaactcaagattggccaaatacatacaatctggacatcacaaggaatcacagtaacagactccacatagaacacaagactcttgagtctatgccaataactaaatgaacacaaaacttctaaggtcgagaaaacaaactgccttataagagcatgccaataattagaagaaacgataatgttgcaaaatcaccattttgcaaccatcttggtaattgattcagcaagaatcatcaattgaggctgaaactagtaggtgaaagtttgatgaggaacaggatacttagtttcaaagtatccctccagaaattacttattaaaaggaaaaacagtatcttcacaatgcggaaaacacaaccttaactgataaaagttaacagcagcaaggaaagcgcagtcccacatcatgggcccctaatgtgatgcatgtgggtcacagcatcatttctgtgctgttcctgccaaaaatgtaaatcctgaatccgatcacgggaaagccccaaatgtaaactgacagacaccctaaagaataacacctcactctccaaaatgtcaaagccgagaaagtccaataaaaatctgaactgtttcagattaagcaagaccaaagaggcatggtgatcggtaagatttgaacatgaactgtgggctaagtcatagtattgcattattgtcttatttcctgcatctgatggactgtggttatggaagagaaagtcctgattcttaagatgtacacactgaaaaagtacttatgggtagaagggtaggatgttttcctcaaatggttcaaaaacaaatctcaaaatgtctaaagcaaatagtaaatgggacaaagtattgacagttggagaatctgggtaaaggatatacaagagttcttgcaagttttctctgtgtgaaactatatcaaaatacttttttaaaagaggagacacttgaaagaatgttatgtaatttactatttccaggttagggtctcctgcaaatgtggtaactatgccttctttgacctcatcccaattaacagtgtccagcaggtcagggcagcaagcaaagacttccctctaaggaacagacttcattctgttaatcaaaccctgccaagttaagactatcccacaaactacaaatcttcagggcaccagcatctggctcatagtccccctttcttcaatgaggccatcaggagacattctggcaaatagcttggtgagatcaaggtatcctctgggaatctattagtaaacaaatgggtttctaaagccagaagaaaccctagtacaatcccattattctgcaggtatttaccacctaataaccctgccaaggaaagtacggttcatgccgactcattctgcagacactgaccactttctatgtcaggtattgtgctaggtggagccctcttctgagcctttcctaaggactcacaaatctcctaatgtacagaaatttgctttttagcctcttggaatgtgtccccgacatttagcaaaatacacctgttgacacacgacaagtatttgcccgcctagtctttccctatccatacctacagtcattaccacctgcttctccactaggtcagaggttgttcagagggtcccagccacatgctgtgtccagtcattcccagaaattaagcctccaagtgtcaaacccagctgaattttaaaagtaatcacaaaaggctgggcgtggtggctcacgcctataattccagcactttgggagaccgaggcgggcagatcacctgaggtcaggagattgagaccagcctaacatggagaaacgctgtctctactaaaaatacaaaattagccgggcatggtggtgcatgcctgtaatcgggaggctgaggcaggagaagcacttgaacccgggaggcagaggttgcagtgagctaagatcacgccattgcactccagcctgggcaacaagagcgaaactccatctcaaaaaaaaaaagtaatcacggaaacacattctaccctgaggatgtattagaagtccttttctgagagattattttttccaaggaagagtcacatacttgattttcacaacggcttaaaggaaaacaagagacaagtagattccctgcccacacctctgctgaaggaagacaaagtatgctccaagtgcctcctacccagggccagaggcagatggggacaaagcagaggagcacagctctgagggcatcccagaccgcaaagaaaataaggtgcacctgccccaaagctcagccaagactcctttccactgtgactcccaaatggagggccccaggtgctgtgtaaacttctcctctcagaggagctgagttctgtctccctcccttcactgacccggcctcccaggtgctgagtgtcacagatctcaactgctcccacttgaagcaggaccctgagatgtgagactgggcccaggccacgtacctaagccttcctgtgtcacactcctgtccttatagcaccgctctggacacagcttctccatctcctcagtggcacatacaattggttggcagttataatccactcatgtccttctag

SEQ ID NO: 10845 - DNA, 64869 bp, Homo sapiens
  misc_feature (1)...(64869): n = A,T,C or G, or insertion/deletion polymorphism (see Tables 1-2)
gtagcccaagcaaaggggccttgatgctagatagtgtgttacttgaggacctcataaggacctcctgtggccagggcttctatgggctgtggcttatgtctcatgtgtcattctccagggaagcgccgccgagctgctatggacttccctggagccaaggtcattgttccccagctgaagggcagggtgcagcgaaggcgtgtggggttgatgtgtgagggggcccccatgcgggcacacagtcccatcctgaacatggagggtaccaagattggtaggtggaccagggaagctgggaaacccttgtctcttcccaggagggtgggggcactggcagggtggtgctgatgcgtggcttatgcttgcttgacaggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgccagtctctagcttcattgttctctgttcacagggttcctgaaatgccaacccaatgcctgccttcctggcctccaagacaagcttggaataggttctccttgaaaggggccagtctataaaaatggagatattgcccctgttgggcaccccatccctgctcctccagggagctgcatcacctctcccctccctgcaagttattgcatctgggtcccaaggggcaacagcttccaggatgttccctctctcactgcccctgtgcatgcacacccttgttctgtctgaataaccacaacaaccgatgcacttccgtgtttaataagccacatcctcagttgagcctggggtgaaatgtgagatcctgactctgtgcagtagtattagtgggtgggccaggggctgtgaataacatcatcctcagtacagctgcaattccagggcccctctaccacaaagatggcttaagcaaaggcagccagatggaagtatgatatccaacaggaaggaagtaggcaggggtcactaaagtggctggtggcccagcagatggaaacagaagtatggccccgagggaaggaggcaggtccagggctacagtgctttcaggtactggtgtttctataggggcatttgccacccacatctttggaaactcccctggcctattgtgacatggcagggctgcctggttcttgaaggtagagaagatgctagtggggaggagctgagcctgtgacgtgcatttgtaccaggtccagatgggaaatgatgaggctgcaggctatgatggggccactgtgcactaaatgcttggtaccatcctatgaggggacaaggtgcagacccacattcccataggcacttaagcagtggtggataggaggctaccccaggggttcagctgtccttcaggtaatcagcttacccccaagaaggactgagaggaatatgagtaggacagttggcagatgacaatttcctttgcctggctcacgggagaagtctggttgggccaggtatgtgggtgtttggtgcctccatctggatagtgccagcaggtacaccaccctgccttatacctgaatggccagctaaataaccatagagcttaaggtctggctcaggtcaggattccctggctccttgccaacaaagcaaaaccagagattcagaaaactcagggcctaggagaaaacagacctgccttacaaaccccagagctggtcaacctcaggcttcctctcaggaaaaaaattttttttttgagatgggtcttgctctgttgcccaggctggagtacaacggcgcaatcttggctcactgcaacctctgcctcccaggttcaagcaaatctcctgcttcagcctcctgagtagctgggattactggtgtgtgccaccacacccggctaatttttgtatttttagtagagatggggttttcaccatgttggtcaggctggtctcgaactcctgacctcgtgatctgcctgcctcagcctcccaaagtgttgggattacaggcgtgagccaccatgcctggccaactcaggaaaaatttttatggggtcacatcttggggatggaagagggacaggaaaagaaacctaagacaaaagaactgatggtcttcccaacccagaggcttcctgagttatcacccctgagagaggaagaacacaatctctctccttaaggcacccagataagagtacaggcaaactcttcacttgcccagtgcctgggtgagggagcaggcttaagaggcagaagaggcccagccctgtaggcactgggtactccctgctaccaaccctgaacccccggcagttgtccctgaggtctggggagtagcagaacccagtgtagaagccagcagacccagtgatgcccttggagaccctctgctgccttcccttattctctgtgggttttgagaggttcgtttgctgccatttccctgaaagtgatggagagagagaagagagagtggttattccatgggcagaacagttgctgaaattggctctcccaagctccttcttgggggctgagctaggctcagtaaggtcacataacaatctagacctctctgctggtctcccacagcccaccctgggcccagcaccttctccctgcagactcattcttcttcctggttctccatgttagtacggcattgccatccttctctagtttttttattctttttatttattactattgttattacttttctttttttgagacggagtttcactcttgttgcccaggttggggtgcaatggcaagatctcagctcactgcagcctccacctcccgggttcaagcaattttcctgcctcagcctcccaagtagctgggattacaggcgcccgccaccacacccagctaatttttgtatttttagtgaagacggggtttcgccatgttggccaggctggtctcaaactcctggcctcaggtgatctaccctcctcagtctcccaaagtgctaggaacaggcgtgagccaccatgcccggcctgttattttttttgagacagagtctcactctgatgcccagtctggagtgcagtggcgtgatctgggctcactgcaacctctgcctcctgggttcaagtgattctcatgcctcagcctcccgagtagctgggattacaggcgtatgccaccatgcccagctaattttttctatttttagtaaagacggggtttccctatgttggccaggctagtctcaaactcctgacctcaagtgatccgcccatctcagcctcccaaagtgctgggattacaggcatgagccatggggcctggcctcttctctaagacagaaacctgggcagtggcagcctttctaacctctagccctaactcttggacccctttatctacttgccatgaagtaggcatttataaaggcaaattagatcagaccacagccttgctgagttagtctttcaatggctcccagggtccaacaagctctcacgttcaagctccagcatcacagtcttacctattctaatatgtcacccgtattcttccctcttagccttgctcaatccattccctttgcttggtacactttgtcaccctgtggcatttgatctcggcttaggtgtctttcttgggagaagccttccctgaccacccttgccccatgcactgccgccctcccctaataaatccctggctccccatgagcagggcccgggttgtctttgttctctgggcctcgtgtggcccctatcacgtgataggggcccagagattatctgaatgaatgccctgattagtgagcgcatgttttgcagaagaggaggctgaccctgatgaggtcaatgtgctcaggacagagattactgccttcccaactgaggggattgtgcggagtggaatccaacaaacctgtcatttcatctctctgaaattatgacaataccaccacctatcctacaggctgctgaacagcatgatgatggactgtccagaccttggtgtcaccctaacttgaagcctgagctctacgtgcagacttgaagcttgctgcaaaggccattaagctggtgggcttaaagcctgagaactcccctctctgtcaccagcacaggagtgtccttggaatgccaagcatggggttgcggtatggacagatttactcaccacgaagggaaatgcgtggagccatcaggcgtggatccattctgaccacccagacctggaggcagaaacacatccagagctgcagaaggctggggtgggaatctgagcaggcatcagcccaggtcaggttagagaccactggtattgtttggtgaagtctggtgagggtcctaagggactaatggtattgccaggtgagagttctgaggaacagatacaatgtgatgggtggactggtggggattctggcgtaaaatggtatggtggcatgagtcagggcacaacgttaagttctcccatccaagtacctggcttagcttccgaggtcagatgcgttcagggtagtaaggccgtgaaccaatgttaagttctgatgagcctcttgcaggatagtggggaacccaatggtacagtcgggagagggtgggggcgggggcggccagcccacggaggttcgtaggaagcctcacctggacggtgatacaacccggtcactgtattcccgtagaacccccacgccagctggatgcccaggagacttaacaccaaccacagcagcagcagcttgaagagggtcacgcgcatgtcctgcgcctcccactcccgcaagaactcgctgcccagcgcgcccagcaccgtggccggcagagcctgcaaggcctgcccagaccaggactccgccatgactggccctcgccccacccggggtactgtcaccgtagtccccaccacgcacgcgtgtggtcttccgggaccaggcccgttagtgcgcacgcgtaaacccagccagggtggggcctacttcgcgtgcgtgaagagttggcagttcggggaggagtattaaaaccgcgcacgcgcacctaaccccaccctgcttgcttaagggatgagtgactccgggagtataaaatagcaaccaggtcttttatagccccggagttcccgtgatgccccacgcggctgcaatgattggttaagggttttgcttttagggcgtggacgggctcctgagcaatagtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgaggtgagcggaagggttccctccaggcgccgcggggccccaggcccgccagcccggtactcttccggccggcaggccgccgcaccgccgcggccgcgccccaccggctgctcgtggccgagccgcccctggcccctgacccttgacctgactcccagcccgggccccgcgccccaagcggcgaccccgcccgcgcagtccccggaagcgcgcccggtagtctcctgtgccccttyccccgcccggccgggcctggtggagcccaggctgcccgcctgcccgccctcggtccccggagcttcctctcccagcggcgccgggcagggcgggggctttgggccgggccccgcgaccgcgcagtgtagccggccgctgaaagcgcgcgtggctgtcggagttgaaatgggaaagaaactctttacaactccattttgctttttacgtttaacgagaaacgacaatcactgtttratattgattaaagtccagttacactttgggtaggttttcttttaatgcagacttgttggagactgtgtaagtaagtaaaagattgtattgaacgcttaggggtatgatctacggccataccacctcgaacgcgcccgaactcgtctgaaagctttggggtctgtattgagtggaaaaggggtattttccatttggaaaaaaaaaacaacacacaaaactgtaaatgatttaagcgatgttgcatgaaaatagatgcaytgttgcttagtcgaagtcgctgtattgattaggaatgatctaaacatctgtaccttagttactgattggatctacagttacgggtcgtcttcattgaatagcgctattcgcatccaagttgatttgttcacaaaccttgtttagtagtttacggtggaaaattggaatcctttttacctcaaagttggttccacttgtgttttttaatagttctgattttaaatttttacctctgttgttgacttgtttggttctgtcttgaagaaagtcttaaacgtttcttgcaggtgtgtaagtagatatttcactctgcctttctgaaggagaaaaattgaaaaaccaaaaaacttccataatttaaaatgttgtatgtggagagaatttttcaaccacttagtatcacccagatgtgtaatgtgtaccatgcggatgattgtcaccttagatgtggctagattggcggagatactgttttgagcatttggcacaagtgacattggactgaaaaactagtttttaattgtaaagaatgacttattgaaggatctctggataacttgtcttaattggttccatctacttttgtggagcactgatggctcttggggacattaaatatataaggtgcaccttggtttgagttaaagtctagtgctagatttatcctctctgttctcataaaaatctgtgttggagggaagaagagagtaggaatactgtgtagttcttgagttttagatctaagaggaatctttcaggactggttgtccaaccccatttgcagatgagcaaactgagtcccagagacttaagtaaatttcccaaggttacctatctagtcaggagcagaccagaactgtctgctctgttaaggtattctccatttactcccaagcagttggcctccagagtcagctaaaattcaggacttctagcttattccattgtttcttcttttaaaccttgttgatggtgaatagtttgggagaaactgttcatttgccaaaaaatttcggttcattagcttacacagcactctccccttgttaactggatggtcctgccttcaattgagggagatagatgaatgtacgagggtccctggttggcctaatcatggctttgtttggatttttttttaagggaccaacttctagagcaaggcctacactttactgcttcaaaaccaagatatttaggtcaggctaagatatttttagttaactgtgggcacttttgactgttgatttggggtactgcgtgtatcaagtaaacaattccctgtgcacatgcatgtggtggtggtggagtattttcgtagtcctgatttctttccatttgtcagttaactgctttttaaaagtttattctggtcatatgggggtgtaagttattaggagagtaaaaacaggtagctcttcaggtgtttcttgtccatggggtggagtccatgcagtgactggagaaggtgctagtttgcgtctttttaattgtcttagagagctgagagatatatgttaactctgagaagaaagactgatcagcttctaagagagctaatttgaagctgctggccttctgtagacagcaccttgggtttaattgcattgtggttactagtgattatgataaatagtacatagtcactggattttaaaattggccatatagttgtagttttatatttatttttatttttgaaatggagtctcactctgttgcccaggctggagtgcagtggcgcgatctcagctcactgcaccgtctgcctcctgggttcaagtgattctcctgcctcggcccctggagtagctgggactacaggcacccaccaccattcctggctaacttttgtatttttagtagagatggggtttcaccgtgttggccaggctggtcttgaactcctgacctcaggtgatccgcctgccttggcctcccaaagtgctgggattacaagggtgagccaccacgcccacccatatttgtagttttaaaaggatcccggcagggcgcggtggttcatgcnnnnnnnnnnnnnnnnnnnntctactaaaaatacaaaaaaaattagctgggtgtggtggcgggcgcctgtagtcccagctgctctggaggctgaggcaggggaatggcgtgaacccgagaggcggagcttgccgtgagctgagatcgcgccactgtgctccagccagggcaacagaagcgagactccgtctcaaaaaaaaaaaaaaaggatcttaagtattttgtctgactctgccatttagtttattcctttgtttacctgcccaatggaactgtttgcttgtaactacacattaatataactaaattttgaacttaatgttacatgccttgctatacatggggctctttggggacatgctcatttgtgggattaaaatttccaagacggtttgaagtttgtaattactataaaatccctcatctttaatctgtggagctgtagtattaagtgaaggccttggtatgttcataattacgatagtcatgtgactgaaaatcaggcactgaagctgctcgttctgggtgttggtctcagtttattgatgcttcatccaaatacatttttatagctaataataaagaaaaacatcaaatactcttgctaaattgcaatcagtatgcagtttatgccaaacttagcttgatttcatttttttaagaggatgagtatgtatatttaagcatatgtgtgtgtgtatatatgtatatatacttgtgtatacgtatatatatgtgtacatatacgtgtatacgtatatatatgtgtacatatacgtgtgtgtatgtgtgtgtgtatatatatatatttttttttttctcttttgagactgagtctcactctgtcgtccgggccagagtgcagtagcgccatctcggctcactgcaaccgccgcctcctagttcaagtgattcttgtgcctcggcctctggagtagttgggagtaccagcatgcgccactgtgctcagctaatttttgtatttttagtagagacggggtttcaccatgttggtcaggctgttctcgaactcctggccttgtgatctgccccccttggcctctgaaagtgttgagattgcaggtgagagccactatgtctggccatatttaagcatatttatgatagtatcttaaatttaagtgaagggaaagaggaaaacatacacagccaatgaagtaagtttgaagtggagtgaaaggaaaagttggaggtaaaaagaggttagagaggtgggcaggggccaaatcatatagggcctttaggacatgggaaattctttggatttgttctgagattagaagtcatttagatattctttagaaagggaatgacatgatctgatattaaaaaaaaaactagaatcactgtgagtaggagtagatctaattccattctgactaaatagtaaactaatatgataatttggacaaatataaaaaggaattcctggctgggagcagtggctgatgcctgtaatcccagcactttggaaggccgaggcaggtggatcgcttgaggtcaggagtttgagaccagcctggccacatggtgaaaccctgtctctactaaaaatacaaaacattagctgggcgtggcagcaggcgcctataatcccggctattcaggaggctgagataggagaatcactttaacctgggaggcggaggttgctgtgagcagagatcgagccattgcactccagcctgggagacggtgcaagactcaaaaaaaaaaaaaaaaaaaaaaacggaaaggatttcataatattaatttccttgacttagtgacttctgcctattttatttgaagtcattggttcttctcttctcttctcttgagacagggtctcactgtcacccaggctggagtgcagtgagtgatctttgttcacttcaacctctgtttcccaggttcaagcgattctcgtgcctcagtctctagagtagctgggactacaggtgtgtgtgtgtgaccatgcccgactaatttttgtatttttagtaaagacgggatctcaccatgttggccaggatggccttgatctcttgacctcgtgaccccgtgacccacccaccttggcctcccaaggtgttgggattacaagcatgagccactaaggatttgtttttaaaatttttttgctttatttttttcttctctttttttgtactagagatggtgtcttgctatgttgcccagacagatcttgtactcctgggctcaagttgtcctcctgcctcagcctcccaaagtgctgggattaaagatgtgagtcaagcgattctcgtgcctcaacctacccactagctcgattacaggtgccatccaccacctgcccaccacccttggctaatttttgtattttgtattttagtagagacaagaattttaccatgtcggccaggctggtctcaaattcctgacctcaggcaatccacccgcctcagcttcctgctgggattacgggcgtgagctaccctggccaagatttttaatttctgaagcttatagctgctctaaagcacaaggattcagtcccatgatttaaaaaagttgcttgttttgacttcaagtatatggttgagcattctaacttttgttatgtatacatttttattttactgtattcttctagccattgtatcctagtctgtatgttgcagatgagttgtgattctctggtgtctcttccatggacctagagatcatatgctctactactgggatttttttttgtaactttgtttgggatataggctttgagaggttaaggaagtaaatttaagatggatatttaatgttgtaacactttgttaatgcttttttctacaagataattttattatgtgatatggcagctttgttggaaatacctgtttttttgtgtgtgtggaaaatttcttttctggatgaaatctcttgtttaacttttccagttattcataatgaagctctgtttatcttttgaagatcttaagttcagaaacagaaggcaggctgcgtatggtggctcatgccagttatcccagcactttgggaggccgaggtgggtgggtcacctgaggtcaggagttcgaaaccagtctgaccaacatggtgaaaccccatctctactaaaaatacaaaaatcagccgagtgtattagtgagtgcctgtaatcccagctactcggaaggctgaagcaggagaatccctcgaacttgagaggcgcaggttgcagtgagccaagattgctgcactccagcccgggcaacagagcgaaactccgtctcaaacatacacacaaaaaaaagaaggaaagaaaaggcagtagagtatcttatttaagagcatggattctggagagaaactgacagttaaatactagctctgacacttgatggcttgagacccttggcagtagtatgtctcctttgtaattcagtttttttcttctgtagaaagggaatggtaaggaagcgccatgagatttcagtgagagagaagcacttacctcaagtgccagacatgtagcccttcaactaacttattttatttatttattttttgagatggagttttgctcttgttgcccaggctggagtgcaatggcgtgatcccagctcactgcaacctccacctcctggattcaagtgattctcctgcctcagcctccccattagttggggtttacaggcatgtcaccatgcccagctaatttttttttttttttttttttttttgagacacagtctcgctctgtcacccaggctggagtgcagtggcgcgatctcggctcactgcaacctccgccctccgagttcaagcagttctccttcctcagcctcctgagtagctgagactacaggtgcccgccaccacgcccggctaggtgttttttttttttgtatttttagtagagacagggttttaccgtgttagccaggatggtcccgatctcctgacctcaggtgatctgcctgcctccgcctcccaaagtgttgggattataggtgtgagccaccgcgcctggcctactttttttattatttttttttttggagacaagagtctcgctctgtcgcccaggctggagtgcagtggcgtgatctcggctcactgcaaactctgcctcccgggttcatgcggttctcctgccttagcctcccaggtaaactgggactacaggtgcatgctgccacgcctggctaatttttttttttttttgtattttagtagagacggggtttaaccatgttgcccaggctggtctccatctcctgagctcaggcaatctgcctgccttggcctcccaaagtgctaggattacagccgtgagccaccgtgcctggccttctggcctttttttttttttttttttttttttgagacggagtcttgctctgttgtccaagctggagtgtagtggcacaatctcggctcactgcaatctctgcctaccagggtgcaagcgattctcctgcctcagcctcccaagtagctgggactacaggtgcgtgccaccatgcccggctaattttgtgtgtgtgtgtgtgtgtgtgtgtgtgtgtgtgtgtgtgtgtgtgtgttttactagagacggggtttcactttgttggccaggctggtcttgaactcctgaccttgtgatccacctgccttggcttcccaaagtactgggattacgggtgtgagccactgcgcctggccttttttttttggagagataaggtcttgttttgtcatctaggctggagtgcagtggcacagtcatagctcatggtggcctccaacttttggtgtcaaggtatccttacgcctcgtcctccctagtagctgggactacaggtgtatgtgccactgcgcccagctaatatttttacattttgtagagatggagtcttgctgtcttgcccaggttgggtctcagactcctgggctcaaacagtcctcccacctcagactcccaaagtgctgcaagtacgggcatgagccactgagtccagctatcttcaactttcactattcaggttacagtttgtagtaccttttttcgggggtggtgggagggtagtgggagtagcaccctaagatttcttggaataaaacagggcttactacttggttcctggtacttaagaacagtggttcctagactccactgttcccaaacttggaatccagttccccaaattggaatcacctgaggtttaattaccttcatggaggtttaatttgcatacaataaaatgcacatactttaaatgatagtttgataatttttttgttcttattttttttagacatagggccttgttctgtcacccagctgaagtgcagtgtcggaatcatggcttactacatcctcgacctcctaggcccaagaattctctgctttagcctcccgagtagctgggactgcaggtgtgcaccaccacgcctggctacatttttattttgtaatttttttttttgtagagagaggggtctcactatgtgctcagactggtcttgaactcctggccttaagtgattctctcgtctcaacctcacaaagccctgggattataggcatgagccaccacaaaccgccagtttgataaattttgatgaatgtgtatacccaagtaattgccactcagtcgagttaaagagcatttcctcaaggctttaaatttttatttttatttttgagacggagtcttattctgtcatctaggagtgcagtgccgcaatcttggctcactgcagcctctgcctcccgggttcaagtgattcccctgcctcagcctcctgagtagctgggactacaggtgcgtgccaccacacccagctaactttttgtatttttagtagagatggggtttcactctgttagccaggatggtctcgatctgatcttgtgatccgcctgcctctgcttcccaaagtgttgggattacaggcgtgagccaccgcgctcggcgggtttcttttttttttttttttatgagatggaatctcgctctgttgcccaggctgcagtgcagtggcacgatctcagctcactgcaacctccgcctctcgggttcaagcgattcttctgcttcagcctcccgagtagctggaactacaggcacccgccaccacgcccggctaattttttgtgtttttagtggatacggggtttcgccatgttggccaggctggtctcaaaggcctgaccttgtgatcctcctgcctcggtctcccaaagtgctggaattacaggtgtgagccactgctcctggcctaaagttttttagactagtttttttgttcattcgttttatttgcttggcttcctagaatatgacaagttttggtttgtttttgagacagagtcttgatctgtttcccaggctggagtgcagtggtgctatcgtggctcactgcagcctctaactcttgtgcccaagtaatactcctgcctcagcctcatgagcatctgggactacaggcaagcaccaccatacctagttaattaatttaatttttatagagatgacgttttgccatgttgtccaggctggtctctaactcctgagctctggcctcgcaaagtggtgggattataggtgtgaaccactgcacccggcctagttttttattttaagaaatatatatacttggtaaaagtaaactcctgcaataaggtttacaataagcatatataaattcttagccagctcactgggaggtacctaatggttcatttttctttgtcagttttactagatacgcattgtcttagaggcaatgtaagtttggaattaggccaaacaaagtcaaatcctgattctgtgcatccattgaaggttaaccttataatatttacattttgagataaatgatttcatgctcttatttaggaaacttgacggtatgttacctcagggattgttccttgcctgtctttccccaaagaacttgagtttgaagtgattttcacttggcagtaaattgaaggttttcttcattgcttaccaccatgtgccttartcctgctgctcttgatctccaagtgcccttactgctacagaaaggaaagctcttgaactaagagcttggcagccacttgatcaggatggccaaataatggcagtacaggttgagcatctgaaatgcttcaagatgggcgctggcatgacattcaaaggaaatgcctagtggtgcctttcagactttcaatttttggatttgggatactgaaccagtaagtataatgcagatattccaaaatctgaagaaattctgaaatctgaaacacttctgggcccaagcattttggataagcagtactcaacctataccaggctcaagttcattatggacagatggatggatggtagtttggccctttcatcaggaatttcccatgcagtcagtaaacaaaataaacagctctatgttttcaacttcatttccccaatttttttttttttttttgagacagagtttcattcttgtcgcccaggctggagtgcagtggcccgatctccactcactgcaacctttgcctcccagaggtttcgccatgttgcccaggctggtgtcaaactcttgggctcaagtgatccatccgccatggcctcccaaagtgctgggattataggcataagctaccttgcctgtccgttttcatatttttttgagagatgaggtctcactgtattgcccagactggtctccacctcttggcttcaagcagtcctcctgcctcccaaagtgctgggattgcagttgtgagccaccacacctggtcaggagttttacatactatgcgttgttacttgtaggtcttgtttggaaagaagtaacttcctaaggtcaattcagaaaagaagggtagtaacttagaggaagtaaatttgaaggccctagtgtctaatattagtaatttgggcttttgaaagtttcctttctaaaaggtaggaaattaactcttttttttttttttttttttgagacggagtctctgtcgcccaggctggagtgcagtggtgcaatctcagctcactgcaagttctgcctcccgggttcacgccattctcctgcctcagcctcccgaatagctgggactacaggcgcccgccactatgcccggctaatttttttgtatttttagtagagacgggatttcaccgtgttagccaggatggtcttgatctcctgacctcgtgatccgcccgcctcggcctcccaaagtgctggaattacaggcgtgagccaccgtgcccggctggaaattaacccttttatataccatccccccacctcacctttttggctacaatcttgctctgtcacccaggctggagtgcagtggcatgatcatagctcactgcagccttgaactcctgggctcaagggatccagctacctcagcctcctgagtagctaggattacagacgcatggcaccaagtcctgatacagtcttctctgtaccagaacaaagtattcagtgattcaagctcacataggcatgaaacagcactgaaagacgaagtgctgtaggagttcagggataaagaagaatttagagtagccaggaagccactgaggcctctggtggtgagggtgtaactcttggcctttaaaatgaggtttaggggaaatgttatgagtagtgggaatcaacccttggcctgaacacagataatcttgttttatctccttatagaaacaggaggtggtggggggtggccagttttggttagactagggaagatgttgggggagaggggggcagtatgcttctgtagtttcgtttttttgtttttttttttttttgagatggagtctcgctctgtcacccaggctggagtgcagtggcgcggtctcggctcactgcaagctccgcctcccgggttcaagcgattctcctgcctcagcctcccgagtagctgggattacaagcacgtgccaccatgcccagctaatttttttgtatttttagtagagacgggtttcaccttgttggtcaggctggtctcgaactcctgattcgcccacctcggcctcccaacgtgctgggattacaggcgtgagccaccgtgcccagccgtttctgtagtttcttgagttcagattccaagatggatttttgcatatgtattgctttatttcttacccccttgatgtaatctactatataaatcttttaaagtccctacatttaaaaatttatcttgttcgaaaacataatagttttatttggtaaattcaaacagtgcaaaaggatatatggcccctagaggtacctgttgtgtttcttgtagaccagtgcatgtaatcccagcacttggggcagctgaggggagcccaggagttctaggccgcagtgagtcatgatcactccactgcactccagcactgcagcctgagtgacaaagcaagaccctttctggggaaaaaaaaaaaaaaagctcctgtgtactattctagagacagtctatacatataccagtgtctattggtgaatattgtacacctctgtcaagccctgttttgtatatctatgtatcccgccattacactatggtatgatagcatatgacatatttggcacatcacttttttcatttaataatcttgtctcagagatcatttgttaacacactttttttttttttgagacagagtctcgctctgtcgcccaggctgcagtgcagtggtgcgatctcggctcactgcaagctccgcctcccaggttcacgtcattctcttgcctcagcctcccgagtagctgggactacaggtgcccgccgccacgcccagctaagtttttgtagtttttagtagagacggggtttcactgtgtcagccagggtggtcttgatctcctgacctcgtgatctgcctgcctcggcctcccagagtgctgggattacaggcatgagccaccgtgcccagcctttttttttttttttttttttttttttttttttgagacggagtcttgctctgtcacgcaggctggagtgcagtggcacagtctcagctaactgcaacctctgcctcccgaggcagcaattctcctgtctcagtctcccaaataactgggattacaggcgtgagccaccagtattaaagccctgtaataatactgtaatactcagacagcaaaattcttttttttttttttttttttttttttttgagacggagtctcgctgtgtcgctcaggctggagtgcagtggcataatctcggctcactgcaagctctgcctcccgggttcacgccgttctcctgcctcagcctccagagtagctaggactacaggtgcccgccaccacgaccagctaattttttgtatttctttttttttttcttttagtagagacggggtttcatggtgttttagccaggatggtctcgatctcctgacctcgtgatccacccgccttggcctcccaaagtgctgggattacaggcgtgagccaccgcgccctgccagcaaaattctttaagcccccactggggcttaacatctattgatgctactgcctaccctttcactgctccttacctttagtttatcactgtaattacccccttttatgtattctccatttcttgttctgtctctcattttatgttacctggcaaaatctcagccctggtttagatcttactttttttttttgacaaagtcttgctctgttacccagggtggagtgcagtggtgcgatctcaaggctcacagcaacctccgccttctgggttcaagcaattctcgtgtctcagcctcctgagtagatgggaccacaggagcgcgccaccacacttggctactttagtagagatggggtttcaccgtgttggccggggtggtctcaaactcctgacctcaagtgatctgcccacctcagcctcccaaagtgctgggactataggtgtgagccaccacgcctagcctaaatcctactctttacctattctgtgcttttgactgaatgtagcgaaagaaaaaattcactgacttgtctctctttgaactcatggacccttgacctcaaaggtggctgcttttagcactgcctagcagtcccgctaagattccttagtccgtttattctcctgcttttaggataatatagcaccatgtcctttggctcaaatctcctgttccctttccttgcctctatcagctgttatgatcttgcttcttacttatttttctattcctgtggatcagtcccttgggagtccattgttctatctaaggtcagcccttccacttgcaagcgaaatctcgttcccctctaatctcgtaatgttgctctagcagttctctcctctcctgcatcatcattttctgcatacagtctgttggtcagatcttaataccccacctagctgcagtgaatgctgggaaatgtagtctttataactggcagccatgtgactatgaaggggaaagctattgaggcagataagcaggcagtctctgccatactttcaacgcttattttttttaaaaaaacaaaaaccaactcttttggtaacaattttactgagatataattcatatatcacaccattcatttgaaatgaacagtttggtgggttttagtatattcacagagttttacgtgtatcactacagtcaattttagaacattattatcacctcaaaaagaaaccctatgttcttcaactgtcatcttcaatctccctatcaccacgcccagccttaggtaaccactaatctactttgtgtctctatagatttgcctattctggatatttcgtgtaatggaatcatatattgtcttttgtgactggcttctttcatttatgcaatgttttaaaggttcatccatgttgtaacatttattttctgactttttttttttttttttttgagacaggattttgctctgtcacccaggctggagtgcagtgtctcgatcactactcactgccactttgccctcctgggcccaagcgatcctgccacctcagcctgcagagtaggtgggaccacaggtatatgctaccacgcctgggtaatatttttattttttgtagagacaagctctcaccatgttgaccaggccagtcttgaactcctgggctcaagtgatcctcccacctcagcctcccaaagtgctgggattataggcatgagccaccaagcccaggctgactactttaaaaaaattttttttagtaaagatgtggtctcactatgttgcccgggctggtgttgaactcgtgcttaagcagttctcccacctcagcctcccagagtgctgataactgcacccggcctgactttttttgtgtgtgatgttttgctcttgttgcccagtctggagagcagtggtacgattttggctcactgacacctccacctcccaggttcaagcgattctcctgcctcagcctcccgagtagctgggattacagacgtgtgccatcatgtccggctaatttttgtatttttagtagaggtaaggtttcactatgttggccaggctggtctcgaactgctgacctcgtgatccgcccaccttggcttccaaagtactgggattacaggtgcgagccaccgcgcccaactaattttttgtatttttagtagagtcagggtctcaccatgttggccaggctggtctctaactcctgatctcaaatgatccatcctcctcagcctcccaaagtgctgggattacaggcgtgagccaccaggcctggccccgggctgacttcttgaaagaacattttccaccacatatctcagtgcccacgttttctcaattcactgccatctactcttgcctgtggctatatgaaaaggttttctcctgttgctggacacctcctcatagacctgtgttctttttgcaagcatgtagtttggactcttttcttgtaatgtgttcttccttttttcttggtgttcattatcatcatacctttttgagcatttcagttatttctggcttcttcatgaccaccacttcctttgtgttggtggcactctttggctagatcactgcccctctccattccatacactygaagactatgctgtttttacctgtaataacagcttacctgggcactgatatttttcagctgactgtggggaaatgtttgtgaggtttggaaaacgcctccttagattgtgcccattccacctccccttccattagggttctttcttttgggcaccctcatacccttgccatagttttctcatccctatccagttaaccactcaatcacttttcgtgccctgccaaggctctgtttcttcctcttctttttttttggagacagagtcttgctctgttgcccaggctagagtgcagtggtgtgatcttggctcactgcaacctccgcctcctgggttcaagcgattctcctacctcagcctcccgagtagctgaaattataggcgcccaccaccacgcctggctaatttttgtatttttagtagagatggggtttcaccatgttggctaggctggtcttgaactcctgacctcaggtgatctgcacccctctcagtctcccaaagtgccgggattacaggtgtgaacagccgtgcccggccaggctttgtttctctattaattacagacctgattgtgctggtccagtggctttcccttccttacagaatagaatgcagattgctctgcatgacataccatatcctctggtctaaccatcgccccatctttccacccttattttcaaaaatctcctttctgaattctttttttttttttgagacggagtcttgcactgtcgtccaggctggagtgccgtggtgcgatctcggctcactgcaagctccgcctcccgggttcacgtcattctcctgcctcagcctcccgagtagctgggactacaggtgcctgccaccacacccggctgtttttttttgtatttttagtagagacatgatttcaccgtgttagccaagatggtctcgatctcctgacctcgtgatctgcccgcctcggcctcccaaagtgctgggattacaagtgtgagccaccgcgcccgaccgccaaattcttgtgttactggtcattgaggttatttgctcaagctgtttcctcaccttagaaagtattcctgaaccatcattaccgctctttccaggggacttgtcctccttcttcaaggtccatccaggtcagatatcatcttatctgaagctctctggcagaatcacttgccttttctctgagttcataccagagaagataagcttttgttacagcacttaattacattgtgctgttttccctgagtgttttccagataaagctgtatctctagtagctagaacaaggaatggcccatagaagacagtggtttgtggccggatgcagtggctcacgcctgaaatcccagcattttgggaggccgaggcaggtagatcacttgaggtgaagagtttgagaccagtttggccaatatggtcaaaccccatctctactaaaattacaaaaattagctgggcatggttgtgcgcacctgtaattctagttactcatgaggctgatgcaggagaattggtggaacccgggaggtggaggttgcattgagccaagatcatgccactgcacttcagcctgggcaacagagagagactctatctcagaaaaacaaaaacaaaaaagtggtttgtatgagaccagtcggggcaataagaattgagacaaggagctggatgcagtggctcacgcctgtaatcctagcacttcgggaggctgaggcaggcagatcgcgaggtcaggagttcgagaccagcctgaccaacatggtgaatccctgtctctactaaaaatacaaaaattaggccgggggcggtggctcacacctgtaatcccagcactttgggaggctgaggcaggcagatcacgaggtcaggagattgagaccatcctggctaacacggtgaaaccctgtctctaataaaaaataaaaaaattagccaggcgtgttggcgggtgcctgtagtcctagctacttgggaggctgaggcaggagaatggcgtgaacccgggaggtggagcttgcagtgagccgagatcatgccacagcactccagcctgggcaacagaggagactccatctcaaaaaaaaaaaaattagccaggcgtagtggtgcatgcctgtaatcccagctactcaggaggctgagacaggagaactgcttgaacccgggaggcggaggttgcagtgagccgagattgcaccactgcactccagcctgggcgacagagcgagattttgtctctcacacacacacacacacacacacacacacacacacacacacacacacagaattgagacaagggacctgtggtcctaactgttcttgaggctgagcctcttaaaaaaaaaaaaaaaaaaaaaagccagtgcagtggcctacacctgtaatctgagcactttgggaggccaaggcaggtagatcgcttgatcccaggagttggagacccgtctggcccatatgatggaaccccatctctacagcaattagccaaacgtggtggtgtgtgcctgtggtctcagctacttgggatactgaggtgggagaactgattgagcctgggaggttgaggctgcagtgagccataattacgtcactgcactccagtctgggtgacagaggcagaccctctctggaaaaaaaagttgacacaaggccactgggcctggcaaggagaagatcaccattatactgcagtagtaggtggcagagtgactaagaaggaagcgtaaaagatggatgggagcacttagaatttatctttaaaatacctgatttttttattttttgagacagagtcttgctctgttgccgaggctggagtggcgcgatcttggctcactgcagcctccgcctcccaggttccagcgattctcctgcctcagcctctcaggtagctgggattacaggcacgctcaccatgcctgggtaatttttgtatttttagtagagacggggtttgaccatgttggccaggctggtcttgaactcctgacctcagctgatctaccccccttgacctcccaaagtgctaggattacagaagtgagccatcacgcctggcctctaaaagacctgatgtttgtggtgaccattttctggaaaaatttgtgacattaaattgtggatatgtcttctttgaccaatccagcagctgtgggagacatgtttagaacagcgttgtctttctgtgatggtggacgtgctgtatatctgcactgtccagtaccatagctcccagccacatgtggctattgagcattgaatatggtcagtgtggccaaggaactgaatttgaaaatgaaaaattttaggccaagtgcagtagttcacacctgtaatcccagcacttgtggaaggctgaggcaggcagatgacttgagctcaggagtttgagaccagtctgggtaacatggcaagacctgtcttttattcaatactttaaaatttttacttacttgataaaaaggaagaatattttaaaatttaaacatcagttttttgttgttcttgtttttgacacagggactcactctggcacccaggctggagagcaatggtatgatcatggctcactgtagactttacctactggctgaagctgtcctctcacctcagtttcccacccttacccacccagtagctgggattacagacactcaccaacacgcctggctaatttttattatttgtagaaatgaggtctcactgtattgcccaggctggtctcgagctcctggcctcagacatcctgggattacaggtgggagtcactgtgcctgaccagcattgtttttttgtttttgtttgtttttttaaagataaattaattggccatgtgtggtggctcacgcctgtaatcccagcactttgcgggggctgaggctggtggatcacttgagataggagttcgagaccagcctggccaataaggcaaaaccctgtctctactaaaaatacggaaatgagccgaacatagtggtggatgcctataatcccagctacttgggaggctgaggcgggagaatcacttgaacctgggaggcaggattgtagtgagctgagatcgtgccattacactccagtctgggggacaagatcgaaacgctgtctcaaaaaaaaaaaaaaaaaaaaaagataaattaattaggccgggcacagtggctcacgcctgtaatcccagcactttgggaggctgaggtgggcggatcacctgaggttgggaagttcagaccagcctgaccaacatggagaaaccccgtctctactaaaaatacaaaattacccgggcatggtggtgcatgcctgtaatcccagctaccggggaggcggaggttgtagtgagttgagatcgcgccattgcactccagcctgggcaacaagagcgaaactctgtcttaaaaaaagaaagtcacaatgtggctagtagctaccacgttgggcagtgaagctgtgacattaccagttgtaggattgaatgcaatccagactttttgtctgttgtgttcacacttgaagcagtgactctgctgcctaagtatgtataatttttacttttttttttttttttgacggattctcactctgtcgctcaagttggagtgcagtggtgtgatcttggctcactgcagcctctgtctcctgggttcaactgatcttcctgcctcagcctccctagtagctggaactacacgtgtgtactaccacacctggctaatttttgtatttctttttttttttttttgagacggcgttgctctgtcacccagactggagtgcagtggtgcgatctcggctcactgcaacctctgcctcccgggtacaagcggttctcctgcctcatcctcccaagtagctgggactacaggtgcatgccaccacgcctggctagttttttgtatttttagtagagacggggtttcaccgtgttagccagggtggtctcgatctcctgacctcgtgatcctcctgcctcagcctcccaaagtgctgggattacaggcatgagccactgcatccagcctaatttttgtatttttagtagagacggggtttcaccacgttggccaggctggtctcgaactcctgacctcaagtaatctgcccgcctcagcttcccagaatgctgagattataggggagagccaccacacctggccccgtactcttttatattaatatccatgacgccttttaccttttctgaaatagattttttcagtttctctactgtcactctatcaaaatttgtaaattttccttggaatattagacagaggattaagccacgtgtttttccagtccaacttttgttacatctgtattttccttttacatgttgactggttcaaactggctagcatcccaagtaaggtgtgaattaaatcctgacatggggctgggcgtggtggctcatacctgtaataccagcactttgagaggccaaggcaggcgaattacctgtggtcaggagttcaagactagtctggccaacatggtgaacccgtctctacaaaaaatacaaaaattaaggctgggtgcagtggctcacgcctgtaatcccagcattttgggaggccgaggcaggtggatcacaaggtcaggagttcaagaccagcctggccaagatgttccccgtctctactaaaactacaaaaattagctgggcgtggtggcgggtgcctgtagtcccagctactcagaaggctgggacacaagaatcgcttgaacccgggaggtggaggctgcagtgagctgagattgtgccactgcattccagcctgggtgacagagtgagactccatcttaaagaaaaaaaaaaaattcctgacaacggactgtcaaagctatttgcttctcacagtctgtgggtattatagatggacggggacccgccaataaaggaggggaaggctccttttgtgaaactgatttgcttctgtcttctaaatcagtatgtgtacttgggcctactaatcaagtcttactgttttgtctgtaactttttttttttttttttttttgaggtggagtctcactctgttgcccaggctggagtgcagtggcaccatctcggctcactgcaagctccacctcctgggttcatgccatttttctgcctcagcctcccaagtagctgggactacaggcacctgccaccacgcccggctaattttttgtgtgtgtggtagagactgggattcactgtgttaggatggtgtcaatatcctgacctcgtgatccgcctgcctcggcctcccaaagtgctgggattacaggcgtaagccaccgcgcccggcttctgtaacttttatttattgtaagttgttagctattggaattctggacagaacagagctcctgagtctgttcactgctgtaagaagtaagaagtgtcatgactctttttcagcagaggaattagtctattaatgacatgtggctggaaatagacctgccgctcagaacctgttctggagttaagtccttccaagatgggcctagggaatctgagaagcacagcaggttcctctcagcaagtgctgctgaaccccaaactaagctcacacattcttcttgggttctgcctggagagtccctattagcctcatccctaagcaaccactatgctcctttttttttttggagatggagtctcgctttgtcgcccaggctggagcgcaatgtcacaatcttcactcactgcaagctcagccccccgagtagctgggattacaggtggacgccaccaggcctggctgatttttttttttgtatttttgtagagatggggtttcaccaggttggccaggttggtcttgaactcctgacttcaggtgttccacccgcctcggcctcccaaagtgctgggattacaggcgtgagctaccacgcccagcagctgctttctgtctctgtagatttacctattctggatatttcatacaaatatggtatgaaacatgtggttctttgtgactggtttcttttactgagcatagtattttcaagattcatccatgttgtagcatgtttcagtacagtactgtacttcgttccttattgttgctgagtagtactccactgtatggctataacacatggttagatatgtagcttagataggattgttttgttaattaaaagctaatgaacaaagatttcaaagtgtgagatattagtcattagtaggctggccattgaacagctccacatttcaaaatgtgagatactaaattagttattagtgggctggcccattgaacagctccagaaggccttcaggaagttgtccagacaaatgtgagtaagcatcatggtcacacaaatgtgagaaaattaccaaagactgctatgtgaaatgcggagagttgctcattaatgcatggttttaatttacctactgaagcatagtcagtagccactgtagcatctgaagaacatatgatggacacaccactcccacactcagcacccagataagcaaggcaggcagcaatgcagatgagctatagttatcccaggaaatcactttgacttgtaaagtgtgaaaaggactggccttcacctatcattctttctatagcagagctccctaaagctcagaaagccacagctggctggatgtcatggctccacctattataatcccaccactttggaagacagaggcgggtgggtcacttaagcccaggagttcatcactgagcccaggagtttgagaccagcctgggcaacatggcaaaaccccgtctccacacacacacccacacaaatagaaaaaaatttagtcgggaatggtggcacacacctatagtcccagctactcgggaagctgaggtgggagggtcacctgagcccaggagtttgacgctgcagtgagccttgatgacagcactgcactccagcctgggcaacagagtgagaccttgtctccaggaaaaaaaaaaaaagagaaagccatccccttccttgacatcatctgtaatgagtaaacagacattaaaacagtaagagtaaacaggtgtaagacatgctagaaccaaagaaccaagagttgatgatttcagagtgactcaaacatatgtgacattgttattatttcttcctctggtgtgtacagaaaaaagatacacacatctaaaagaaatgtatgcaaaaacatcataaaagcatagaaaacaaacataatagggtttttttttttgttttttttttttgagacctggagtctcgctctgtcccccgggctggggtgcagtggtgtgatctcactgcaacctctgctcccgggttcacaccattctcctacctcagcctcctgagtagctggaactacaggtgcccgccaccacgcctggctaattttttttgtatttttagtagagacggggtttcaccgtgttagccaggatggtctctatgctgacctcgtgatctgcccaccttgggcctcccaaagtgctgggattacaggcatgagccaccgcgcccgacccttttttttttttttcccccgagatggagtctcgctctgtcacctaggctggagtgcaatggcacgatctcggctcattgcaacctctgcttctcaggttcaagcaattttcctgcctcagcctcccaagtagctgggactacaggtgcgtgccaccatgcctggctaattttttgtatttttagtagagatggggtttcaccatattagccaggatggtctcaatttcctgacctcatgatccgcccgcctcggcctcccaaagtgctgggattacaggtgtgagcccccacgcccggcccggttttttttttttttttttttttttttttttttttttttttttgagacggagtttctctcttgttgcccaggctggagtggaatggcgtgatctcggctcactgcaacctccgcctcccaggttcaagcggttctcctgcctcagcctcctgagtagctgggattacaggcacccgccaccatgcctggctaatttttttttgtatttttagtagagacgggattttgccatgttggccagactggtctcgatttcctgacgtcaggtgatccatttgcctcggcctcccaaagtgctgggattacaggcgtgagctgccacgcccggtcatgtaacagttttaaaaagcccatacggtcatactgaatatagacatagacagagttaatcaaatacatcagagactgagtttgtgaagttaaggaaaaatattcaaactagttaatcgccctaagttgcatattaattaatcgagtctttcagtgtcaccaaggtttgcctgagtaggcaaaggagaataatacgctaaagctgtagaatcacttctcttgacacggggaaggaaggagggtaagacagtggaatgtttagaaatgtgtactctgaaacggattgcttaatttacttcagtgtccaattctgcctcttactggctagcagtgcgactgacgttgaacaaattagcctttccatactcagtttcttcatttgtaaatgagagtattagaacttacaggaggactgttgcgaggattgtttgtttaaagtttataactgcattatttgttagctgtttcttatatttttcctcttctacaaagtagtggtgggagacaaggcttccctacatttagtttgatgcctgtggttctaagtataaggagaaaacggaagggaggaaagaggaagtaaaaatgaaagatgacctaaataaatggaaaggcgtccatgttcatatgtcagaagacttaacattgtaaagatgacagtactccccaaatcgatctgtagattcagtgtaattcctatcaaaattccagctggcttttttgcagaaattgacaaactgttactaaaatacataccaaaattcaggggacccagaataaccaaaataatcttggaaaaaaacaaagctggaggactcacacctccagattttaaaacttactgcaaagcaacagtaatcaagactgtggtactagtataaaggtggacaatatagaccaatggaataggattaatccaaagtaaaccctcagttgctaattagttgatttctcaagtgtgccaggaccatccagttggggggaaaatagtcttttcagtaaataatgctgaggtgactagatttccaaatgaaaaagaatgaagttggaccccttacctcatatcatgtatgaaaattaactcaaaatgaatcaaaggcctaaagtgtaagacttaaaactatagaaagaagcatatatattttttttacgaccttgaatttggctgtggtattttagatatgccaccaaaccatcagtaaccaaagggaaaaatagataaatttgacttcaacaaaataaaaaacgttgtgccccaaagggcatcatcaaaaaaataaaaaaaacaactgagtttaaaaatgggcaatgggggctgggtgcggtggctcattgctgtaatcctagcactttgggaggccgaggcaagtggatcacctgaggtcaggagtttgagaccagcctggtcaacatggtaaaaccccgtctctactaaaaataaaaaaattagccaggcgtggtggcagacgcctcccagctatttgggaggctgaggcaggagaattgcttgaacctgggaggcggaggttgcagtgagccaagatcgcgccactgcactccagcctgggcgacagagtaagactctgtctcagaaaaaaaaaaaaaaaggtaggggggcaatggaccaggcgcagtggctcacccctgtagtcccaacacttagggagccaacacgggagaatcacttgaggctaggagtttgagactagccagggcaacacagcaagaccctgtctctacataaaagataattaaatttgtttttcccccgagacagtcttgctgtcacccagactggagtgcagtggtgccatctcagctcactgcaacctccgcctcccaggttcaaacaattctcctgcctcagcctcccgagtagctgggattacaggtgcctgccaccacgctaggctaatttttgtgttcatagtagagaatggtttcaccatgttggccaggctgctggtttcgaactcctgacctcaagtgatctgcccatctgagcctcccaaagtacttggattacaggcgtgagccactgcacccagccaagataattaaatttttagaaagtgggggcatcacttgagcccaggagtttaagaccatcctgggcaacatggtgaaactccatctttacaaaaaaaacacaaaaattagctgggcgtggtgtgtgtgcctgtactcctagctacttgggagactgaagtgggaggattacctgagcctgggaggtcaaggttgtggtaagccatgataacaccacctcactccagcctggatgacagtgagaccctgtctcaaaaaaaaaaaattaaaagttgtaaaagaaatactgttatttgtgtattgttactggtgacttaattagatataactgacttttggttaaataaacctctactccaaacttataagttatttctgagactaaacctagcctggaaaatgacacgtctgggagagctaagcgtgatttcctttcttgacaaaccatgtacttgtaaagaatgctgcattatagcaaagtggaaaggagagataattctgcaaaatttctcctgcgtttttcaaggagaaaacagcaagtttgattttctgtgcttgtactttttacttctcaacttctgtgtattgccgcactcccagtatcccagaaatcacttaggctttcattttgtccgataatcacttgtaatttttgtctttgtcaccattagtggctaaatgattttattctttttctgggccaaatgttctttatcagatatttttctttttcttttctttcttttttctgagacacagtctcactctgccgcccaggctgtaatgcagtagtgcaatctcggctcactgcaacctccacctcccaggttcaagtgattctcgtgcctcagccttccaagtagctgggattacaggcagatgccaccatgcccggctaatttttgtattttcagtagagacggggttttgccatgtttgccaggctggtctcgaactcctgacctcaagtgatccgcccacctcagcctcccaaagtgctgggattatgggcgtgagccaccgtgcctggctggactagggtctttaaacgtgaattccctccctataagcaaaggtggagacagagtctggacattctaggaagggaaggcacaaacagaatagaagacacatgcagtaatctcagacacaccagagcacccggaaggaatggagtgcaggctgaaagtgcagaggggaaggtggggctggagagggcccaaggacaggcaatgatttattccccatctataaggaaacttttcaaaccataacagaagatttaagtcaatactggaacaaatattgtgggcatgttgaactataaacaaagcaaagatagctctttttttttttttttgagatggattctcgctctatagaccaggctggagtgcagtggtgtgatctcagctcactgcaagctccaccttccgggttcacgccattctcctgcctcagcctcccgagtagctgggactacaggcgcctgccaccatgcccggctaattttttgtatttttagtagaaatgttagccgggatggtctcgatctcctgacctcgtgatctgcccgcctcggcctcccaaagtgctggaattacaggcgtgagccaccacacctggccgaaagagattatttctcaagaattgaatgtcttctaggtagggtgctacgcaaaggtggcagccttttctttttctttttctttttttttttctgatacgatggagttttgctcttgtcgcccaggctggagtgcaatggcgctaactcggctcactgcaacctttgcctcctgtgttcaagtgattctcctgcctcagcatctcagtagttgggattacaggtgcccaccaccacgcccacctaatttttgtatttttagtggatatggggttacaccatgttggtcaggcttgtctcgaactcctgacctcaggtgatccacccacctctcaaagtactgggattgcaggcatgaaccccagcacactcggccaaagcagccttttcttgaactggggaattcctgttgacgtttctttgcatcccatagggtcctggttgtttgactttgggcaaaagcccatgcagattaggccttatgagagatgtaaagtttattaaatctttatttggtgagacagggtcttactgtgtcactcaggctggagtgtagtggcatgatttcagctcactgcaacctctgcctcctgtactcaagtgatcctcccatcttagcctcctgagtagctgtgaccacagatgcgcaccaccacagccagctaattttttgtattttgggtagagatggggtttcactgtgttgtttaggatggtctccaactcttaggctcaagcaatttgcctgccttggcttcccaaagtgctgggattacaggtgtgagccaccacgcccagtgtctatttttttattttatttatttatttatttttgagacggagtctctctctgtcacccaggctggagtgcagtggcacgatcttagctcactgcaagctccacctcctgggttcaccccattctcatgcctcagcctcctgagtagctggaactacaggcgcccttcacgacgcctggctaattttttgtatttttagtagagacgggatttcactatgttagccaggatggtctcgatctccttacctcgtgatctgcccacctcagcctcccaaagtgctgggattacaggtgtgagccaccatgcccggccaatatttttttatttttatgagatagggtcttgctattttgcccaagctggtctcaaactctggactctagctgtcttcccacctcagcctcctgagtagatgggattacaggcatgagttgccacacttgactctaactggggaacttcactctctgtcttttttttttttgagacgaattttcgctcttgttgcctaaactggagtgcagtggcacgatctcagctcactgcaacttcctcctcccgggttcaagtgattctcctgcctcagcctcctgagtagctgagattacaggtgcggaccaccatgcccggctaatttttgtatttttagtagagatggggtttcaccatgttggtcaggctggtctcgaactcctgacatcgtgatccacaggcctcggcctcccaaagtgctgggattacaggcgtgagccaccatgccaatccttttttttttttgacagagtctcactgtgttgcccaggctggagtgcagtggcgcgttctcagctcactgcaacctccgcctgcctaattcaagtgattctcatgcctcagcatcctgagtagcctttcaggggttacaggtgcctgccaccaacccagctaactttttttttttttttgagacggggtttttctcttgtttcccaggctggaatgcaatggcgagatatcggcttactgcagcctctgcctcctgagttcaggagattctcctgcctcagcctctcgagtagccgggattatgggtacatgccactacgtccaacttatttttatattttttgtagagacggggtttcacaatgttggccaggctggtcttgaactctggacctcaagtgatccgcctacctcagcctcccaaagtgctggcattacaggcatgagccattactcctagccttgactgcatgctcttgtttgaagatatgcattgagcacatttccctatcatcgatatgcttcttattgtgctttcatgattagtagtatcttcaatttactccctttttgcaaaaaaaaaaaaagttactagattttgtagatttggataaaattctataatatctgtatctatatatatatacacacacacgtattcactgctgtatgtaatattgtcctgagaattcacaaatgagtaatggcagcactgtcagccctctgagtttttttgttttgttttcattgtttatttttgtcgttgtttgccctctgagttttcttctggtacccctgtggattgtcttatccattctggttggggaacataccctttagacaatatagttttgataatgagtatttattattattattattattattattattattattattatttttgagacaagagtctctgtcacccaggctggagtgcagtggcatgatcttggctcactgcaacctccacctcccaggttcaagcgattctcttgcctcaccccaccacgcctgggtaattttaatatttttaatagagatggggtttcatatgttggccaggctggtctcaaactcctgacctcgtgatctgcccgcctcggcctcccagagtgctgggattacaggcgtgaatcaccatgcccagctgagtgtatataatttaggattagtttgactataggtaacagagacttgaaaaataccaccttaaataagacagtcatttatttctcattcatatggaagaaacatggaaggtaggcagtcttggggctgagatggtggctcccaagatcacctgagatccaggctcctttttaccttttggttcttccagccccacggtatggcattcattctcacataccaggatggctgcttagaaaccagcccttactttagatttaagcagcaggaaaggaggaggataataaagacttccctttaagaaagactttctggaagtcccacaacatactgctgattctcacatctcatggtacatggccatgtctccaagggaagctaggaagtgtagtctacaacaaagtacatagctaaaaatcgaagtatggtctaggagggaagggcgggaattgggatggttgaccatcactgtctgccagatggaaggaatctgcagatttctctcttttttccccccactgggggcgagagtggtggtaacagctttattgaaatataatccacatatcttacaattcacctttttaaagtgtgaattatatatactgtgggctgggtgcggtggctcacgcctgtaatcccaacacactgggagagacaggcaggaggatcgcttgacctcaggagtttgagagcagctggggcaacgtggtgaaacccggtcactactaaaaatacaaaaaattagccgggtgtggtggcatgcacctttagttccagctacttgggagactgagattggaggttcacttgagcctggggaggctaaggttgcagtgagtggagatcgcaccactatactccagcctgggcaacagagtgagaccctgtctcaaaataaataaaatgtgtgaattatatatactataatcaatagtttatagtatattcatagagttgtgcagccatcaccacaataattttggaaaaatctttttacctgagaaactccagtattccattagtcattttccatttctctccacccccaagtccctgccctaggcaactaccagtctattttctctttctgaatttgtttattctggacaattttatataaatggaatcatgcatgttggtttttgtgactgggttctttcacttatataacatttccaagatctatccatactatagcatatatcagtactttatcctttatcgctgaataatattccattccattgtatggatatattatattcatcagttgttggatatttgggttctttacattttttgacaatatattatgaataatcctgctatgaatattcatgtagaggtacaagttgttatgtggacatatgtttttgtttctcttagatatatacctaggaatagaattgcagggtcatacctactcacatcctttgctcattttttaattggattagattatttgtctttttattattgaattgtaagagttctttattttttaattttttctatatactgtatttaggcctggggaggtggcttatgcttgtaatcccagcactttgggaggctgaatcgggaggattgcatgagcccaggagtttgagaccagcctgggtaatatagtgaaacgctatctgtataaaaattagtcagctgtggtggcaggagcctggtagtcccagctactggagaggttgaggtgggaggatcgcttgagttgagcctgggaggcagaggctgcagtgagccaatattgcaccactgcattccagccttggtgacagaatgagaccctttctgaaaataactacataatagagaaacacatagataggttagataggtacatagattggatagatgcgtagatagatgggcagtggctcacgcctgtaatccctcagcactgtgggaggccgaggcgagtagatcacttgagctcaggagttggagaccagcctgggaaacatggcaaaaccctgtctctgccaaaaatacaaaaattagctgggcgtggtggcgcatgcctgtggtcccagctgctggggaatttgaagtgggaggatcacttgagcctcggaggtggagattgcattgagccaagatcacgccactgcattccagcctgggtgacagagtgagacctcatctcaaaaaaaaaaaaaaaaaaaaaaagatagatggatagataaatagcgtacttcatgtcagaaggagttctctctttttttttttttttttttttaagacacagtttcactctgttgcccaggctggagtgctctgttgcccaggctggagtgcagtggtacaatctgggctcactgcaacttctgcctcctgggttcaagcgattctcctgcctcagtctcccgagtaactgggattacaggtgcccgccaccacacccggctaagttttgaattttttgtagaaacggggttttgctgggttggtcaggctggtctcgaactcctgacctcaagtgttctgcttgcctcagcctcccaaagtgctgggattacaggtgtgagctaccgtgcccagcccaaaaagagttctttatgatttcaaccttgcaagagatcctgagccagaccaccaacctaagctgcttttttgtagttgagtcataagagtttgagacaaggttccactctgtcacccagtctggagtgcagtgatgcaatcatagctcaccacatcctccacctcctgggctcaagcaatcctcccacctcagcctccttggtagctgggactacaggtgcatgctaccacaactggctgattttttttttttttcttttccttctttttttagagacagtgtctcactggggttccccaggctggagtgtagtgatgcaatctcagctcactgcagcttccacctccagggctcaggggattatcccacctgagcctcccaagtaactgtgattagcatgcaccaccgctcctggctaattttttgtatttttagtagagacagggtttcactatgtttcccaggctcgtcttgaactcctggactctcaagcagtccacctgtttcggcctcccagattgctgggattataggcgtgagccactgcgcccggcccttttctttctcccctcccctctcatgcttccgtccgtccttcctttctcagtgtctcactatgttgtcagggctggtctcttaactcctgggcctgagcattcctcctgcttcagtctcccaaagtgttgggattacagacatgaaccactgtgctcggcctcaattgatttttcttttttgagacggagtttcgctcttgttgcccaggctggagtgcaatggcatgatctcggctcaccacaacctctgcctcccgggttcaagcgattctcctgcctcttgctcctgtgtagctaggattataggcatgtgccaccacgcctggctaattttgtatttttggtagagatggggtttctccatgttggccaggctggtctcaaactcctgacctcaggtgatctgcctgcctcggcctcccaaaatgctgggattataggcgtgagccaccgcgcccagccaagaatgctgtttctttacaaacaaatctagattggtaaaagaaggaatatccaaacttagaaagattgcagaatgtctacccaaacaacctgccgatgacttttttggttctttcctcccttgggtactccctttcatcagtcctttcattgtttttaccctgcttgacaaattgtttcctttttttttttttttttttttgtgagatggagtcttgctctgtcccccaggctggtgtgcagtggcccgatcttggctcactgcaagctctgtctcctgggttcacgccattctcctgcctcagcctcccaagtagctgggactacaggtgcctgccaccatgcccggctagttatttgtatttttagtagagatggggtttctccgtgttagccaggatggtctcgatctcctgacctcgtgatccacccgcctcggcctcccaaagtgctgggattataggcgtgagccactgcgcctggctcaattgattttttaatgttaatattgtatcctgcaaccttactgaacttgtttattctaaaagttttctttaggatttcccacattacaaaatcatctcatgtgtgaattgagatagttttacttcttcctttccaatttggatgtcttttatttcattttcttaccttattgccctggctaggacctccagtatcctgctggatagaagtagcaagaacaggccaggcgtggtggctcacgcctgtaatcccagcactttgggaggctgaggcaggtggatcacctgaggtcaggagttcaagaccagcctggccaacaaggtgaaaccccatctctatcaaaaattagctggatgtggtggtacgtgcctgtaatcccagctacttgggagtctgaggcaggagaattgcttgaacccgggaggctggaggttgcagtgaactgagattgggccagtgcactccagcctgggcgacagagtgagactccgtctcaaaaaaaaaaagaagtggcaagaacagacattcttgtcttgttcctgatcttagggggcagacctttttttcagtcttttaccattaagtataatgttagttacgagtttttaatgtataaccttttggtgccaggtggatcggcgtactagaagtttgaatttgagtatgctaatagaggtttatgccccatggttaccaaagcatgtgtcatcctgtaagctacctatgacttcttgtgcattgcaggtaatatctgtgttttgtgtttcagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtgagtatacttttcataacaactgatgccattttccatgttagaatatttatggagcatgtagagaattagagctttttgcctcttcagtataccatataacaaaaatgttggaaagaagaatccattctcatcctgccatcttagtccaagtttgttctttttttttttttggagacggagtctcattctgttgcccaggctagagtgcagtggctcggtcttggctcactgcaacctctgcctcccaggttcaagtgattctcctgcctcagcctcccaaatagcagggattacaggcatgttgccaccatgctgagctcatttttcgtttagtagagatggggtttcaccaggctggtctcaaactcctgacctcgggtgatccacccacctcagcctcccaaagtgctgggattacaggagtgagccactgtgcccagccttcccccaggtttaaaggattctcctgcctcagcctccccagtagctgggattacgggaatatgccaccacacctggctgatttttgtatttttagtagaaatggggtttcactacgttggccaggctggtcatgaactcctgaccgcaggtgattggctgttttttcatttttaactgctactcatccagactttgtttacattcatatgtatttgacatggtgtccttagcatatgtgttttttttttgttttgttttgttgtttgagacagagtctcgctctgtcgcccaggctggagtgcagtggtacaatctcagctcgctgcaacctccacctcccgggttcaagcaattcttttgcctcagcctccagagtagagtagctgggattacaggcgcacgccaccatgcctggctaatacttgtattttgtaaagatgcaattttgccatgttggccaggctggtctcaagctcctgacctcagatgatccacctgcctcagcctcccaaagtgctgggattacaggcgtgagccaccttgcccagccatatgtgctcttttcaagtttacgtatatttgaagtttagttcattgccatatagataatgctcagatgaacttctttgtatgcttggactttgacaaaaattctgtcaaagtatttaatcagatgtcccagtattagattactagttcaagctctgcctcctgggttcacgctgttctcctgcctcatcctcccaagtagctgggactacaggtgtccaccaccagactggctaattttttgtatttttagtagagacggggtttcaccgtgttagccaggatggtctcgatctcctgatcttgtgatctgcccgtctcggcctcccaaagtgctgggattacaggcatgagccactgtgcccggccaaaagatttttttttactttaacataaaatagcctgccacagttgttttattttattgtcattgatggtgagaacagtgcttccccatttctgtcctaaaagccctctggcaagactggaacaaagctcttgtgaaattggagggtttttttgggttttaattttggttttggtttgtttttgtttttttttttaatcttctgcttccttttgttgtctaagtaatgctttgcttggcctctcatacttttttttttttctcttaaataaagagacagggattgtactttgtctcccaggcctgcagtgctgtgacatgatcatgcagccttgaactcttgggctcaagtgatccttccacctcagcctcccaaatagctggcactgtaggtatgtgccaccacacctgggtaatttatgtttttagagatgaggtcttgtgttggtccagctggtttcaaacaactgggctcaagttcttccatctcagccccaagtggctgggcttacaggcgcaagccagcgtgcccagctctcctatacatcttttgaagtgggtcagctgaaaggaaaaaacccctaaaactagaatgaggtgctcttctccaacattctcatttttcttgagcattcagttatatgtctcatatgctgctaacacttgatatattagcttccattcatcccctttctcctttcttactttgtttttgtttgtttgtctagagacagagtctccctctatcacccaggttggagtgcaatggcatgatcttggtttacaacaacctccgcctcctgagttcaagcaattctcctatctcagcctcccgaggagctgggattacaggtgcctgccaccaagcccagctaatctttgtatttttagtagagacgaggtttcgccatgttggccaggctggtctcgaacttttgacgtcaggtgatccgcccgccttggcctcccaaagtgctgggattacatgcatgagccaccgtgcctggccacttctacttgtccacattacttatttctttctgtcctagggccacctagcctccttttgtggcactgtgtgaggaatgtgggttagatcagctgctcagaactccagggtccctcattgtagggcttcctgatagttgtttgaccatcagtaagctcctgacctttgagccttcctcatttgtaaaacggtttttataggtgacatcaaggttctgtgaagtaacggaaaatgtttggcagcaccaaagcgctttctaagagatgaatactgccatgttcaaaaccctctttcatagtttgtagtccttttttttttttttttttttgagacagagtctcgctctgtcgcccaggctggagtgcagtggcgtgatctctgctaactgcaacctctgcctcctgggttcacgccattctcctgcctcagcctccggagtagccgggactacaggcgcccgccaccacgcctggctagttttttgtatttttagtagagacagggtttcaccgtgttagccaggatggtctggatctcctgacctcgtgatctgcctgcctcccaaagtgctgggattacaggcgtgagccactgcgcccgtcctatagtttgtgctcttttttattcaaatacagagtgagccacgatgattgctcttatgctaataggaactctaagatactttctggcccaagtatagatggaaaaaatacaacaaataccagcctaacagaattttgggatgtaccctgaaggtggcaaaccaatacagagggtgttaattcagcctcagccaagcatggatgcttggacataggtgtttttgtggtcctgataggaaaactggttttatatggacacagggcccagttgtgacaaactaggtagaaatgtgatgacatcttcaggattggtgtcaagttatagccctcttacctaacttagattgatgcaccatacatagaaagatccattggcttggggaagcaatgtcaggttggcattttcatagcttatttctcaaaagcctagtagtgaatgtatattactggttgtatcctaacattttctccagagagtggctgttaattgctgcatgtctgtaagcatgaactggaagggtcttttccatctgtggcagtatgtatgttttggaagcagctctttggttctcttggaaacattatttctgcctgggcatcttggaacaaccagaatcttgcccataagaaatttagagaccttgacttaaaaccttgaggcatggtctgtgagtatttttcttgtgctgcaaaccttggacatcactgaccctcgcaagatagggggaggttctcacttgaggagagtcccctggaataaaagtgtttgattgaagagcatattacaggctacctgcctgcctcagagcaactcaagagtccccaagatgggagagggtactgtgtaggaatattcatttaacagtatgcaatagtataaggccagacgtggtagctcacacctgtaatccagcactttgggaggctgaggcaggaggatcaccagaggtcaggagtttgagaccagcctgcccaacatggcaaaacccaatctctactaaaaatacaaaaaattagctgggcgtggtggcaggcacttgtaatcccagctacttgggaggctgaggcaggagaatgacttgaacctgggaggcagaggttgcagtgaactgagactgcgccactgcactcaagcctgggcgacaagggcgaaactctgtctcaaaaaaaaaaaaaaacagtaggcaatagtacagcctagggaaccatacaagattgtaggtgatcatggtaccaagagtaggcctgctcacaatgaaaaggccccttttgatatgagacagactcaacatcttggaagcattttatcaagcgccaatagaggctggatatatgactaaacaccgtggggtggagggggccgggagagtgggatttgccagggagtaaatgagctccattattgtgagggcagacagattgtgataattgggcatcagtatatcttagttacacatgccagaatgatggtttgcatgacagaagtacagtgggccttgtggaggttatttgtgatgcatcctggggcaaaagttcgggggtggaagagccatcaattttaaggaagaaatcatttagaaactgaaatttgggctgtgaaggtgctaagagaagaaagatgtgttccaagtattggagggagacctcttgggcctcaaagggcctctgtacagaggatgtttaacatggagtctggtgataagaatggggtagcagagctgggtgcagtgctgggcagtgttgaatgggacttgtattcagagcccaggcatcagtttacccttctaccacaggagggtgaggatgtacccggatgtgaaaggagtactctctcaccttacgtgatgcattatttcagacatttcttgagtagtaaaggcacagccaaaagggctttcctgtcatctcaggccttgcctaacagccagcatggtgtcttttcctacctaccaactcaaaatacagatttgtttccatggtttccacattatagcagaaaatttacttagtcttgtatcttcctctctcgcctgtatgcctggtaggatgttatttaaaatttgatttcttccctcctgtctgctttctttcctagtagaatgttatttataattaaacacttttataagctacagagttatttttgacttgacattttgaattatgccacttggttcagttctagtatctgttttgtttttttgtttttttcctaattgagtcaaggtctcactgcctaggctgcagtgcagtggcacaatctctgcttactgcaacctccgcctcccgggctcaagcagtcctcccacctcagtctcccaagtagctgggactacaggcgtgcaccaccacagtcagctaatttttttttttttttaaatggagtttcgctcttgttggccaggctggagtgcagtggtgcaatctcagctcattgcaacctccactcattgcaacctccgcctcctgggttcaagcgattctcctgcctcagcctcctgagtagctgggattacaggcatgcttcaccacgcccagctaattttgtattttcagtagagatggggtttctccacatttgtcaggctagtctcgaacttccgacttcaggtgatccgcccgccttggcctcccaaagtgctgggattacaggcgtgagccaccgcacccagcccacactcagctaagttttattttatttattttttttttttttagagatggaggctcgctttgtcgcccatgctggagtgctggagtgcagtggcacgatcttggctcactgcaacctttgcctctcgagttcaagcaattcacctgccttagcctctccagtagctgggactacaggcgcacgctgccgtgcctggctaatttctttcgtattttagtagggacggggtttcaccatgttgcccaggctggtctcgaactcctgagctcaggcagtcagcccgcctcagcctcccaaagtgctaggattacaggcatgagccaccgcgcctggccacactcagctaatttttaaggtgtttttgtagaggtgggttctcagattttcaattttgagaaatttcaacctaaaataatttaaatatactctcatttgagcttgatgctcataaaagtgaatattcggccggggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactgaactccagtctgagcaacagtagtaagactccgtctcaacaaaaaaaaaaaaaaaaaaaaaaaaaaaaaaaggccaggcgcggtgggtcacgcctgcaatcccaacactttgggaggccgaggcggacggatcatgaggtcaggagatccagaccatcctggctaacacagtgaaaccccgtctctactaaaaatacaaaaaattagccgggtgtgatggcgggcacctgtagtcccagctacttgggaggccaaggcaggagaatggtgtgaacccgggagacggagcttgcagggagcagagatcgcgccactgcactctagcctgggcgacagagcaagactacatctcaaaaaaaaaaaaaaaaaagaaaaaagaaaaaatgtaaatactcctgtgttttactgttttagaycgtctgccatttcartggtctgccatttcaatgtactatggtaagtgtcactttttctaaaagtgggtggggggattaaccttgcactcttgtggttgtttttcccattacaggtagagttggctttgtgggacacagctgggcaggaagattatgatcgcctgaggcccctctcctacccagataccgatgttatactgatgtgtttttccatcgacagccctgatagtttaggtgagtggccctgcaccctgatatttgtcactgcctgtgtagctagttggcatctggtttctgggcatcaagtggctgaaaagcagacatgaacttcagagaagcaatcatcgtcagtggccggagtcctggagtttgggattgtagagcgtgggccttgggtccctttcagcctaggtctcccatgggtactgtatttaaaatgtatccacctaggcagggcacggtgcctgacacctataatccctgcgctttgggaggtccagacgggtggatcacctgagggtcaggagttcaagaccagcctggccaacatggtgaaaccccgtctttactaaaagtacaaaaaaattagccaggcatggtggtgcacgcctgtagtcccaggtacttgggaggctgaggcaggagaatcgtttgaacctggtaggtggagattgcagtgagccgagattatggcactgcattccagactgagcaacagagcaagactctatctcaaaaataataattattattattattactaaataatattaaatgttatttaaaaatctaactgccttgtaaactagatgaattccagatacaaagatgagtaaactaaggctggtgcggcggctgacacctgtaatcctagcactttgggaggccgaggctggcagatcacctgaggtcaggagtttgagaccagcctaggcaacatggtgaaccccttgtctctactaaaatacaaaaattagctgggtgtggtggcgtgcacttgtaatcccagctattccaggggctgaggcaggagaatcacttgagcctgggaagcagaagttgcagtgagccaagatcatgccactgtactgcagactccatctcccaaaaaaaaagatgagcaaactagatgagttccaaatgtaaagccatctcttttggggaaagactttcttttttttggttgccctgtcttagcctttttctgaagtgtcttagctgatagaagcttgaatgtgatcatttcattagcctaaacacagccacataattcagaagtcagtaagtcagtattcttttttttttttttttttttttttgagagggagtcttgctctgtctcccaggctggattgcagcagcttgatctcagctcactgcaagctctgcctcctgggttgatgccattctcctgcctcagccacccaagtagctgggactacaggtggccaccaccacgcccggctaattttttgtattttttagtagagatgggatttcaccacgttagccaggatgatcttgatctcctgacctcgtgatccgcctgcctcggcctcccaaagtgctgggattacaggcgtgagccactgcgcctggcccagaagtcagtattctttagaaaaagactgaagaatgctaacctgacattctgtgaaaccaggcttgaaaaaacttgctttaggtttgtgctgaagatgatgaggtatctattaataaacttgtgctgcagccctccctgtcatgacagggcagcaggtgggtcaaggatgttgtcgtcattaccacaaacagcctttgagggtctgcttgtggcctcgggttgcctggatagttagtgttagagtgattgtgttgttatggttgtccctaccttaatgatgataactggggttgctccaagatattgagccacttgtttaaggtcatgctggcccaaggagctgagctaagattgagtcctctgtgcagtatgtcccaggacagagaaagagcacgtattccatgccgttggttcacttagatcattttcagcagttatgattgattgattgatttagaggcggggtctcgctctgttgcccaggctggagttgagtggcacaatcttggctcactgcaacctccgccttccaggttcaagcaaatctcctgtctcagcctcccaagtagcttggactacaggcatacgcccccacgcctgggtgatttttgtatttttagtagagaccgggtttctccgtgttggccaggcttctctcaaacttctgacctctggtgatccactcaccttggcctcccaaagtgctgggattacaggtgtgagccaccacacccagcctagttttggttttcaaactaatatgacttccttttgtgaagctgctggaaggccctggaggctgggcagagctttaggccacagagaaaatttgagctagttgacactctcctatcagatacacacataaataacttcacctagatcctattggaatgagaaggactgtgtgcctttgccctcgttatctagtgtataattcttgagggaaaaaactgcctccagagcaaaacattttgtctcttcagtctcacttttttctttttgagacagggtctcgctttcttgcccagtcttgagtgcagttgcagattcagtttactgctgcctcgacctcctgggctcaaacaatcctcccatctcagtccccacccagtagttggtactacaggcacacactgctgcgcttggttaatttttatattttttaggccgggcatggtggctcacgcctgtaatcccagcacttcgggaggctgaggtaggcggatcacctgaggtcaggagttcgagaccagcctggccaacatggtgaaatcctgtcgctactaaaaatacaaaacttagccaagtatggtggcatgtacctgtaatcccagctactcaggaggctgaggcaggagaattgcttgaacctgggaggcagaggttgcagtgagccgagatcgcatcactgcactccagcctaggtgacagrgtgagactcttgtctcaaaaaaaaaaaaaaaaaaagtttgaaaatttattcaccaaaagtggcgacagtcaatttattcaaattctatgtacctcaaactccaggaagggggtagactattggtataatttcacatattcaggaaataactacagcacctactaacagaacatctattctaggccaggcactgtggctcacacctgtaatcccaccactttgggaggccaaggtgggtggatcctgaggtcaggagttcaagaccagcctgtccaacatggtgaatccctgtctctactaaaaatacaaaaaaatcatccgggcgtggtggcgagtgcctgtaatcccagctactcgggaggctgaggcaggagaattgcttgaacccgggaggcagaggttgtagtgagctgagattgcgccactgcgctccagcctgggcgacagagcaagagtccatctaaaaaaaaaaaaaaaaaacttctgttctagatgagggaagacagaataggctcccctcaatgcccccaaaaaagtaaatcagaaaataacaacagtaaacccagtaacagtaaatattacaaataacatttgtagaggtgggtcatggttgtatgctgttttgttttatttatttttatttttgtttttttgagacagacttttgctcttgtcacgcaggctggagtgcaatggtgcgatctcggctcactgcactccgcctcccgggttcaagcacttcttctgcctcagcctcccaagtagctgggattacaggcatgcaccaccatgcctgactaatttttgtattattagtagagacagggtttcaacatgttggccagactggtctcaaactcctgatccacctgcctcggcctcccaaagtgctgagattacaggcctgatgagccactgcgcctggtctatttatttttatttatttatttatttatttattttgagacggagtctcgctctgtcgcccaggctggagggcagtggcacgatcttggctcactgcaacctccacctccctggttcaaggaatttccctgcctcagcctccctagtagctgggattacaggtgtgcaccaccatgcccagttaatttttttgttttgttttgttgtttttgagacggagtttcgctcttgttgcccaggctggagtgcaatggcacgatctcggctcactgcaacttccgcctcccgggttcaagcgattctccagcctcagcctctcaagtagctgggattgcaggcatgtgccaccacgcccagctaattttgtatttttagtagagacggggtttctccatgttggttatgctggtctcccaactcccgacctgaggtgatccacccgccccggccttcacagtgctgggattataggcatgaaccactgcgcctggcaatctttttgtatttttaatagagatggggtttcaccatgttggccagactggtctcgaactcctgacctaacgcgatccacctgcctcagcctctcaaagttttgggattatagacgtgagccactgcgcccagcctatttatttgtttttaagagatgaagtctcactttgtcaccctggctggagtgcagtagtagcgtgatcatagctcactgctaccttgaatcctggactccagtgatcctcccacctcagcctctcaagtaggtgggaatgcaggcacatgtaccactgtaaactgctaagtttttgtatgtttttgtggagatggggtttttgacttttttgatacagagtctcactctgttgcccaggctggagtgagtgtagtattgcgatctcgactcatcacaacctccacctcctgggttcaagtgtttcttctgcctcagcctcccaagtagctgggactataggtgcacgccactgcgcccggctaattttagtaattttagtagagatgaggtttcgccatgttggccaggctggtctcgaactcctgacctctggtgatccacccacctaagcctcccaaagtgctgggattacaggcacgagccaccacgctgtctggagatggggtttagccatgttgcataggctgttcttgagctcctaggcccaagctgtctacttgccttagcctctcaaaagtgctggaattacaagtatgagtcaccacgcccagcctcttttggttattttcaaaagtcacttttttttatttgagacggagtcttgctctgtcgcccaggagtgcagtggcgcgatctcagctcatggcaagctctgcctcccgggttcacaccattctcctgcctcagcctcctgaatagctgggactacaggtgcccaccactacacccggctaattttttttgtatttttagtagagacggggtttcactgtgttagccaggatggtctcgatctcctgacctcatgatccgcccaccttggcctcccaaagtgctgggattacaggcatgagccaccgctcccggccaaaagtcactcttcagccatttgaaataccagtaaaccccatagggtagaagttatgctgagagttgatgaacaagttagaaaaagarcatgtggaccctgggtcagctgctgccctagaatggggaccccttctgtaagctatgtcagaatcatctaccagcagtgacagatgtcctgtaaagtgcctgcctttgtggggcaggaagtgccccccgtgaaactaccttgtgttgtggatcttttgctcctccagagcccttactcgggccccacctacagagatgctcagcaccactcttggctggactgagaaaaagctgttggttctctgtttaaaggaaagggattatatttcctttttatggttttgaaactagtgagtttcattaaatgtctagcatttttctgaagccacaaagaaagtgtctctgcaatttcactgaggttcttggaaagtcttcaagatagaattgtatgtatccccaaattctctacatttttctttcagaaaacatcccagaaaagtggaccccagaagtcaagcatttctgtcccaacgtgcccatcatcctggttgggaataagaaggatcttcggaatgatgagcacacaaggcgggagctagccaagatgaagcaggcatgatctggggcaggactgtcttgtagtattcttgaactagggccccaagtttggaggtttggggagcccagcaggaaccttcacaggccaggttgttttagaggctcagaagcccctctgtggccctctgaccctcattaattgggatcttcacagaagatccctaagatagttcaccagtcctgtgagatggaatgtttttttatgaggtagtgctatgcccataaggactgctggcctgagaatgaaccatttcattagtagctagtaatcagtggctctagatgtaggaactttcttttttttgatatggagtctcattctgtcacccaggctggagtgcagtggcgcaatctcagctcactgcaacctccgcctccggggttcaagcgattcttctgcctcagactcccgagtagctgggactacaggcaccctccaccatgaccggctaattttttttttttttaatagatggggtttcaccctgttggccaggctggtcttgaactccttacctcaagtgatctgcccacttttgcctcccaaagtgcagggattacaggtgtgagccactgtgcctggcctctgttagactctttatttttattttttgagacacagttttgcttttgtcacccaggctggaatgcagtgatgctatctyggctgcaacctcagcctccaaggtttaagtgattctcctgcctcagcctcccaagttgctgggattacaggcatgtgccaccacgcctggctaatttttgtatttttagtagagacgggttttctccatgttggtcaggctggtctcaaactcctgaccttaggtgatctgcccgccttggcctcccaaagtgctgggattacaggtgtgagccaccacgcccgggcctgttagactcttgattgccttccccagctattactttggtacatgtgaggccaaagataaattagtggcaactgaaagataaggaaatcttgaaggctgggagtccagatagaaagccctaatgccttccctctcctccactcccaatgcctttttaaaagtgatgatggatgtggcatcttggcctctcagaaaccagctggcctaatggcagggcttcctcactggaggagaagcattgagatcttcaacctaagttctcttactcaggtttctctgtctgaatgtcaagggtaggctttatttccttcagggcatttagtcctggattggtagcttgagtaattttgctcttgattgactccttaaccttccagggctcctctgacctcttccctctacttcccagtgaataccatgtttattagagattttatgtttggtagggggtagttaccatatgtcagtttaaaaatttcataagtttagcagtttgttgttttttttttttgttttkttttttttgagaaggagcctcactgtgtcgccaggctggagtgctgtggcacgatcttggctcaactgcaacctccgcctcccagatttaagcgattcccctgcctcagcctcctgagtagctggggttacaggcgcccactaccacacccaggtgattttttgtattttagtaaagaggggtttcaccatgttggccaggatggtcttgatctcctaaactcgtgatccgcccagctcagcctcccaaagtgctgggattacaggtgtgagccaccacacccagccaagtttaacagcttttgaaagtcttttttttttttaggctgggtacagtggctcatgcctgtatcccagcactttgggaggccgaggtgggcagatcacttggtcaggagttcgagaccagcctggccaaaatggtgaaaccccatctctactaaaaaattacttgggcgtggtggtgggcacctgtagtcccagctactcgggaggctgaggcgggagaatcccttgaacccaggaggtggaggttgcagtcagctgagatcatgccattgccctccagcctgggcgaccgacgagcaaaactgtctcaaaaaaagaaaaaaaaatcttttagatgaatttgaatactttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccytttgacactgctctawcagccctcctctgcactcccacctgacacaccaggcgstaattcarggaatttcttaacttcttgcttctttctagaaagagaaacagttggtaacttttgtgaattaggctgtaaytactttataactaacatgtcctgcctattwtctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagawgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaaktaaataggaattggtttcacgcctgaggcaattagacactttggaagatggcataacctgtctcacctggacttaagcrtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccgctttggagacagggaggagggagaccggaagcctagatccctctggctgtcccctgcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttatagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaactgtgtgtatgtcctgtgtcattgtcatttgggaattctttttcttttctttttttttttttttttttgagacggagttttttgctctattgcccaggctggagtgcagtggcgcaatctaggctcactgcaagctccgcctcccgggttcacgccattctcctgcctcaacctcctgagtagctgggactacaggtgcctgccaccacgcccggctaattttttgtatttttagtagagacagggtttcaccgtgttagccaggatggtatcgatctcctgacctcgtgatccacccgcctcggcctcccaaagtgctgggattacaggtatgagccaccgcacccggcctggcgatactttttctaacctcattgtcatagtggtgggaacttaatcctccttcccttatcctagccaagtctgaactttctgtccttttgtctgcagcgtgtaggatccactctttcctttgtgggaagtctggctcctggcctgcatttctgccttcaccagaacatgcaaagggccatctcaagacccagttacaacaaagtccttacttcaaaaaagacacaaggcaatggttgactgcctaactcaaatgatagacttctgactacttgctgcacgctgaaatgactgtcacaaaataacatgagcccccactcacatttggagtcatggcctctccaattgttaggtccacacaatcccattttacacggaagctcatgcaatgttataaattctgttatctggctagatctttccatgttgctaccaagtgcctgtatctgctgtgacgatgatcttacaagtttctgcctcatatattcaagagtgagaaaactataatttaactggcccttctgactatgccctgcccaacacttaacgtgcaattaattgcacattcaggcccaggataagggcttgtctttgaagccagctgctgcttctcgggcaccactcaggtccagcctctccatctgttgaccctgctgccaataatctttaattttttttttttttttttttttttttgagacagtcttgctctgttgcgcaggctggagtgcagtggtgtaatctcggctcactgcaagctccgcctcccgggttcacgccattctgcctcagcctcccgagtagctgggactacaggcgcccgccaccacgcccggctaatttttttctattttttagtagacggggtttcaccgtgttagccaggatggtctcgatctcctgacctcgtgatccacccgccttggcctcccaaagtgctgggattacaggcttgagcagcaataatctttcaagacagatttggagccatttcctaacgcagtgcaggggactgcagggcctgggtgtagcttccgcttgtgcaaacaggtacccagagacatggtagtgctgttcacccgctgactgtggaccagaggttctggagtcccagcatttgtgttcaaattcgtgactcaaggtccttcttagtctgaaccaactctcaaggacttttcctcttgccctaagcagtgatctttgctgctgctttccccctttgtctgcccttaggtcactaaggattgtagggccttctggacctgctctggctccatcctgagaactcctgaacaggcccacctccctctggttctctctgccccagcctttgagtcccccttggggtgacccaggtagaactatcagcttcccctttggacctcactctacttgtgttgttccttggaactctcaggagtctcactcttgcccaggctggggtgcagtggcatgatctcagctcactgcagcctccacctcccaagtttaagcgattctcctgcctcagcctccccagtggctgggattacaggtgcctaccaccatgcctggctactttttaatatttttagtagagatgggatttcgccatgttggccaggctggtctcaaactcctgacctcaggtgatctgcccgcctaggcctcccaaagtgctgggattacaggcgtgagccactgcgccctgccagaatggaatgttattatattaatagatcaatatttgtgatgaatatcannnnnnnnnnnnnnnnnnnnatgccgggccctgtgggccctgagatggctagcccctgtacccctcctagactgttaacttctggggaagaagattagtcattcataaatgcaatcaaggctcctgagtggccattcatggacgctcacgcctataatcccagcattttataatcccaagtaatccgaggagggcagatcacttgaggcaaggagttggagaccagcctgaccgacatggtgaaacccccgtctctactaaaaatacaaaaattagccaggtgtggtgtcgggcgcctgtaatcccaactactctggaggctgaggcagggagaattgcctgaacctgggaggcggaggttgcagtgagccgagattgcgctattacactttagcctgggcaacagagcgagacactttctcaaaaaaaaaaaaaaaaaaaaatccactcaaatggtaccaaggctttttgacatttgtagacttcaaatctgactcctggaatggagaatagcaacctgtaaatctgggtggacccagattgcctgtgacccctaatgtcctacatgtctcttccccaaaagcactttgctccctcattcattcataatccagtcctgtgccgtgtgctctgccaggtgcctgaagaagtcagaaggacagtatataattatcaaaaaagcatgttttgtgctttgagaataggaaaaaaagacaagaaaaaaattgtgcaccttacactagttaaaaaaaaagaataggccgggtgcggtggctcacgcctgtaatcccagcactttgggaggccgaggtgggcggatcacgaggtcaggagatcgagaccatcctggctaacaaggtgaaaccccgtctctactaaaaaaatacaaaaaattagccgggcgtggtggcgggcacctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaagaataaagaagaggaccaggcccagtagggaggctcatgcatgcctcctggaaaaagtgacagtgaggctgggtgcggtggctcacacctgtgatcccagtactttgggaggccaaggtgggcagatggcttgatggcttgaggtcaggagtttgagatgagcctgcccaacacggcgaaaccacgtctctattaaaaatatgataattagctgggcgtagtggcgggcacctgtaatcccagctactcaagagtctgaagcaggagaatcacttgaacccaggaggtggaggttgcagtgagccgagatggtatcactgcactccagcctgggcaacagagcaagactccatctcaaaaagaaaaagtggctgggcgcggtggctcacacctgtaatcccagcactttgggaggccaaggtgggcggatgacaaggtcaggagatcgagaccatcctggctaacacggtgaaaccctatctccactaaaaatacaaaaaattagctgggcgtggtggcgagcacctgtagtcccagctactcgggaggctgaggcaggagaatggcgtgaacctggggggcggagcttgcagtgagccgagattgcaccactgcactctagcctgggtgacagagcgagactccctctcagagaaaaaaaaaaaattgagactgaaaagaagtcaagaagcagttggttaaagaataagctgatggcgggtgagcaggcagggagtatagtgtgtgagatcctgagatgggaaggtggcattcttgactaagtcagcaacaggaggagcaggttttgggggtaggtggatgtgttcagattcagctatactgcattagacatccagacagaggtatctggggcaggca

SEQ ID NO: 10846 - DNA, 14859 bp, Homo sapiens
gaaaatccagcccagccccagctccccagtaaccccccgcgccccttcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccaggtgaggccagggggcaagggggacccaccttcatcctcgttcccactcccattcttactcattcgagcctcaggctctccctaggcctccttggggctgggatttaggattgtgcgagcttatggtccccccaaccccaacatcattgaaattacgtgtctgttcaaagccttgggactgagtctcccagctcaaccagcagggcctgcaagaagggggcggggccagcctgaagaatcgggtgtggcatgggggagtggccaaagcctgagggtggagctggggccggggaggtggagctggggccggggaggcggagctgggggagagagtggcgtcaggccagggaatggaggccaaagcaatggagcaggaccttggcctggtggtggatcccgagcagcggagacagacctctaccctcagacctgtacactcagctgtcaggcttaaataaacctatatgtaattataccttgaaccaagtgtggaaaggacaaacaggattgcttagttcccaaagggacctagagggagccacggtggataagccggagagcactggatgtggattggaatcctgaatgtaccactttgcaggtgacctaggaaaggctcttaccttcctgagcctcagttttctcacccatgagatattggaagaaataactcccagaagcatgaggatgaaatgaaaaggggcaaaaagatgtgaacgtgctttgtaaacttgaatgcagagtacacaatgtgccattgttgattgaatggtcagaataggtggataccgttcctggaacaggtaaggcctcagaagagaaaagctctagcagagaagtctgagtgcaagcaaatttctcaggccttgaaagctgggagaatgattgaatgctgccctaagattgggttgggctcttcctgctggccttccaggcatctgccactcagtccagacactggactgaggaatcagggattctccctggagatgacctggaggaggaaaaagaatgtgtttcccagatagcaaggctggggtgatgggtccccttctccaatatcccacagggcaccctgcctcagcttgtaaagaattcctaaacccttgggaggccaaggcaggcggattgctggatctcaggagtttgagacctgcctaggcaatatgacaagaccctgtctctaccaaaaatacaaaacactagccaggcatggtggtgtgcacctgtggtcccatctacttgggaggctgaggtgggaggatcatttgagcctggagtggggtggaggttgcagtgagccgagatcgcaccactgcattccaacctgggtgacagagcgagaccctgtctgaaaaaatgtaattaatataatataatacaatataattcctagcataatttctaaacccactcccttgatccagtgtcacacagctattaagtggccaggataataagcacaaaatagaagttgttggtattattattatctttggggtcaacctagaggaaagctaagatagagagtggcatttccaaatggctgtctagtttctttagtcaatctcaaataattcatcttgattaacccattcagtgtttcccaatctttagtcattcaccagtatcttgaccacatatgacttgtctgtttatcaactgtactattcttaattttctttaaatagatatgactcttttcaaaggttcatacatttatttctaaaggaaacgatacagtacagtaaatggaaaattagcctcttttgccataaatagatggttctagtaaaagtaaaaatagaaaaacaaaactatgattaaagtttagatgtagattctgttgcaagctgaaggctctgagctccaggcttgcttcatgggggaaagaaaaaagtgagataatcatttttcaagacatactagcactaagctgagacttttactttgatgtgttctcagcactgcaagagaagtggaaagggagtattttttcctaagggactggggaaagggaggatattggtttcccttgggacaagactggggctcgctgcggggaggcacggaggggccggccctcatccctcctctctctggtctctgcagtgcccggaaacgccccatcccctactatcggcccagcccctcctcatccggcagcctcagcagcacctcctcctggtacagcagcagcagtagccgctcggccagccgcagctactcccggagccggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtttgacttggtgggaggtgtcaggagataggagttggttaagatgatagatagaaaaacggaagggttcagctgctgctcccaatacctcagcatggtaaggggacagagcccagcagatcccagctgtgaagaggccactgcatggctgacacaaaacacctcttggccattcacaggggccctgcaacctcacgagaaaggagatagtggaagagtcaggacaggttggtctccagccccacttcccaaatatgcctcagccccactagctggcaccaacttaattccacgggaccatctgctgaacattccccagtgccatggccagttgccaggccccagcgccagccagtctggccttaccctccggttggcgcctgccagccccctcccctctgcccaggctgccacgccctggatgccacccagtgcagcctggcacctacccacccacccttcagcttaagccactccccttgcctctcaggaattttgccaggatggggcacagcagctcaggtttgggggaaaagacccgaatccagagtgcaggggagaggggcttggatatgccatgtcttgggctcctgctggcttctgaggtttcttgtcagcttgggaaagacccacctttatttttgccctcaccccaagtcccccctggctggggctgggcagagagggtaagctgatctccgatccacaaataccaccagctgcttcatccacagaaggcgctaagaacggggaggtgaggaataagatccttaaaataaactcttgggcatccccctcaccagctgactggctttccggaggcttgtgggtgagtttcaagtttgtggtggcaacagcagcaggacagggcacggagggagcgagggagagaggaccggtcccagcttttggatattttgggttatggggaagcaagggccaaacattctttatccctcccaccccagggaaaacatttggaaaatagtcctttttcttggaagcagtgacgtctccctacccaatctttcccatcctatcaacccatggggctagagactgccatgcaaccaccaccacgacagcccttcctccatcagaagacaggagtgagggccccgggcagcagtggacgacccagcctccccataccgggcctctggcccagacctaagccctgcccacaaagactaatggatgccagtgctgtcactgcagaaggccagatggcaggtgcctgggacaggggcaggtgccccggggagggcaagtacagccactgtaaataaccctcgtccctgcccaggaacccagactggacttcagtctccctccatggagacaaaggcttcccagagccaccaaaaaccttcttagcaggacagctgtgagaggcatcagaacctcacgttcggactgccttcatcaagacaactctaggggaccattttgcctggggctcctagcaaacctttttatttattttatttatttatctatttatttatttgatgactgtctctctttctcgccattagcagtattgaattatttatttatacagaggttttgtgtgtgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccctgaaggctctaagcctggaacaccctggggttggcccagaaggaggcacatcagtcccaaaattcatcacttaacccagcgtccaggagggtcaggcctgtaccccagcctcctgtcccccaggaacctcacaggggtatcaaaaagatgtaaacagcccagaggcttatgagctacagtgatgaattgacacagtggagttgcaacttaggtgggggttggagtcgaaagttggcaaatggggccaaggctgcacaaagtcgaaatcccttgtgaatgtcccttagggaggcaccagattggagacagatgtgctatctcctaacagagtgatgaggcttcagttgagtacttgctgaagtagttgccttgtattttgagggccatggtggatgaaaatgatgtctggtttagtactggaattgcacttggggttgacaaggtgctcacaccatgagaatggaggcaggaattgagctgactgagggaagatgcaccttgatctcaccctcactccaaggcacatagcaggatcactccctagcttctctgagcacacctagttggtttcatgtatgttacacatgcttccactccacagtacctaatttctctctgtcccctgagatctgaaggctaccttgggaagaggcatcagccatcttgcttgagaaccaccaagccaaaagcaaaagcttttatctatgatctcttgctgtttcatcaggggaaagcacaaagctatttctgaaattaggaaaaaaaaaaaaaaggtggaaggagcagccagatgttccacaggaccccaccaagaaggtcatttccaaacccatcctggaagggcccaggatccaaaggtcatcagtcctgcttatctgaccaactggcagtgtcttctggctgctggccggagacagctcttgccctttccaaagtcactgtccactgccttgcaattgccagcttgtctggtccagctttgggtttggtgagacttttgcaacatccctggttgtttccctggcaatgtgactatccagccctaacccaaagcaagggagtgcccctttcctgggtgaagtttacaagaaggctgcttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggcactggtaaccctgattaaccagaacctcccattcccagtatcgctgttcctacgcccatttcaccctcattaccttctgcttccaaggaatatgacagatcaccaggatgctgctcgtcgtgaggatttatctcaaaaaccaacatccaaaatgggagggagatgtggcttgaggtcaagcgccatgcatcccaagcctttgaccttcccgctatggaagtgcactggatgacagaaactgaatacattgctccctttccctagggcaaagttcgacctctgttaagtggagggatttgtgagataaaaattcaaaatgttggcctgaggcctgagagtgtcaccaaagacagagggagcttcactgagactcagagggaaaaggaaaagagcctcaaacatttttaggaggttgtccatcatgaaagtaaaaacgaaaagcaagatttgatctcccttcagttaattaggcaaggctaagtaactcaaagccccctattagtaacattctggttcactgaggtttgatcatattcctatctgcattccttcccttctttgaaggacagctgatctttcagaagcagaataaaattaagatgttagaacaaaggtctcagtctcagagaaccgcatcacttcatttgctcagacccatcctcttttgcaaaagggtctgcttggagaggccaaaattcagggtgctctcaaaggcaaagaaagcacattgttttccttctccagtccaactttcatcttttcttctgctgttttcttttcccctcttctttttcacaaatgttcaaaatggtctcatgcgcatgtgtcttgccccactttcccctttagctgaacagaaaattttgtctcagtaaaacgaagtcaaaaaacaggattcctccaaacatgcctcctcccgcactggccagccgagtccagctgagaaacttatgctagattcaatgtcattgagcaatgctttattgaagtctcgttcttctcacttctgcaccagtgagccaatgatactgacagaaatgtcatctctcttctatctgtggttgctgtttttggagtaaaagtttctgtgtgtgtttttttagttcttttgatggctgttgttttgcattgtaaataccatgatgggggacccccatcagaacatggcttatttaataatttatttcgtatttattgagtaatattgggaaaagagaaggaccacctctttccctgaattgctattgagaattggtccatctcccagctccaggtgctgctgtctgcagcaagggcattactgcccaggtaaggagtgctagaatcaccaagcaaattgaaattggcagaaatggaggcttcagtcacacaaattagactcaaatggaactaaaacactggttatctccaggaaaacctcatttagatggaaattaatggaagaataaaatgcctacacatgaaccaacttctattaaaaagtcacaactccttgaaaaaaaaaataaagaaaaattgtaaactcttttttttttctggccaaggaaagctatgcctcatcttctaacgagccaagccaaaaagactgcaatggtattcctatgtgtttctttggcctgtgtatcagtctgaatgaaatggaatgggtctctagcctcagtcttgtcatctgtaaaatggggcttgtcctatatattatctgcaagacgtgggaaatgggggctcaagccctgatgctatggactccatactgttggatatattgtctcttgtgtcttctgctgactgcagattaaagggtgtcaaccaaggaaggaaacaaaaaagtagggcctggacttcatttgcagaatgaggtcayagtcgttgagtcccacagtcatatatgggagacctcaagttgctgtcaccttgataactcttgtatcctgggttaaagccctctgtatttagtttgaacttctctctaagccccgtggtccaaagtcatcacgggagagaccaagatgggcttaccttgccctgctctggatttaaccattgttcattgtcaggctatatttttgtacaatcattcaaataacccagtgacataggtcatattgccacttttcagaggagaaaactgaggctcaggagggggagttgacatgcccaagctcccttgagctcagatcrgcttgactcaatgtccaacattcccttggtagctttttctccggggtcctgtgctataagaacttctctctgcactgtatttttttttctcccaattcttagctatttcctcaagcaatgattggccaaggacctagcataatccaccacattggccaaggggacgtggtgcaccccaaggccatttctctgcattggaggctgcgaatctcctctggaaaattcccaacccgaggacccaccatgagcccagctcagcctgaccagacagcctctgcctggagcattcacatcagatggaaagaagctgctgtgtcctccagcatcctgggaccctgtcctctgcccagtgacacagcagccatggctagcttgatttctggtctccaaagctaagcataaccttcccggggtttctggtttttcagcctgtacgaaacatgtctctgttctaattaaagttcccatggtatggtgttctcatatatggctcagtgttctctgtttatatggggtactcagaattaaaaaatggggagggaaacaaggagctagagaagacttaagtagcacctgctgcgtgtcatacatgttcacactactcagctcacatctttaatcttccaaacaaacctgtatgtattttgggtttttggttatatatacagcatatataccaaatatatacatgttatatatatatatatatatatgtgtgtgtgtgtgtgtgtgtgtgtgtgttagtagcagctatggagtgccttaggcaacctttttggaagcattttatatgtgttatcttagtattcagcaacaaccaaccctatgaagtaggtattaggaacttcttcttacaaataaggaaactgagtcttagaaaagtaaagtcacccaggcacagtggctcacgcctgtaatcccagcactttgggaggctgaggtgggcagattacctgaggtcaggagtttgagaccagcctggccaatgtggtgaaaccccatctaaacccctactaaaaatacaaaaattagctgggcatggtggtgggcacctgtagtcccagctactcagtcacctgagatacaagaatcacttaaacctgggaggcagaggttgcaatgagctgagttcatgccactgcacttcagcctgggccacagagagaaaacccatctcaaaaaaataaaaagaaaacaaggaaagcaaagtcacttgcccagggaccacagaatccagaattgatgataacatccaggcaggctaactccaaagcccaggttgtcaacttctttgctctgtagcactccagtatgtgtaatgagtaaccagagttctttggtggaactctttttctctgagatcttcttcatgggtgggaggaaggacacagattttggagtccaaagacctagattcaaatctagaccctgccattaccagctaggtggtattgggaaagcactatacaccttgttggtgcttggttggtttgctcatttgtaaaatgggatagcaacagccacctccctgggatgctgtgagaactaaatgagatggtggctttaaaaaacaatgaggcaccaaaagtagtcagtgactgttaatgagcaacatgactatttcctcaactgagactgatctgtggtggtgcagattaagtagatagcccaaagtagccaacttggatctgcaggagccctgcaaggccctgtggaaatgtcctcagtgtggaattaaattgtttctttccctccagagcagggactgaaaacacccccagggactgacaggtgagggaagcagataaggttagaactgtggggaactggagaactcagtagaccaatgccagatagaaatctcagctcagagttgccaaatcttcccatttttcaagagagcctgaatttttccattttaaaatctgattttaaaatatttataacttattgttttttcaaacactatgtgggtccaaaaccttacacacagacacacacacacacacacacacacacacacacacagtccacaattgagttgattctcaactggggagaaagatcaaagaaaacaggtgactgccactgctccccttgtatcctgcccagcagaaatttcccttaggagtcattggatgggataacctcctttgagtaaatccatgactatataccaccctccccaagtccccccaacacactgatttctttcttcccaaataggtttggataaagcaacaaccagtgtcctcctctgaggttccatcaataaataatggtaattaataataataaacatttatggatcagttaccacctgccatgccctttgcgtgcattaacttacctcctttggggagggttacctaatttttttacttttaatttttggggggtacatagacttatttcattctcataacaacatcatttagccccatttgacagaggacaaaattgatgcttatggagggaagaccacatagctagtaggtatttaaacttaggtctgtgggctccagggctgtttctgctacacctctttaccccctgaggggggatctctatcaactcagagctagccatcgttaagggcccctggtaacttcttcccataaattgtggctgccaggagactggaggatgcctgcacctttctatctcctgctccagcccccagttaccggaatccatgtgtttgtttctccagcaattgctctcaacaggcacttctcccagcccaggtgtctgggctgcagaggagagagacatccttctggagatatctctctctcaggccagattaacagctgcccaacgatggagcggaggtggcatgcattcaacaccaccgcctgggcagccctggggacacacacagcccttccatggggtgaaagcaaaggcataagcagaggggcgggaggaatatgggaaaaatcctcccgagaggcagggaccaagacttgttgcatggccctaagttaatcaagcccctctctaggacctagttactctacctgttaaaagggaatgcgctagaccagtggtccacaatcctggccagacattaaaatcatctgtgaactttacaaaaccacatatgctggagttccaccccaccccaaataataagaatctctgagggtgacattgatgtttctaaaaggctccctagagcattctgatatgaagccaggattgagagtcactgaattagatggcacctgaaatgccgtccaggtgtggtgtcctaggtgtgctactggatgtcataaaggggacaataaaaccagcacaaaaagcacccaacacatatagagcctgccatgtgctaagcatgcttctaagttcttcacatatatgaacataaattatatattcactgccacgacatccttataaggtagatagatacaatttttgatgcctattttgcagatgcagaaactgaggcacagacggttttccccaggtcacacagatagtaagtggtaacagctgaatgctagggtaaaagtgagtccaaagaggcacgtgaaacagccttgtggggtcaaagaaggcatcacagaaaaaaaactgacctctaggttgatcctgggagatgagtaggtgttggtcaagcaaaggaagggttaaaaaagaggagggaaaggggcaggcacagtggctcatgcctgtaatgccacctctttgggaggccgaggcagacggatcacttgaggtcaggagttcaggattagcctgaccaacatggtgaaaccccatctctactaaaaataccaaaattagctgggtgtggtggtgcatacctgtaatcccagctactccagaggctgaggcaggagaattgcttgaacctggaaggaagagattgcagtgagtcgagatagcgccaatgtactccaccctgggtgacagagcaagactatgtcaaaaaaaagaatcagaaaaaagaaggaaggaaagaaggaaggaaaggaaggaaggaaggaaggaaaagaaagaaagaaggaaagaaagagaaagagaaagaaagaaagaaagaaagagaaagagagaaagaggagggaatggagtcatctcagacaggggaaattgagtgtgtacagggccagagtcaatgacacccacctgcttcccccacctccccagcgtattccttccatgaggcttattaccacctataaccagtttgcttacttgtttacttgtttactgcccacctccatgaggacaggagtcttgtccacctcattcattcatctctgtacacccagcagcatgtggccagctgtcaagtgattgaatttgcctggagtgccagccccgctcccttccaatacccattcattcctgagctggttaatttttagcttatgtcggggatggggagtggtactaggaggactgtggcaaggttgtgacatgtcccatacagggactctaaggatctctcatgcacattctcttcccaccctgggaatgagagaagacagcatgtatggtagggtagacatgagcacatattgtttgtccagcattgttggaagcactggatatatacccttagatgagaaaatggcacaatttttaaaaggcagtggctgaaagcaaggacttgtgaatcagacagacctggattggagcctaactctgctacttcctcactgtgtgtctttgtgtagtgacctaacctctctgagcctcaggttgcttatctttccaatggaaatagtaaaagaatcaatcttataagactgctgtgaagattggtagaggtgatgcctggaaacgacttagcaaagtgtctgactgagtgttagttccattgttactgatcatttaaaaaaaagggaggggtgggcgtggtggctcacacctgtaatcccagcactttgggaggctgaggcaggcagatcacctgagatcgggagttcgagaccagcctgaccaacatggaaaaaccctgtctctactaaaaatacaaaattagccggacacatgcctgtaatcccagctacttgggaggctgaggcaggagaatcgcttgaacccaggaggcggaggttgctgtgagccgagatcgtgccacagcactccagcctgggcaacaagagcgaaactccatctcaaaaaaaaaaaaaaaaatgggtggggggtgggggtagatgctcagtcgcctatgtaagctcatgataatttctgggaggatttcaggtcaccttggcaaaagatagaacagtgtcttttcctacctttcatcaccgacaacaccagattctcaagagaggcactcccacctgccaccctccataaggatctcttcctctcagaaggatctaaagcctccggagaacttggcaatctccctatgtagatccccaccctgatctttcatcaacatcttccacccaagttgctctagcatgaatccatcagtgggaagacactggggcactgttcaggcctttccacccatagtgggtttacaaaacaggtttaccactcccttggaacgctgtcactccaccattgtatagctatggccaacctatagccagatgactcatggaaatttttcttttggtctttttttttccccctttgccatggaaacttgtcaaatgttttctgaaggtataacaccgtgtcccttaatacactctcaaattgaaaactaaaataacacaaatcacatcaaatagagtcatattgccaaatggaaaggggttggaatagatgtacacacacacacacacacacacacacacacgcacacacacacactgagcgagagagagaggatttgtttcttcccttcagtctctctcacctcaaaacctatttctagatcaaggtatcttaatctaaagaaaaccgtgccctcctgcgcttgggctttgtagagtctgtgaatcatttgaaattccaagccaagttttctgtattaaaatatcagcatttcagtgcagaggaggtatatatttccaccagttttccaagggattcaactcaatgaaaccttcaggatgcttccgcaaaacctatcttcattctctccagatgtggtggagtttctagttgccttccaatagccattccctcttcatccatagtaataaaaaaccccaatttataactgggattatagccacccagaataaagactgcatctcccagcctcctttgcagctaggggtggccatagctgcaagatgtctgagctatagacagaattcttggtggtagtgtccagaaatttttatgaaagagatttgtcatgtgctttttccgtcttcatcccttcctttttcttgctggctggaatgtggacatgattgctggaatgcatgcgactccctgattcatgaggtggctttgggaatagactccatatggataaagcactaagatagaagcggtctccagcttaaggacatggtggagcagggacacatattagcctcagacaga

SEQ ID NO: 10847 - DNA, 15495 bp, Homo sapiens
  misc_feature (1)...(15495): n = A,T,C or G, or insertion/deletion polymorphism (see Tables 1-2)
cctgacctcaggtgatctgcccgcctcagcctcccaaagtgctgggattacaggcgtgagccaccacgcccagcctaatcacagaagtttcttatgcgcaaggcatcctgcaggctcttcacctgcggtgtgttactcaatcctcccagcccagaatgctgaccatgacagagacagtgacttgacagtggctcatagtgagtatctcccagtgcttctcaactcatcatggcgatgatgacaaagacagtggtggtgacagtgactgcagctcacactgactgcctaccacgccagggacgattctaagtgctttatgcattttccctctctaaacagtggggatgttcagataggtaacataatcaccatcccctgttcagagaggtcaagtctcttacccaaggcaacacggcaaggaggattccaaccaggtgcaggggtctgactccacgagggagagtgtgactggcggttgctgtgccttccccaccccacctggagcgtcgcccccaccctggccgctgaagctgcaagtttttgagcctgaacttggaatctacggtgaatgatgggctgatgcagtcatggtgttgctatttataacagacccagccccctcctctcctggccaggagcactcctaatcgcccctaatcctcctgcccacctccctcgggatagggggcctcaggcagaggcatcctgggagaccctaacgagaaccagatgtgctttgggggaggagggaccctcccgtgccagggtccgggcggacggaggatggaggaaggaggcgggaggagggaactgatggggcagcgttgcggggaggccagtgggtggggaagaagtttgagggttgggggctcggagggcctcctgaggaacgctgaccccacaccttctcctggaagccctggaggccgcgtcgtctctttcccacgccgctcggcccccagcccgcccgtgaaccacactggagatttctaacagactttccaggtggacaagacaagggtgggggcttgccgaagctgggatagagcccccaagaacccaggacaggggcagggtcccatgggcacactctcgggagcgcccctccccactgctcccaaaagagccccagaacatcactggagcccaagcaggggtacctgccaggcaggaagcggaacatgggccatatggctcgttctgatcctcaagacctctctgagagaagggaagccgggcccgccagaggctgcccgaggctgcccagggcccaataacccgaaaacagcaccatgagctcacaaaccagcatctctgtccttcccttctcaaacccttcaacaacttcccactgctggggagacacccggagccctctggcagtccaaggcctgacatggtcccctgcctgcccccgacagccttttctccttccccaggtcccctgcctcccctcctctccgtggtcagcccttgcctcctttccatcctccatcccacatcaaggccttcacacatgccattccatgctgttccctaagcctgagaaagccaggtcctattcaggctttaggttttgtcttaaatgtaaattcccccaagaggccatctctgactctcccattctgtttagcaagggatgggcaggggcgttgtaattcctcatcagttctttaccttcccgcctacacacaccccgctgggcaggatgagtgtctgtccaccacccgcccaccacccacagctcactcgcccagtggccactctgtgcccagccctgtgccatgcactttacatggctcatattgaattctcatcccaacctacaaggtaggtgattttctttttcttcattttatagatgaggaaactgaggctcagaaaggatgggcatgtgcccatagcttacaggggcaggcactgggctatgagcgctgccctgttctgtctctctgggatatagtatcccagcacacagcaggcacccaggaaatgttcacggagtggatgagccaagtggccagtgagggacctcggccaggccatgctgtggccagggccggggctacctggggcccctccaggtcctgcccctgccctgctgagctgtgtgcctcagctgctcctcattaattaggccctttattacctgcctggaacaggaaccagacactgccccttcccaggcaggctgcgatccagactatgggaaggcagccccctcccctccgctccgctcttctctcctcgtctccttaaggccaccccagctggccaggaaaggaacggagggcacccaagccaggtgcaggatgagagcaggcaggggcccaggtggtccctccacccaggacccctcccttccgcccctccttgtgcttatgtgcccccccccccaccagctgtggccgttggctgagtctcggccattgtcccggggaacgggggagggtggggacacggcacagtgggaggcttgtgccctgcccaccccctcccctgccccgtcaatgaggcacttgtcaattcatgccccaaacatggcggaaatcccgtcagccacgtggctgtgggtagggtgggccggggcccgaggatgctggccaggcttggtggatctgaacctggggtgcagaggacaccagggcccaggcctatttccgacaaccccagttgctctgagtgtcctctcagagcatctgaacctgaaggatgccctagcttcaggcagcagctgagggccagggtggtagcagtcaagggacagcccacctgggcataaccacgatgcccagagagacctccagagtcaaagaggcctggtttctaatgtggacttcccacttgatggctatgaccctcagcaagtgacctgagccctggcttccttctccatcagatggagcacgaatccctgccatggagtgaaccttaaacgaggtgacccccaggaggccattccgcagtcagggtgaaccgccctgtttccatctctcttaggactcccatctcctttcctgcctgcacacctccgcccaggctgtcccctctcccccaggcccctccgccttgctgcacacgtgctccagagcctccgagggacatcctcaccttctcctaagtccctctgaggcatggtcagcactctgctgctattcttacacatgcacagcacagtccagcctccgggcctcggccccagccatcccttccagtgggtcagccttctgcgactgcctccctgcctgccctggcagcccctccccatcgccccagtcacagagggcccccagtgctgtggctcatctcccaaccagtttacatgggggcaaggcacagtggcctcacctcctttggtttgggctttctctctttattaatatgatctatggccaggcgcggtggctcacacctgtaatcccagcactttgggaggccgaggtgggcagatcacaaggtcaggagttcgagaccagcttgatcaacatggtgaaacgctgtctctcctaaaaatacaaaaattagccaggcatggtggcacgtgcctgtaatcccagctactcaggaggctgaggcaggagaatcacttgaaaccgggaggcggaggttgcagtgagccgagatcgtgccaccacactccagcctgggcgacagagtgagactctgtctcaaaaaaaaaaaatctataactgctagctgccctgcttcaggcttcaacttgtgaccagagccgtcttagtcaaaatgccttcaggtcagatgtttgcttgtgcaagcaaccctttgcctctccgcatcaaatctcagttagcttgggcccagcagccacacctgacaaagatggggctcttgagccgtttttctatcaggttcttcgatctgagtcacagtagtctttgttctctcccagcttcttaccaaaaatgcagaagagcccccacaggctgcctacagagacccctctcttttttttttacctttctttttgagacaaagtttcactctgttgcccaggctggagtgcagtggcacaatcttggctcactgcaacttccgcctcctgagttcaagtgattctcccacctcagcctcccaaggagctgggactacaggcgcctgccaccacgcctggctaattgttgtattttttgtagagacgggatttcactatgttggccaggctggtctcgaactcctgacctcaggtgatccacctgcctcggcctcccaaagtgctgggattacaggcatgagccactggcccagccggagaaccctctcttctaggagacccagaatctttagccacccttgggctatggctacatccactccaagtccccatgaagctgccgccctgtcctcaggtcaacataaggctgaactcacagccccaagatgctccaaagccaggtccaacagcaccgaggccagcagctgcgacctgttcctactctctcccacagggaccagggcaggcaggccaccaggtgccaggtagagaccctgcagcttggggtggacacaggtctccaccagggtcacctgtgcccatctgtgcctacacaccggcgtggccccacgcaggcacactgccaacacacacacatatatgtaagggcacaccctgcagtcaggtatccactgacatgcgcatgatcacgtaccacctgccccctactcacacatacacagtactgacacacagtggcatgccccacacatatacccacacacatgcgcacaccagcgttcatccgtgtgccttcattcattcagcagttatttactgagcacctgttatgtgccaggcaagcatagtgcccagctttggggctacagcagtgagcaaaagggacaaaagccttgcccacatggagctgacattctagggagcagagtcagatgacgagagcagcaaaatgcctagcattctagaaggttccagatggcggggacagccggtgcaaaagccctgaggtacgagcatgcctgtgcatgttcacacctcagcacacttcacaggtgtatatgccaggacacgcatgtacacaaacactcactgacccgacgacaggcccaggcccacaggcacagcgtcacatgcatgggttaggttagtggccacccaggaagagctcccacctcctcttcttccctccaagccccctccccgcctgctgtcagaccctccctaagcagctccggctggagccaggccccactgagtgaactcagtgtcacaggcacaacttccctcctccaagctagcagggcaggggatggggatccccttgccccagccatggagggagaagagaggggagtgagggaggccggagggagataggatcctcaaactccacaaaggagagacagaggctgtggttgtgcactccggcggctgcacggaccccggtcagctggagggagaacttccctcactgatgcgacctggggcacagggaggacagaatgtccgggagccccctccatactctaggccggcagggggctccggacccaactgtactccccacccaggggctttgcccctccccccctcactccaggccttggcactcgtgggatctaactgctaacatcacccaaccttgaccatgtgagtgagggctctgaggtctagagaggtcaaggaggctgcacggacatcacctggcgtggccacccgtgctggagccacccctcagcatgtcaggaggagaggccccttccctgcccatcccaggctggcacagagctgggacccaggctccagtcccagctctgttgtggccaccttgagggagcctgacacatcatcgccttcctgtcctgcctcacagtccccctcagaaatgggaggccgtcacccacgcttccactgcaccccaggactccaggaagacaacgtgcaaagagcctgggtgcagcagatgaagtcacaatacagccaagcccctcctccttgctggcagcaagaacagaacccaaatctcagagggggaggtggggcgggccccactggatgtgccagggaccaggaccaggccacgctgggccagagctgtcatggttcaggccttgcacacagaaccacagaacatgntcaacaagccccctaagcttaggggcactgacctaccctggggacnagtaatcttcaaggtagggcgcagaacacctgccatggaccaatggagtgttcaccaggccaggcacaatcttacctaatcaccccagaaaccctgggacggaggccctgccattacaactgcactcccgttttacagatgagaaagcggaggcacagcggtgccctgatacggccaagagaagcactgtgggtaagcaggagagctaggaacagaccccagctgccctcgctggcgaatgcacagaaccattacatcatcctaccccgagacccaaccaagaggtacccacaccccgtggcagccggggctgaaggcctggagataggagaggaggccccacatactccagcacccaaggcaatgagagaaactgaggcccaggaaggtgctaggtccgtgaagaggaaggtgggaaggtaaggcaggctgcctgggtagggcggggccacccagttaatgattcagttaataatttctgctcccagttccttatcagggagggcaaagtccaagggtggcagccaatgagcagctctgctgggctgttacccagcagcctctgctgccagggccctccagtctgtaaccccttgggagttggtaaktggggagtcaggcccccagggaaaaggccattctgccctcaaatgccctccttggctctacttaagaccccaaggagcactctgtccagccttccagtctcaggagagtccctgaggccaaagggttggtaactgcctgtttctcacccctgcactgaccccaggccctccagagaggtgctttctggggtgcgtcccccacccccgccgcctctgttcacatacccattgttgtcaccattgaccnggagagcacttcctgcccaccccccacccctgccctgcactgggtgctggggacatggggatgagtcagaccccctactaccatttcctcccctgcctgggctcaggaaaccctgtgcctggccacccctcccatctacttactccctgggtgcaccagggacagacagagacaggctgacacgggccacagtgccacccccatcacgaagcccagctcagcccccggattcctgtccaggtgggagtcctctcttccaaatcatcaggtagtctctacctgggacctcctcctgccctctggaggcagagatgttggtccctgacaggtagccccctcaaccccaaggtactggtggcagagtagggagctgggggctaggtrtccactctggctaactctggccaactcccttctctctgagcctcagccagcgccattcccctccccttacccatcccacagccgggaagggtggctttcaaaccagtatcctggtgcttcaggggctgtgaggagcccagcccccattatccactgtatctgtcctatcaggagactatgagtttgtttgatggttaaaaaatcacattggaagcccctgctctggtccaacccacttacttaccctgggaggggaatgaggccagagaaggaagtcaccagtccagrcacccatcagcttcagaaggggcgaaatcccaggcctccctcctccagccctggtggggctccagaggccgggcagaggcccactaaactccaagtggtctttccagcacctgctggaaggcgacttccctccatcctccaaggctccctgcacacccacctgctttctgggggacactggttgctcactcgagcctcatgtgcccctagaatctagggccagcaggcaccccttccaggctcggccattcatactctaacatgtctctccttcccagggctgggcagtgagcttcttcagagctgaggttcttctctgccaccccctcctgtcttgcaggtgaggaaaaaggacttaaagagggcaagagctctttgggggttccctgccaggcacagacggtcaccccactctcagtggtccagcctgcaccagaactctgaggtcctggcaggattctcagacactgccctgtcccgtgcctgcmctggctctggagtccaaagcccccttataccatggcccggttacctgctggaagccagtgcatcctgcccggtgggtcccctctctgcaggccctgtgcccgccgatctgggctgccttgcctctctctaggggattagccgggcggtcacgggggcccggctgtaccagcctcgagggggccgctctgtcccggcctcccacctgaggtccaaagcgccttagcccccagcccaccaccggcacagggcaggacccagcacctatgcttggtgtgtgcccagggagggggaccacgtcaggtgagggggcgcgctgtgctgcagccccttcggtaaaaccctttcccagtctcccagcccagagccgagagcacagggactgctacccactgtccagagggatgaccaaggccaagtggggaccaggatgagagctcaggtgtccccagccccagccccgagtgtgacagcactcaagagtgacgcagccacggctcaaaagcacaacttcccgctccctcgcacttcacacactcacaagcacaccaggccctgccactcccaggccttctctcacacctacagtgggtcccccacatgggccttcccctcccaagtggcctggagaccctaggcctcaggggccacccacaccttcccccatcgcaggggctgggagctgtttccagcccagccctcctagacgggcagcctcacacccctcccctgctccccacagacattcttgagtctcctcttatctctctggagggagtagcgcagcctccccccgccaggccgctgcatggctaagccgtggcgtcagcccccaccccccaacccatggtcaggagggagccagggagtccaggccagccaggcccacccctctgctctctgtcagggcccagcgtcctggggcaggcagtgtggaggtcaagggagcctggcctgcgggtcctctgggtacctagcaggctcaaggcactccagacagtaacccaagcaagcacgaatgtctggtcccctcttccctgaaggtctcaaaccgcgtcaggcccctcgagagctcctatggatcaacagtgtctggggagagccagagccccgggacagatgcagggctgcctaagaccctcagatggcccacctgatgcagagtcaaccattcaatctagtccaagcctgaactcttgggttctgggtctgtggggtgtccagaatcctggagtgggatgactgaggcttaggggtgcccctgcctgggctgctcagccagcaggtgtgaacaagggttcctgcctcccaagtcacagagggagagaaactgaggcaccggaagacctgcttctctcctccacaggactccacaggaatctggggcttgaaacttgggccttggttccctgccctgtagccctgataggttcacacatgaagggaaggttctcaatgcaccaaggagcaggatgtggccttagggactagagggagctcggggcaggggctgggctcgctgcattggtagacaggggcacaaaagggggccagagggtctggctagatgttccagggaggttctgagaagcggagtgggctgggaggcagtcagccagaacttcccctccccctcccactgcggtcccatccctccagaacccagcaccaggaggagtggtggccctgcaggaggggcaggggtcgtccaggaaaagacagggagttggttagatggaggagcagacctccaaaaccaatgtaggggtgggggcagaagaagatattatggggtgtatgtcaattccaccccagagggctcctttcggtcaagtgggggtgaggtcactctttgagggggcgaggtcagagaggcacagctccagggttggggggacatagtgctgaggagcctcagagggctggtgggatgcagttcacagcactagaagggtctcagagagcagaggtgaccggtggcagggatgtcagcttcaagaaggttccagccccaggagagcatgctagggaggggggtcccagccccaaacaggagagcagtcactaggcagcattgtggaaagcaggtggcagtctccaaggggatccaggctcgaaagtggtcctaccctcatggaagcacagtggggaggtcccagctcctagaagtcatgggggatggcgccaaccagaagggcacacagggggtcttggtctctaggcgggggtcacagattctgggaagcaggctggggtccagcctcaagaggtacggaaggtcctagaaggcacgccgggggtctgggccttgaatggggttgtatcccgcttggggttctggggaagcaaagtagagggtccccagactcgggaagtttgctgggggcgagagtgtcacaatttagggaaagttccgggtcctggaaggctcaaaggagtccggacctggaaggggacacagtcccaaggaagctgcgagttgaggagcggggagggggagcccaacttcagcggcggtgggtggtaaccgctgggggactcccagccccgggagcctgtcttggcgggctggtgccagcctgaaggagggtcccagccagaggaggcggaaacacagcgaggagccccagttcccggggagatcagccgggggttcccagcgccagagggtcgccgccgccagcccgcggtctctcaccttcgaagaagcgctgcagcgcctccgtctcgtccaccacctccatgtcccgcctgcccggcgcacactccagccgcggccccgctacagcccggcccgggggcgcggcatcgccggcgcggcccgcgcgacagtcccggctgggctccggctacggtcccgcccggtccgccgccgcgcttgccccccgcgcgtccctggcccggcccctgcccgccccacgcgccccgcccgccgcgcccagcgccccctgccggcccgcgccgcgcccagcccggccgcgggcaccacgctcccgactcctgcaggcggcgctcagcgctgggcagtcctaggcttgcggggcgcggggccgtcccgggtcgggggacgcgagaccgtcccaggcttgaggggcgcggggccttcccgggtcggggtgggggcgaagggccgcttggcctctgtggggtcgggactggaagggtgtgccctcgccgtcctcgccttcgtcttgcacgggacaagatgtcacgattccgaatccaaacctcagagacagcccccatccctctcgttagccacccacacaccccgctcagcaacaataacaacctgcatttagggaacgtgtgttatgtgccaggccacacaggcattatctcatgtactcctcacaggcaccttatcaaggagatgctgttgttacctgcattttacagatggggaaactgaggctcaatgcattaaggactgccaggaagccctgtcctgtggctgtgatgatggaaatgttccctgtgttgttcagtatggtagtcactggccacaagtgagcactggaaatgtgcctattgagactgaggaactgattttttcattttgtttaattgtaattaaacagttacgtgtggctgtggtattggacaatgcaggtctaaaagctccttttttttttgagatggagttcggctctgtcgcccaggctggagtgcaatggcgcgatctcagctcactgcaacatctgcctcctcggttcaagcgattctcctgcctcagcctccccagtaactgggattacaggcgccaccacgctgggctaacttgtatttttagtagagacggggtttcctcatgttggccaggctggtctcgaactcctgaccttaggtgatcagcccacgttggcctcccaaactgctgggattacaggcatgagccaccgctccccgccctgcctaagagtttcaaggtcattaaagttcagagccaaatcctggctgccccgggaatccgaactctcctttgccgtggccctgtctggtataatgaaacctggaggttctaactcgatataagtccaggataaagcggttgtccttgtgcccctgccttcacccttatgactgactgcctccacatctctgtcctgcccaacttgcacagcctctcgtctcactgatatccccttcagttctcccaaatcaccctttctgaaacatacatccgatcatgtcattcctttgcaaaactaagtttccctttgcactcaaaacaatatctgaatgtcttgctctggtttctcaggccccgcctctaccactggcctcagctcttcccctctctccattgctcactgaataacagccaccaagacctccttgccattgctcaaacatgcaaggcctacacctgccacagggccttggcacatgctattccatctgtttacaatgcttgtctccacatggctacttctttgtagcagttggtctcagctcaaatgtcatgtccccaaccagcctacctaaagcagttctccctacctaggcctttcttgctcaccatgtaaaagattcctatttagtttctgttattatccttcttgctctagaatggaagccctacgagggcaagatatttttctgtatcggtcactgctatagcttcaacaccaagaacatgacctggcacacagtaggtgctcaataaatgtgttgaatgaatgtatggtggcatcttcaaactaccgaatccagtcaggctccagtggctcacacctgtaatcccagcactttgggaggttgaggcaggaggattgcttgaggccaggagttcgagaccagcctgggcaacatggcaagaccctgtctctacaaaaaattaaaaaattaactaggcacggtggcacatgcctgtgatcccagctactggggaggctgaggaaggagaatcgcttgagcccaggaggttgaggctgcagtgaggctgcagtgagccatgtttgcaccactgcactccagcctgggcgacagagcaaaaccctgtctccaaacacaaacaaacaaacaaacaaaaatctacagaatcctggacctctgaaaccttgggagcggataattctggaatcccagacctagagaatcatcccgcttcagagtggctcaacttgaagcctctcgggacccttcaaggcagcacgtaaaagctggaaaaacctaccccacccaaccactgtttgacaagccactaaacagaggccagaggtgtgggggactgctggcagatcaagatgccaacgtagccagcttcggactctcacctctgccttgcagcatccccagggagggtggggcacaagccaggccaccccgtggggatggggtgagaggcctggaagccgctcccaccccagcctccctgtcagttctcagtggccagccgtgggggaggggcagccaatgcctgagccccagatgtggcccagtcagcaggcccatggtggcccgccgaaaagggtcaatgccacgacagttctggggttgggggagggggtgctgaggccggcgggtgcctcacaatgaggttttgtccctctgggggccgctctcagagctgttgctcttagatatatagaatgggattttgctggaggccccagctgtgtgtgctgaccgcagctccctcaccgcccccgcaggggctgggctgagaggggggagaggggccacactgagactcctattcttttccagctgatacaccccagaggtttttctccctccgcagactcccttaagacaattgttattctccaccctgcccctcctccacccggggtcaggcctgcctgcggacaaagtagacacccgcctacaccacgcgattctgagaaacggatttacattacgagtcgcctgggaccagccacagaaccagcttctctacaagcctccacatacccacggatctttcctccgtatcccacatactgcataactgaccatcatctaagttctcaccaccatccgttgagctacacattgtccctgtcctggtcagcaagggctggaggtagaagggaagactcgtactttgtccctaacgccccaactccattgcattataatcaattaagagtatagattattcaatctctagggtagccttgaagttggaaggggtggaatggagcctcctgttaaccctgtagcagctgacctggctaagggagctcaggccctgccatctcccctgttacactaggtcactgagcaaaggagcaactgtccccagggattttcatctctggactggaggaaagaggtggctgaaatgtcccagactcaagggctcagccaagagttgaggctgccatctgccaactccataatgaagttgggtcccaagcagcgctggggcagaggctggggcaggaaggtggctgggccggtgaaagtagcccaggggacttgcatacaaggacctaggggggcccatcaatggagatgagtcctcatctgtgcccctggcttctctaccgagccacagtgagtgaggggctgagatttcagccctagcccagcagacatggctgtcccctgtagccagctccacctagtccccaaggcctgccctctgtcctcagaggcctcatctataaagcacactcagtatccctgccttacagtggaggtaaagtgccaggtcagtgatcagtaaatggtgccctctccagttccaatcagctctcagcacccatcactgtcccttgagtgggagcagggccaggaggaggtggtagaccgaaggcagcactggggagagggatgctggcacctgagggttaatgggtaatgggcgtagaggccagcccaggagaaggtacagccctgtcctccccaccgtgggactctcctggcctcctgtggacccacacagcactggcatcaggccatttcgcagaggaagaggagggctcaaagtggggtgagtgtcaatccagcaagccagtgaggctggtggtccagcttccccggactagggcccaagggcacacctgagtgtggggtcctgcagggtagaccccttcctgactgcaggggcaccgggacaggagggggctgctgcaggtattgagtggagcgtgaggcagagtgcctctctagcccttcccagcactgccctctcaagaccctccccaatgccacaccctggctgcagccccgggcaagccacagagcctccctggccttcagtttcttctgcctgtgctgtgctcactggacaggataatttgcagaccattgagaccactgagggcaaagaacctctgaaagccatcaggtgtggtggaggccagagtcctag

SEQ ID NO: 10848 - DNA, 13515 bp, Homo sapiens
  misc_feature (1)...(13515): n = A,T,C or G, or insertion/deletion polymorphism (see Tables 1-2)
tggttctataagagaaaatttccctgcacaagctctctcactttgcctgctgccatccgtgtaagacatgacttgctcctccttgccctctgccatgattgtgaggcctccccagtcatgtggaactgtaagtccattaaactctttttcctgtatagattatccagtctcaggtatgtatttatcagcagtgtgaaaacagactgatacagtaatttatcagtttcttttaaatagaatgggccctagaaataccctcatggtgtgggcttccatcaggtggatagggtaggatcaaaaggcccagagaaagtctaaggaaggagaaacatgatcatgagatatgatagtaaaaatactacccccccaaaaaatatatacatatgtatttttttttttttttttgagatggaatctcactctgtcacccaggctggagtgcagtggcgcaatctcagctcactgcaagctctgcctcccaagttcacaccattctcctgcctcagcctcccaagtagctgggactacaggcgcccgccaccacgcccggctaattttttgtatttttagtggagacgggatttcaccgtgttagccaggatggtctcaatctcctgacctcatgatccgcccgcctcggcctcccaaagtgctgggattacaggtgtaagccaccacacccggcctatattttttgagatggagtcttgttttgccacccaggctggagtgcagtggccaatcttggctcactgctacctctgcctcccgggttcaagcaatcctcctgcctcagcctccccagtagctaggattacaggcgcccaccaccatgcccagctaatttttgtacttttattagaaatggggtttcaccatgttagccaggctggtctcaaacacctgagctcaggcaacctgcctgcttcggcctcccagagtgctgggattacaggtgtgagccaccacacccacctaccccaaaatattttacagcttgtatttgtgttttagggccgttgtacaaggtaccccaactgggggcttaaaacaacagaaacttattctctccagttttggaggccagaagtccaaaatcaaggtgttggtagggttaagctcctttggaagactctagtaaagaattcttccttgcctctttcagctgctggtggctcccaacaattcttggttttccttaccttgtagttccctcactcctatctctgcgtctttcatgtggcctttttccctgtgtgtctgttctcttcttataaacacattggtgatgggatttagggcccaccataatccagtataaccccatcttaatttattttttatttttttctttctatataagacagggtctccctatgttgcccaggctggtcttcaactcctgggctcatgggatcttcctgccttggcctcccaaagtgctaggattacaggcatgagccaccacacccggcctatatttttttattttattttattttattttttgagacaggatctcactctgtcacagaggctggagtgcagtggcacaatctgggctatttttagtagagatggggtttctccatcttggccaggctggtcttgaactcctgacctcaggtgatccacccgcctgggcctcccaaagtgctgggattacaggcattagccacctagcctgactgtaccttatcttaactaattgtatctgcaaaagccctatttccaaataaggtcacactttttttttttttagacagggtcttgctctgccacccaggctacagtgcagtgcggtacagtcatagctcactgtcaactagcttctgtgctcaagttatcctcctacctcagcctcccaagtagctgggactacaggcatgcaccaccatgcctaactaatttttttttttttagtagagatggcgtctcactatattgcccaggctggttttgaactcctaggctcaagtcatcctcccgccttggcctcccaaagtgctgggattacaggcatgagccactgcacctggccctgggtcacactttgaggttacaggtgaacattgaattgttgtgggagtccctattcaatccactacaggggtctacagtttccacttgactaaaagtgtcactaatactcaattgtcaaaaggcatgttatctgtgtagagcacgtggacaagtatactaggtttgagggacttccaattgagagactcaatgcactgtcacgcaactctatacaagctttatttcattttagtgaaaatgtattttcctctcatgggaaggaagcagaatatcagaattttaaagagaggagcagaatttaaagaaatccccacatttttacaacatagctgaagcttatatatcataatagtccacaggtttgtacttaggacttttgctttaaccatgatccagcaggcacggccgggacgggaatataattatttaagaaggaggtaaccaagtgaattctggattaaactgtcatttttccaatctccctcattgtgcagagagaaaggagaattgtttcaattcctcacacaatactcttatctcatccttggcaagaaccctcatgcctcttctttggcattttaggtgaggggcagctcactacctcccgagacaacccactttaccccaggacagtttcatctacaaaactgtccttttctttcttttttgagtcagggtcttgctctgtcacccaggccagagtgcagtggcaccattatggctcactgcagcctcaaactcctgtgcccaggtgatccttctaccacagccttgcaagtagctgggaccacaggtgtgtaccaccatacccggcttgcttatttatttacttatttatttagagatggggcctagttatgttgtccagcctggtctccaactcctggcttcaagcgatccttctgcttcagccttctgagtggcggaattcataggtgtgagccatgaatgttgcccagcaaaacgttccttaataagtaggttttatcatccccatgcttcagactagaacatggggcttacagaggtatcatatcatgcagacacatggtgaaaagactagaaggatatatatatatatatatagttataaggccgggtgtggtagctcatgcctataatcccagcactttgggaggccaaggcgggcggatcgcgaggtcaggagttcaagaccagcctggccaacatagtgaaacctcatctctacaaaaaatacaaagactggcagggcgcagtggctcacacctgtaatctcaatactttgggaggccgagtgggcggatcacgaggtcaagagattgagaccatcctggccaacatggtgaaaccctgtctctactaaaaatacaaaaattagctgggagtggtggcacacacttgtagtcccagctacccaggaggctgaggcatgagaatcccttgaacacaggagggggaggttgcagtgagctgagatggcgccattgcactccagcctggcgacagagtgagactccatctcaaaaaaaaaaaaaaaaaaaaaaaaaaaaaaaagctgggcatggtggcgtgtgcctgtagtcccagctactcgggaggctgaggcaggagaatcgcttgaacctgggaggtagaggttatggtgagccaagatcgcgccattgcactccagcctgggcaacggagcaagactccgtgtcaaaaaaaaaaaaaaaaaaaaagatgttatgtgattttcttaattttcctaaaatttttttccttccttccttcctttctctctctctctctctctctctctctctctctctctctctctctctctttcttttattgagacggagtctcgcctcgctttgtcacccaggctggagtgcaatggcccaatgtccgccaactgccacctttgccaccctaggtcaagcggttcttgtgcctcagcctcccaagtagctgggactgcaggtgtgtgccacacctggctaattttttttgtatttttagtagagacagggttttgccatgttgatcaggctggtctcaaactcctgacctcaggtgatccacccacctcggcctcccaaagtgctggtattgcaggcgtgagccactgagcccggcctcctaaaatgttttaagtacaaacgaattaattttttaaaaccatgattatgggtccttcagttcaaggtcactgagaaagtgggagtcaggattggaacccattactggacaacttccagtgtatgtggaattttctggactctcttccagtgaccccagtcttccgcctttattgtccttccagtttcagggctcctctcactccaggctgggcctccacctccagctgtggccctcatcccggagactaggacagagcagaggagggcttcatagtgatgggcccccaggcctgggcccttgagtgaggctggcatcaaggtatcctgtggcataccgccccccccatccagttccctgggcagccaccattgcgtttgtccctgtgtctccggtattaacacctggcgagaaagtgttggaaggagacccactacaaggcagcctcaccagctgtgtgatttggtaatttggccagattaaggaaggaaagcgcgttcgcctggagtgtggaatgaacgtacagggtgatcattaccgttttcagcgctgccgtcactgtcgccgcatgtgagacaccccctcctccccaaggccagtgattgcgccagagctcctgcgcgctggcaagcaggtgacgccgcgggtgacggccagccagggcgggggttgtgggggcgggaggcaaggggagaagagggcatgttcccgtcggtgaggcgagaactcacccgtggtccaaagcaacgagggcggggggcaccctccatctctaccgcactccctcggggcacacactggcgcgctccgcgtcctcaggtgctccgagcttccccgcgtcacccgcagcccagggcgccccccgcgacgccgccattcattcctcctacactgcgagcgcaccactccagagccgcggggggctacagccaccggactagggctgggggtgtctgccctggtgcgcgcgcgtcggcccagtttctatagacccctcctaggagagactgaaatacccagattcaggagacggagacactggcacagagatacaggagtcaagaatggagatagatagagaaaggcagacacttaagggacaggcatagacaaaggccataacacagcgaaagagatacggggcacagagacagagagatacagacacttagagatggactgacacacacaaaggcggagacagagacacagaccggcactcagaggcgcacggaccctgacgatctacttaagaccagcagagcaactagtacaagagcgcgtcagcggcaagggcaccatcccactggcccgagctcttcccgcgctgtgggttcgtgccttccccagtcaccctgtacccgagtctcctccccgcgcatttcccgctccccgctttccattgccagccctgcggccgccttcccgccccaacgcgcccggccagcttttgccctcctgctcccagtcccccttgcacgcctctcccagcctaggggtcagaccctcctccaagctcctccagtaccaggctcgatcccaccccccttcggtcccgcccctccccgcgaggtcccggccgggttggctggtactattccccaagacccacgtgctggccattccccgccacagtgcgggaacctcccactccagctgcctctgttcccggggtagctgggcgcgctcctgcccccggccccgcctctttcccctggccagtgcccgccccgcctccaccgcgccccgcccgccgtgctctgccgcagtcgggcgctcatcgtcattccgctcttgccgccgccgccgccacccccgccccccgcccccgcccccgcccggtccccgccaccgccgccgccgccgcctgcccagcggcccgggaggcggaggcgcgggggaggaggccccgcttggctcctcagccccggatgctgcatgacttcatccttccgccggctcccctgctgaggtagggccggtccggcagcaagcccgccgcccgcgccccgccgcagtcccgctcccgccccgcgcccaccccgcgcccgccatgtccgagatcctgccctacagcgaagacaagatgggccgcttcggcgcagaccccgagggctccgacctctccttcagctgccgcctgcaggacaccaactccttcttcgcgggcaaccaggccaagcgaccccccaagctgggccagatcggccgagccaagcgaggtacgcggcccgggcccggagtcgccgcctgacccagaaaccctccgccgggcgccccncggctgccgttccccgccgagtgcccgcagctcttgccgcagaccagcgcaccagccgctctccrgcccgggctggaggggggggtccccgctgcagtgtgtgtccccctcttcccttctcccgggaacacggtgccccggattcgatgctcgccacctctggaagcagagccctggcacccgggcgagggggaggggccggtcggggcatttggggctgcacggaagtgggagcacggggtaacgggctgattctttgggatcaaatactgagtcggtggacaatacgaagaaccttcgggtcgagagggacgtctaacaagagagggcaggaggccgggggtccgcttgtcttggttgtttgcatggggaggggagctctgttggtgccaggatcggaagaggggttccagcggcgagagggctcaggttgaggagagggctggaccagctggatactcggtttgagccccatttgagcagggggatctgttgaagtgcgggttgaagagggggattccgtgagcaagaggtttctgatcaactcagagggaggaaggctcaggtggcaggagggctcgcactgggagggagaatagctggagcctttggaagaggggcgttccgccatcgggaggggagggggtctaggcttggcggcgggttgggtctccagaagagttcggacggggaggacaccgcggcacagggttccgaggggcgtcgctgggccacgggcagtagctgcgcgggaagctaggacgcggggctcattctcatcgccgccgccccccgaggccgcgcggctgacgcgctttctccctgcgcagtggtgatcgaggatgaccggatagacgacgtgctgaaggggatgggggagaagccgccgtccggagtgtagacgcgccggctcgggcggcgggctccgggcccagcctcgcagcggccaggagcgcgggccggcgatgcggctgccggcgcccccccgccccggcccaggcgcccgcgggcgggggctgcagggccgtgccgccgccgccgccaggcactccggagctgtccgcttcagcaccacggcggccgcggtagcggcggcgcggacccgcccggaacccgccgccgcgctcatgcactttaaaacctcgggccgcagccccaccccgcacaccggaacggacacggagacccgcggcccccagcccccggcccgccccctcccgcacggctcccctgccccgcccccctccggccagtctggtctgcagaccgggcggccgccggtgtcggaccgcgcgcggccagggatgtttggctgcgtacttgcatgagctttccacccacttgagcccagtcctccgggccgttcctcgcccccacccctgtctggcgtgaccccagcctcagcctctttctaagggacttcctcagcacatttgtatttttatatccgactctttgtttactggctctgctcatggttcctgccctcccctcagtctcggccacgctcttctgcgcctggcagataggatgggtgttgaggctgggatgagacaagcccccgacacggttaccaaccacatggccagtctgcccaggcctgaccccaggaggctttctggcagaccccttctccccaaggtatcatcaccttccaagggcccagatccgattttaccttggacccctgcgtcttgcccctgggaacccaaatggggactgctctgaacctttggatgacatctgtggccccggagatgttctcaacccaggggtgcccttcgtaaatgttcctccatcctcactgtaccaggagtgtgtgaataaacacagaccccctctgtgtgtgtgtggccgctgcttaggtctcaggagccaggccaaaatgggagggggggcaggtacttgggaatctcaggtgcatgttgctggtgagggacggttgccaagtaagacagacaggccaggctggcctgggaacctcattatgatgtggcctccttgggtagagatacaacccaggcgtgactggtcaccagtgttggggatggagctagggtgagaaacataaagcaatctaggttcaaagcctgcagtctcctgtggataaatcaaggctagatgaggatcagtaacaggccccaggaacaacggtctccaggctggctggtgtgcagaggggttatgatgagctttgccccaggggatgcatcactggtggtttggtgtggtggcagaggaggttggggaacccaggagagaactgaggaacccaagaaagaagcaagaaacctggaatctggatctagttggagctgggctgtattggttcatgtgggttcgctcccaccctctatcttaggcatgaggcccctgggatgtaagcaccttggacccaaccccaagtcctaagtcaggaattccaactacctgaggagcccagggcagaatggcaggaagggtggaggaccatgctctggcctcagagctgaatggcactaaggaagtcctcatgatctgagtcctgaaggaagcaaggtgaggtgggaggtctggggggtgagaggatttgggcccccagagccagctgggccacactgagcttcccgcccttgtgcatgaggtagagatggaagtggaaaccgctgccataggtagcatgcctcagggaccagccataataggcttgggcatagtgtctggtccgaaagtggggggcagcagaagtcattgagataaaccggcctccagggacaagcacgcggctcacctgcaaggcagacagagaagccattggtgagaagtggatcttcaggttctcaaaggtcagtactgctccagatgctctcccagtcaaacctcaggaaccaccccacatctgtagctcaggctttccatggcaaagagtgagccactttctctgcccctggccattccttgggattagggctatattctattcagggaagggtataggagtgatatcaggtataggggcaccactttcctataactgctcaccttggcagtctctgtcacctgtcaggaacctggctgctacctcatccctatggcaacccagtaaccacatgtcagcctttgtgagcctgactactccagccgcctctataaatctcgaccccgcttaacccttccctcccttcagagagccacactcctgagggcgacccactacttgctccaaaacatgcttctggcttctgatttcttccagtcccctgaaacctcaaccccgcagccccacctattgatctgctttcctctcttgttgctccctcacctcactcaacacctggtccacagtgtggacaccttcagaggacacggtccagggatctcgttccccagccagcagggcatccagcgtgcccttctcgagcaccacatcaaaagaagcactggggaagtccagcttccgcacatccatggtctcccagcgcagctgcggcacatgggcatagcgagcctgcatggcagccaccacgactgatgagtagtccacactggtcacattagggaagcctccgaggaacagctcgtagctcagggcactgttcccgcaacctggggtgggagggaatgggtagcaaaagagctacgttagttttggttctcacctccccctgaatatccatccactcttggccccgttttctctcaatccaaaccctctagtactgagaggaggtggcagagtgcagaaaaagcacaagccttggaatcgcacaggcctgggtgcaaaccctggctctatcactcctagctgtgtgggctgggacaagttgtttaaatactagaaacatggatttttttttttttttttttttgagatgaattctcactcggtcgcccaggctggagtacagtggtgtaatctcggctcactgcaacctccgcctcccggctttaagtgattctcctgcctcagccttctgaggagctgggattacaggcgcgtgccaccacgcctggctaaaacttggatttcctattcagaaaaatgaagataataatacgtaggccatatacaggatatgatgcattaaacttaagaactaagagctaggggccaggcacggtggttcacgcctgtaatcccagcactttgggaggccgaggagggcgaaacacctgaggtcaggagttcaagaccagcctgaccaacatggagaaaccccatctctactaaaaatacaaaattagccaggcgtggtggcacatgcctgtaatcccagctacttgggaggctgaggcaggagaattgcttgaacccgggaggcggagattgcggtgagccaagattgtgccattgcactctagcctgggtgacaagagcgaaactccgtctcaaaaaaagaaaaaaaaaaaaagaattaagaactgtagagtagctgaaggagctctaaagttaggagttcagagatttgggtctgatattcctagtcacacagccacggcaaatcattcaactctttgagcctcagtttcctcaaattcaaaatggggataatactggtatcattaggaccataatattatcagtagcataataatgatataaattagtattatcctaatccccaacctcttagaaaaccttagaagatatcaaccctgggaaggcctcatgttaggggttattctactttgttttccaaaacagaattaacaagtgaaggggaaactaggtggggacacacagtggagctgactaattccttgcaattctttttttcttttcttttcttttttttttttttttttgagatggagtttcactcttgttgcccaggctggagtgcagaggcacgatctcggctcactgcaacctctgcctgctgggttcaaacaattctcctgcctcaacctcaagtagctgggactacaggcacgcaccaccatgcccagctaattttgtattttaatagagacggggtttcatcatgttggtcaggctggtcctgacctcaggtgatccacctgccttggcctcccaaagtgctggaattataggcatgagccaccacacctggccgcaattcttaacgtatgtattgagcactacatattaggctctgcccatgaataaaagtccctgccctcaaggagctcatgctccagtaggaacaaatgtgtcatcagacagttgctgcaaaacatgatgagtgtttcaatagagacaggctgtgagagcacacaggaaggtctggacctcacctcaggtgagtcagccaagagtttccggggagctgacaaccaagcaaagtcttgaagaacagagtcttgacaacttcccaacactctggtaggaagtgcctggaaagcagtcccaaagggggtagggtcaggatggagaagggatagaggtgagaggagtggatgtggatctatagtccaatgggcatgacttccttagaagatccagtggcctcttccaggccctcctatggccagtcccagcttgacaatggagctgggtgacagctcttgatagccccactggggatcttcagctcttgggattagatttcctttaatccccacttgcctccctaagaggatcatgggatcagcagttgggatagccctaatctatcagggtttggcacctggacaatgtacccagaggcagctggctgcttgctccccagctgccccttcccatgttcctcttcaagccctggggctcaaggaaaactatcttgcctaggaaaacccaacatgtgctacccaaagttgaagccacaaaaagccatgatagatacagcacatgggatgggggtaagggtggcagaacctgacttagttccaggttgaaatcccactgggtttgctgacccacaatcccttcattacccccacacctgacctcatatacctgtagagctctgccaaactgtggacaaatccagatttccttcctttgttctccttagtacaggatggcatcttccaagataactttaccaaaggtgaaggggaaacaaaagctggtcactggggcagtcatttttacaagcagtgacttttgattctgttgactcagagatttggggccagcaactaagaaggggcttgggaaagccactgccttccaaagtggagcctgagggaagtagagccttggagaattgatccatatccaagaatacatcacatgagggcctagagctgagtggatcctaactcaacaccaagagattgaaatataagccagaatgccaatttactaatttataacaagaaaaatagccatcatgggaacaggagttgaatcctctggccagtcccttttctctttataggaaatctaaattggaagtcaaattgattccaaattaagtttttttttttttgagacggagtcttgatctccgctcattgcaagctccgcctcccaggttcacgccattctcctgcctcagcctcccgagtagctgggactacaggcgcccgccaccacgcccggctaatttctttttttttttttttttttagtagagacggggtttcaccgtgttagccaggatggtctcgatctcctgaccttgtgatctgcccgcctccgcctctcgaagtgctgggattacaggcatgagccaccgcacccggctgcttccaaattaatttttgattatgatcaaaagattccaaagaatcgcttaagcataggagttcaagaggctgcagtgggccaagatcacaccactgcactccagcctggggacagagcaataccctgtctctaaaaaaacaagaagattcctacagagcatgaagtcaagcaagcataacaaattggagaagctcaataacagcaaagtggggccagccatccatatacattcatttgctatgaggatgtctcagccatagggaccagacacacgagtcttccaacagggtactctgttctctgaacagtcctggataaactgcctctctgattcccattttcaataaaaataataatagctaacagtcattgaacaccaagtactatgttaagcatttataagaattatttcagtttactttcatgttagagccatataaaggatact

SEQ ID NO: 10849 - DNA, 17553 bp, Homo sapiens
  misc_feature (1)...(17553): n = A,T,C or G, or insertion/deletion polymorphism (see Tables 1-2)
tttcaaactgatgtcttattcttcttagtgcttcaaactagatcctgttcagacatgttataacaagttagtaggagtttattttggtccaaaaattttgaaatccatgcatagttttttcatgatatgcattttccatgcactttttcaagacccctcatattttcttaaatttgagaaacaactacaataacaagcctaattcatgacagaactagtattagatttaagattcccagtttcctatcaccttcttttctactgttcctgaacagttccttaagttataggctagtcatccttggcatatctaacagtcatttgtaaaccctggatctttaagaatatcaggtgctgaaaagattatatcattatttctaagaaaagataaccaacagccaggtgtggtggcttatgactataatcccagcactttgggaggctgaggttggtggctggaagtttgagaccagtctggccaacatggcaaaacatggtctctacttaataaaaaaaattagctgggtgtggtggcatgcgcctctaatcccagccacttgggaagctgggccacaataactatttgaacccaggaggcagagattgcagtgagcagagattgcgccgctgcactccagcctgggcaacagagtgagactgtcaaagttaaaagctccaccccctccaatgcctttcctgaattgaatctattaattaaaaaaatactattttgaaataatacttatctttaaaagctggaagagtaaggaaaagaaatttttaattcagagtacagtatccacattaggctgaaataaatgtcaattttctgctcatacctgaccttttctgtgttcttttatcaaaataaatgtgtaagtcccataccttattatataaatcttcaacttcttgatcaaataaatatgacaaatgatgttctctaagaaaaacacccttcaattttattcctaaaacgaaaaacattcaaaggaactcattgtgcagaaacacaatatatacaagcctcatcattttctttttctattatgtcctcatccacatacattaatcacaacaaatcatgatgtgaacagcagtggaaaaaatttaatcattggacatttatttcttgaacttcagctctagttgtaagattctcattgcttagctctttaaaacaaatgcatatatttatctaatgtagaacagttaagacctccaattttactataattgggaaaaaaactcagaacaaagattatgtcaagtgtatcactgtattgactttgttaacctgctatacatctgacacaagggtaggtgttcaacaagtgaaataccaatcctaaaaagccagaagtctgtatctgctttcatagggttattatgagaaataaatattgtttaacagaaccaactctttcttttttgagacagagtcttgctctgtcacccaggctggagtgcagtggccaatcttggcccactgcaacctccacctcctgggttcaagtggttctcctgccttggcctcccaagtagctggggttacaggtgcgtgccaccatgcccggctaatttttgtatttttagtagagacggagtttcgccatgttggccaggctggtcttgaactcctgagctcaggtgattcacctgccttagcctttcaaagtgctgggattacaggtgcgagccaccatgcctggccaagaaaaccaactctttctatatactatatataaaaatcttagcagcctgggcaacacggcaaaaccccttctctaccaaaaatacaaaaaattagccaggtgtggtggcacacgcctgcagttccagctacttagagaagctaattggaactagagtatggctagaaattaggtattcctactcatataattttccttggggtgatactaacttggaaagttgaactttctaagaatttttcaaggaatattgtccaatttcttctgtgcagttatacaaatatttgctataggatggagtaaaggtacagatgtacagcatcattgaaggagtttgacctttttccccaaagcttgatttttatccactatgatgaatacattttactaaatacttgctactcttttccttctgctgcttccacccccacctcccacaggcttctactcctcatcagcaaaatatagaccttgtcaagcaatcagaatgttcctaattggcagaacactaattcgtgcctgagatttataatcttttgagtcttcttgttttcctttcatcactgctcaaaagttctattagaagaaaaaacactcccccttttcctttaagtcctagcactgcttctgatatttggaaaccacttgtctaataacagaagcattacgtataaaacaaagcataactagttttggagcgtattagggtgtagctgcccctccatatcaggcttgatgctgagaagacacttccaagttagcatgagattctagaagtagaaataattatgtaacaaataatgatataacaataatttcaaaactccatggctttctgaaacaaaagacagaactcaaacaatgaaaaattcggcaacacaaaagggtaggtcctcaacaagcaagataccaaccctagaaagcaagaagtctatacctgctttcatagagttattatgagaaataaatattgtttaagaaaaccaactctttctatatactgtatataaaaagcttagcagcctgggcaacatggtaaaaccctgtctctaccaaatatacaaaaaaaaattagccaggtgtagtggtacatgcatgtggtcccagctacttaggaagctgaggtgggaagattgcttgggcctggaagacagaggttgcaataagctgagattgcgccactgcactccagcctgggtgacagagtgagaccccatctcaaaaaataaaataaaatgaaatgaaattaaaaaaagctcagcataatttgtggcccatagtaactggccaataaataaatatctgttattattctttccaagtggacaattaatgagattatataccataaaataggtagatttcattaaagccttaataaatgttttttacttggacaatcctccatttccaactcactgctatagttccaggaatacttaatacatttaaaatagaaagatatactaccttccctgcatattttgagtaattatcttccaagacccatgtatcttttctcaacatctctgagagtacaattcctgaaaagagatattttcttttaaaattttttgtgcaatagtcaatgcctttgcaaataacactatctttaatacagcttacatatcctcatttaagtattcaataatcacaacggttcattatgtgaacagcagtgaaaaggtttaatcactggatatgaagttactagaagaagcaatgatataaccaaatgatcagattgagaacttccatgtcaacagtaaaataatcacaacaacaaaaaaagcatagataagttataaacaaatgtaaagatacaaaaatacaactaagaaaaaaaaattccatctataaaggattacttatttcctatgcagaagtaaatatctagagcagtgaccccttgcggctattgccttcatttaagtaaatctgttctgataaaagcagttttcagaaattcatctgaaattaacaattaaaggaatgttgtcagaataatgtaggaagcacactatttcatctttaggaaaggcaaatagttgcaatccaattaaacaggaaagaaaacagccctcatttcagatgatgaactggcagcagtactttcaactctaccttaagaaaatggcaagtgaatgcctgtatctgcaaacttttgagtccttaagaaaaggcaaacaccacgatgagacagccacttcacatgcacaaaaatgtggagaaactggcagcctcatccactgctggtgggaatgtaaaatggtgcagccactagggaaaataatctggcacttcctcaagaagctaaacacagttatcttatgactcaccaattccactcttaggtgtgtaatcaggaaaatgaaaacatttgtccacacaaaaacttgtacacaaatgttcataatagtaaaaaaaaaaattggaaaacccaaatgtccaccaactgttgaacggataaacaaaatctgctacatccataaaatggaatacgattcagcaataaaaaataaagtactgatacgtgctataagatggatgaactctgaaaacattccaagtgaaagaagccagtcacaaagaccatatattagttcataattccacttacatgaagtgtacagagcaggcagaggcacacggaaactaaattagtgtttgctgagcggggtgggggaatatttggaggtgctgctagtaagaatgaggtttctttctggagtgatgaaaatgttctaatattgattgtgactgttccacaattctgtgcatatactaaaacccactgaattgtacactttaaaccaattagttgtgtggtatgagaattatatctgagtaaaactgttacaaaaatataaggcaactaattttttccttaaagatagctaaaaacaatgttatttttattcagcctcactcgggtcttaattggttgagcaggaaaaggctctaacagcccaaccaacttacagtatttaaatccagttcttactctctgcacacaccttacagccaaaaagtatttgccctgcacatcccccagggaccaatttttccaaagttccttgaccatctatccttaggccatgtgacttttaaggaaccataaccaaaagctattaattccattcagagaagatacaagcatattataatggaaaactggtgtgaataagtaataccttaatatgtatcttcggctgtaatctggacaaagtaaacacaaaggggaaaaagaagcaatcttgttaggcctggatatttggaattatttttgtgtgctatacaaagaaacggaaaagttgcaaacccttctctgttttctgtatgctaaggatctccttctcagagacaaaaacccactggcccgtttccttctctaagcaaattgaaatctcttcctcaaacataagagcttataactaagacattgttctaagctctatctcctgaaagctattcataatgcctcattcccaaccaaaaccacttaattgccccttgtcccctgcccctattactactgaggagccccaagaaccttaccttatttccttcattgtggcaaagtgtttcagaaaagggttccttgaattaaaagtcggcgtatcctatttgactcctgctcctccggtatcacatacctacagccaaccatgccaagagcttccccattatctccgcatcggagagctacaagataaagcgcaagaacacgacacgcatctcagtaaatcatatatttttggcccgactctgtcttcaacacacctaaggcaccgtgttttatccctcttccataccctttcctcccgatatcctccagtttcagagaccgcacccggagacccattggcaggttcctggattcgcctcaattttggtcctgcctctctgcttcgcattttcaggcttggcctcacaagaaggacgatggcgccagattgtgccagaatgggtgaaaacagaaggaaaataaaccggttgcagcaaaacccactattccgcctccaacgcggagggaggagcggtcaaatgcacgtcttcaggctcaggcccttccgattggctgctgggacacaacgtggcctgtcattggctacggcaccggcgcagggccttcggagaggaagtgtggaagtcccgcgcctctaaagcccgcctttcgtgacaaataaaggtcgtagccgcagagtcaacgggcggagctaaagtggtcgtgattcatgctgtcgcgggaaccccgaaggtggggccccacgtaacaagaagatgacccgaagttgctccgcagtgggctgcagcacccgtgacaccgtgctcagccgggagcgcggcctctccttccaccagtgcgtatgggagcagcctcgaagccttcgaactccctgcggggcccggcgggccgtggcgtggcgtggggcggggccgggccgcactgtgggtcgcgccgcgtgtgtgacgcgacgtgacgtgcgcagcgtcggggcgtgggagcggaattggggcactgtgagaattgagattctctctcttcccgcccagtgtttacctctgaatagccggttctcgcaccgcctaccgctttaaggagagttacgcgaaaggagtcctccattaattggatggtcttattatttgaagtgaggangccgaaagggaaggcagtttaggacaacggttgaagtgtgtgtgtggcgtcttcctgagcacgagtacagatcagttttctcctgtactgcctgacattgcaagttcttaagtgctgttagcygagctgtgcaaggccggtccgattctggctggatttgatcatggcagggaagtttcatttggctcgacagtggggaagaatttcagatcagtcttatctgaactcatatccatggttcagactggtataggtcattcagtattcagggtacactagcaagtagaaaagtgggtaaaatagatcctcacagacaaaaggagcagatttatggaaagatcaaaaagaactttatggttggaaagggggggtaggaagagggtagttaggaatggcatgggaaaatgtaaaggatagaaagtgcaaatatagaggagtggaaaagtacctgagaaaccattttaaaaatgtaaatgccaggttaaggagtttmgagtatgtatggtaggctatgtataaaattcattgattttttttttkttttgttttctattttttaaatagggctgattcctccacctaaattgttagcagtgtgaaccaactcattgtgtatgtgagaccrtaattgatttgggatttttcttgtgatagaggtagttttaaactagggagacatgaattccaattttaattgagtatttactgatgtctgtacttggctctgggtcttggtttcttcttctgtaagaggaataaaaacctgccttgtagaattttgtaaaactaaaacgtaagactttatagcatatgtaacgcacaaggtaaatgctttaaaaatggtattattaccaaattaattttttccagaactcaaaactagttatgctagttagattacaatatttcccaacattttccttcttttttttttttttttttttttggagacggggtctcactttgtcgcccaggctggagagcagtggcactatcacagctcagcgcagcctctatctcccaggctcaagtgatcctcccacctcagcctcatgagactacaggcacagaccaccatcccggcttttttttttttttggtagagatgaggtctcagtgtgttgcccaggttggtctccaacttcttggctgggattacaggcatgagccaccctgcccagccccagcctttttcatagcattttacgcataggaaataattgttcaatactttggggcaaacctacagcactgtttggggctgccttcaagtaactactcaggtgtcccagcccaccccatggactaagaatatcaacagctgtactcactaggcatacctgttgggaagctttgcatcagaggaccacgctagtaatagaagttgttggaccagccaacttttgagggttccttgcacgtttagagactatacccaatctgtggaaaagctcccttgcaaaatatgttccatgagttagaaaagaactcagtgaaaaaagatagatttgccccaactttattggaaaaagaattccctgttcatttgcccttgatcaagtatcatcatcttcttagaacaataaaattataatcccagaaatggaattagttgttcttaggaaagatcgaactttggatagtactttacagtttacaaagtgattttgaatacatttgtagcctcatacactcttactacagccctgtgaggaagttctaagattgagagatgtgtctaataccatatagctggtagaaagtcactgaagcttaaatacaggttttccaattcagagttctttctcraggtgatttagagagcatatcagaattatgttttaccatgctgctatatttttgtagcatttagctgagaaataaaatttataccaatctcagttctagtaactatgtgttttaaagtctaaattaaaatacacaaaaagcatagttacctataagtctgtctctaagataacgtcaaagaagaaggggcagaaagagtagttttgtgctttttattgtgttaatttcacaagtttctttttcttttcttttttgagatgaaatcttgctgtcgcccaggctggagtgcagtggcactatcttggctcactgcaactttgcctcccaggttcaagcgattctcctgcctcagcctccctagtagctgggattacaggtgggagccaccaggcccggctaatttttgtatttttattagagacagggtttcaccatgttgtccaggctggtcttgaactcctgacctcaagtgatccgcccgcctcggcctcccaaagtgttgggattacaggcgtgagccaccacgcctggccgacaagtttctaaacataatttggcttggattgaaaaataaataaatgcaaggtaatttttataatcaaggctaggaaaaagtagtgcctttaaacatgaaaaaacaatatagtaaatatacttgtcttgttttctactgctgcataacaagttacctcaaaattcagtataaacatttttatctcacacatttctgagggtcaggaattcaggagtgtagctcgatgttacagtatctcataagattgcactcatctgaaggctgaagtcacctgctttcaaaaagactaactcaacatggcctttgactggaggcctcagttcctcaccaactagttttctccacaggactgctttataacataccagataccttaccacagagcaaaccattctctacagagagcaaggaggaaagcttgttcctttatgacgtagtctgtggtcacttactgtcacatgttctttttccattccttagcaaatcactaactctagcccatactcactcaaggggaggggaattaggctcccccttttttttttttttttttgttacggagtttcactcttgttgcccaggctggagtgtaatggtgcgatctcggctcactgcagcctccacctccggattcaagagattctcctgcctcagcctccccagtagctgggattacaggcacccgccaccacgcccggctaattttttatatgtttagtagagacggggtttcaccatgttgtccaggctggtcttgaactcctgactgctgatcctcccgcctcagcctcccaaagtgctgggattacaggcatgagccactgcacccagccaggcttcacttcttaaaaggaagagtaccaaatagtttaaaatcactacaggaaaggaaaagatgcatatattctttaaccatttaaatttgagcaaattctattaagtgtaggaagtgaagacaaaatatagtaggatttttaatatgggaattgcccctctatgattgacaaagaaaaatcagatattgaacctttggattaaaaaaaatcaaagaactttgaaaaatgaactaagtaaattaaacttttaattcacttggctttatgtttctataaagcagtaaaataatagatgggtttatatagtaaatactactgtaatagtactataatgttttcatgttaatggaactttaatgtgattgtcatagatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaaggtatttaaatgtaggtgtaagtcaacaaaatgaaaatttacagagcctttaaaaatcaagatagcccccattatagctagaatttgcagacaaaaaaacccaagtcttaaatccagtaatagattttaaatgctttgaaaatttaaaaaaaaaattatatatattagcatttgttctggagcttttaaaaaactatataaatgcaaatcatttgtctagatatatataaaggttactaaccaattgcaaaaatcaactggtagatataaatagccttagaatacaggcttttgttaagtatgagacagctttcatagtactttgaaattatctatgttttttggttcctcctaataatgttatttatcttgatcaaaaatatacctaattattaacattgatacaggaagtatgtgggaaataatgaaactttctatgagtgagtcaccagtattggtatgatattcttctgtttcctatgactgtttttattttatccttttaccccttaaccacaactctgacacatgggctttcactttctgcacagtctgtgatagtcacctaactgttctattctgacactagccttactttcctcttaatcgtcagagtctccttcttccagtattggtttatctcattcccctattcggaagtatttagttggtgtcaaattcaaactcaccaagtcccaagagcttcctattaactgatttgtacatttttaactgtcctgaattatcttttcaaaccatatatacttactatatatgtgataaatttgcttgctttcatacttttgtgtaaaatcaataatggctgccatgtgttgagagctacaatggtccaggcattgtactaggagatttacataaattcttatattgtatcttcaaaagaatcctgtattattatccacattttacagatgaggacacaagggattgtagagcttatgtgacagctaattgagggagctaagattcaaacccaggtcagtcttaattccaaagccatgcactgtccactatgccttcttttttgcacaaataacttctctgtcaccttcattaaccatgttattgtaccttctaagaactgcttaaaactcacttccatgaagccatcccagtttactaccacctttctctagttactttatttcagaaactttcaacatcatattaatatttctgtgtagtgcaaaaaaaaaaagcctgtttatattaccctataaactatacattaaaacattcagagattatgaccttttctttcctaactaactctccacagcaaccagattagtgctttgtatttagggtatttttacagatactcttctatgtgattatttctaaaataactttaattttatatatctgtcatagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcaggtacttccccctagtaacctgtagtatttacaaaaatagctgtttttctgaggtaccattaagtatttattttgttcttgcctatgaaaacatgctttcagttgggaagtgaaagtctcagtagcttaagaagaatgaaaattaatcaccaaaattcttttgtatcttatggttttccagttataaaagtaacatttattataggaaaagcaaagaaatatttaagtaattaaaataatgttgatcccactacccagagatgaaaccatatggtttataccattttctgttctgcacttatcactttttgtagtagctcttacccatttgctactgcaaattcattataaacagttttaactgctacataattttaccaaagtctttttgcagtagagttgtactagtttgcaaaatttctttgagcttggaaattgtgtatctccacatttttttctaaaatattctatagagtagactataaacccatggaaaggctacctagtcctctttagagtgaactaagatctttgaagaagggcaaaataaaaattgccaacttgttctttgatgaaagcagcagagatttggatttacattctaggaaaagagaaatgtgtcctctttttagaaaagagtagctatctccaaaggagatgaatattttatgtttttccaagaggggactagaggtcataaataggaatccccaccaggaacagaattttttttttttctcttgatattaggcaagatggtctgttcagtctgaatagtaccctatccccagaaatgtttttcatatctaattttcaccctcagataaatagtaagcagggaacaaaataaaataaatgtcctcattttattttcttttcagttcctctaaaaatctctcctctcaggctgccactgaacagtaaaacataattcaagttgaaaattttttcttccctctagtgaaatgattccagatgaaccgaataaattggtcaaggggtcctaagtggatattaacctctgaatagacttaatcaaaatgcaactatatttgtatttgaattctgatgcccagtgcattttatatccaaatgctataatctgtacctgaaaattttactattcatcacaaagaataaaaaaatttattttaacagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtaagtgaattatttttttattttttaaaagtgactttcttgtcaggacatcttgttgattgcatgttaattactctttagatgttaaaccatattattcttttgttgcattttacttattaaggctattagtactcatactcccatttaaaaaaagaaaaaatggactaatgaaaaaatggactcccattattagcccatttttgttcttcaaaaacttctaggtagtatttgccaattatcacaacagcaatattttcaccaacaaaatgaagacacatagtatgacaagttttttgcatctcccagacactctgggtggataaaatttgaatcctgaaatattggaatttctagtatacttcagtagtttaatatctgacgatcctggaaaatctagaacagttctggattgatcgccattggtcttaggcaaagcacaaaaaaatctgcgtttttcataagcactgcagttgatgccaattaggttgtccaggaaacagattttgataaataattttttaggatttgtgattaaaatggatagatataattctcttagtgtgcagcaaataacaatgattttctagtaatgtcttataaatttaatactgaattcttaatttttactgtttttaccactagttttacagattcctttttttgttttggagactgagtcttgctttgtcacccaggctgcatgcagcacagtggcacaatctcggctcactgcaaccttgccttccaggttcaagcaattctcatgcctcagcctcctactgagtagctgggattacaggcatgtgccaccacacccagctactattttgtatttttagtagagacgggattttgctttgttggccaggctgatctcgaacccctggcctcaagtgatctacccgccttggcctcccaaagtgctgggattacaggcatgagccaccatgcccagcctagttttacagattcctttttttttttgagatggggtcttgctctgtcgctcaggctacagtgcagtggtgcgagatcttggctcactgcaacctccgcctcccaggttcgacccattctcctgcctcagcctcccaagtagctgggattacaggtgtccaccaccatacccggctaatttttatatttttagtagaggtgggatttcaccgtgttggccaggctaatctcgaactcctgatctcgtgatccacccacctcggcctcccaaagtgctgggattacagacatgagccactgtgcccagcccagattcctttataaaaaattgtagattttcctctatacacactattacaataatactaccaataaaagatttaaaaataattgaccttcagagtgggctgctcttctaattgaccttcagagggctgctcttctaaaaaaatttaaagaggaaaaatttattattcccatacattatatataaataattactgttaacatttagagtatttccttcctgtgtgtgtgtgtgtgtgtgcacttagatttattagtgtttacatagttatgatcttttgtaaataaatttctaaccagccttttattactttattatgtatgccttttatctgtaacgttattttgaactctttatagacaagttttaatagctgcatgatatcaggtagtcctaccctacttaactctgacattctccagctattggacatttctattgtttacattttggggttataattgttttttcatatattttgatgaacatttgtatataaggcttactctttcataatgtgattttaccattcaagctagatattatacttatttataaatattcactttttgctaagcaagagagttttataggtactgtgttgataatttctcctcctatacctttttggttttttgttttctgatggttgtacatattctgggggtacatgtgatattttgatgcatatatataatttgtaatgatcaaatcagggtaattaaaatatccatcatttataaatccaaacatttatcttttctttgtgttgagaagcatatacctttttaatctcttcactggttttaaagcattacttaatggtatttcactatggtttatataagagatttcaggtaacttcttatcttttctttttcatggttttcttcatttcccatagttctgcgtcaactcctagattaaatcttcctggtaattccagcgcacatttatcttttctctcttcatgtcattttgcattttgtgacctttgctgtaacattatatatttagatttataattccagtacttaaacagttgctcatttctttaggtactttgcctataagtaaggtatattgtttagtatgatagtaatatatgtttgttataaaacattcaaacagtatataagtacataaataccagaaagtgaaaaacacagtacttcgcttcccctaatcccacaaaataactacagttagcagttttgtgtatatcctccaagttaaataaaaaaaaaaacctatttacctaccaataaaattttgttttagtgttctgttatattaatggtatatagagcctccgtttattttcttatattaatgtaagattatattatattaatataagattcttatattaatggtatatacgtttccatttattttcccatataaaaagtgatgtttttaacacagttatcttaagtattagatctttataatcattatatttaatatttattcaataaatatttattgatcaggagcggccagtgaggcaggaggaaaaccaggagattgtgatggcctggaagccaagtgtagaaagtatttcaaggagggagtagtccactatgtcaaatgctgctgggagatcaggtaagatgaggacagagaattgaccattggattttgcaagatgaaggtcattgatgaccatgacaaaagcagttatagtagagtggtggagaggtaaacctggctggagtgggattaagagagactaaaggtgaagaagcagagaaaatgattgtgggctcttccatggagttttgctatgaagtagagcagagaagggtctgtaggtagaaaggaacatgcattgaggggagggtgtttgttgagatggcagatgtcccagcgtgttcgcatgtttatggcaatgatccaagagagaaaagaaaattggcgatgtataagagaaatgataattgcaggaggatgacatccaacactactgtggaaggaagtatgaccttaaggtattgggacagttcatccattgaaacaggaagaaaggccagaagtacagataaaataggttaacagatttggtagtaggaaaatgagttttgtcttttaaaaagatggggtctcggctgggcacagtgactcatgcctgtaatcccagcacttggggaggctgtggaggacggaccacgaggtcaggagattgagaccaccctggctaacacggtgaaaccccatctctactaaaaaaataaaaaaaaattagccgggcatggtggcaggcacctgtagtcccagctactcgggaggctgaggcaggagaatggtgtaaacccaggaggcggagcttgcagtgagccgagattgcaccactgcactccagcctgggtgacagagcgagattccgtctcagaaaaaaagatggggtctcactgtgttgcccagattggccttgaacttctgggctcaagcagttgtccagtcagcctccctgagtagctagaactacagacatgcaccaccacactcagcaggaaaatgagtttttattgcattacttctgttttctcaaagttattaactgagagttgaggaggaaggcattagatttgggaagaaaggagaaaatgtgaccagtcacctaccaggaaaagtaagtaactagaaaaatgcagtaccagatttgtggtcaaaactgttgtctttccctccataatgatggagaaacaattagatggttaacaattagacgatgacagaccaaactagacttaaatttttttaaaacccttggtttggttagatagggtgcctcatgaatttctaattgtctatatctttctctagtcttagctacatcagatatttctctaattttctctttactgatgttggatcctttttcagttctccctggattctttatgtccaaaactttcccaaagctgtgttttttacaattttcagtgtttggggtctttaaagtaatttattttcacaaatcctttgaaattaagtcttaatatccttaactttccttgttataatagtgatatatttagtgtgatcttggtcatagatagaaaatgctggcacagttgctctttatttatatttcctctgtttctaatttttggcttatattcactgcagtttagtaaaccaactccctc

SEQ ID NO: 10850 - DNA, 29540 bp, Homo sapiens
tctatgaatgagttttgggaggatttaatgagtctcctcaaatacattggaaatattgtgcttatttgcatatgtacacatctatggtaaaagaagtctacctttttaaacagacttttaaaagaaaattttatctaaaatgttagaaatcactgctgtagagatttaacttgcttatccattctctacctcaagtaagaagagagactgctacaaaaaagttcccccaaattatattctggagcctttgttgaataatggggatgagctagtggatattcacaacctggcagtactgatttataccaaggtccttaatttttaagttcttcattttgttttttgctatatcgaagaatataacaaaagcattcacgtaaatatgccttcccattctaatgtattctctccttttgtccatcaaatagtaatggcatgctctgcattagtgttccatgctgcataacaaattaccacaaatttggtggcttaaaacaatacaaacatatttctcaggggctgttgtcaggagtccaagcacggtttagctggatgccctgcttaagatctcatgtagctgcaatctaggtgtttgctggttgtattgcttctgaaactgagggttctcttcccagctcatggtcattggcagaattaaatttcttgttctggtcggactaaggactcctttttcttgttggcaattagccagagaccactttcaacaacctgaggctgctctcaaatccttgccatgtggctgtctctataggcagtttacaacatggctgtttgcttcttcaaagtcagtaggtgagcatctctctggcttcaaatctctcccttcagaggaggcctgaatgcacttcaaaagtctcatatgagtaggtcaggcccatccaggataatccctcttttgactaactccgagtcaatttcctagggactttaataagcacctctgcagaatctctttacctttgctatagagtgtagcctaatcacaggagtaatagcacatctattaagaagttccagtcacagtcaaggggaggagattatatagaacatgtacaatagggggtgggattcttggggtccatcctagaattctgccttccagagtgtctaagatgccttgtttggcaagcagaatcttgtccttggcacttctcaaaaaggactaggtttaataacggctaaaacccagttttggggggcagttcagtgtctgagaatcagtgttgttttctttttccacataagtaatattgaaaatataatttttgacttctaaaaaaagtagtcgttttgctaccaatcccacgttcatagtctggcccttcatctttacattttccagctacctatgatgatgatgctatatacctactgtgtcattgtttagaaagtgcttaaaaaagtcagcttattaacatgaagagattttcaaaaatagtatgaggtaaaaaacagcttgcaaagttatgtatactataagtccatttttattaccacttcaggtaggtaggtagaaaacaaaaatggaaggaaggaaagaaggaagaaaggaagagaggaagatgggaggaaggaaaagaagatactaatagcagttgggtgggttttgttttgttttgttttgttttgcttaactttacttaaaatttttttcttcatcgaaattgctcgtgtaattaaaacatataattgttaagtgaagaacatgaaagcttgctcctgaagggtaagagagaataatgagcatttttcatgcaatacaactaccttggtttccagagatacatataatgtaccataaatgctgattctgtaccttttagttttagaacagaagattaacatatattatgacttttgttgctgttaattggagaattgggataaaaataaaatgatattcagtgaagtcaggtaatgtggctcacggaggaaggaaaaatcaaatgcacaaatatagaataagggaatgccaaactgggaatgttaccacagggaaagatctagtggttataagcagtgggtaataaattaggtatgagtcaataatacagtgttataaaaaaagtaagtgtggtagaaaactgagttgtattcacagaatactgcacctaaaatgagtcagagctttatagagtagaaagaagcaatcaataaaatacattttaaaaagtgccaaggaaaaacagaagaagattaggtgattatggctcaaattaacaacattgtaattaatgtgcctggaccaaaacatattagcatttaagattagaaagttacagactgaaacaattaaaatgttgaagataatgagaaatctttcagttcttaaatgcatgacaggttaaaaatttataacttgtagtctaacattaaggagactaaaaatactaaaaaggagacttaaaaaagagactgaaaatagactgctgtctctttaaaagcagcttacttccattttgagtatataatatatgcccccatttaacataaattatataaaaactaaaaagtgctcatcctaaacaaattttgggtcatgattatctaaagcattgaaagtatataattttgtactttaaatttacaatttcatgagaatatattttaatatttagaatataaactataatttcataccaaacagatctagatggaagagtttatatttcgcttgagagaattgtgctaaagtaaaaaactaccactatttagaaatgttctattagtaggcaatctaacctgctaaaaaaatctatagttgcataggtaaagcattacctattatttataaaaattataaaagatgattaccaaccactaatgcaggctcttacagatgtttcagatgtattatagtacgttacattcccgaatacttttgcaaaccaaatcttccattctgttcctgtggatttattcaatgttttcactttctacacagcaaaacaacaccatctacaatatactagaaactccagtccctctccgcaagaatacactctgtacatacttgctagaacaagagtttggtctctaaagcattatgagaaatggaccaagcacaggatttgaagttagaagatattggtcatagcagcaccaattagctctataattaaaaatatgtttcttctgtaagacataactcataaggttgttgaggacaaagcacatttaacatataactgccatgcgctctgtaaaaggtgtttattattgctaccactccattgctaaagaatttatagtacttttaattttcttctttacttaaaaaaattatgtaataatttgaccatgttcatcaatctcttgtatgtatcttttatgatacaagatgatgtcttgtatgatatccatgcctttcaataaatatttgaatattcctactaattttcaggtcaaatcaataaatatttgaattcctactttgtaccataatgtggtcaatggagaaaagtttaaatgtgtgtcttagtgcatttgggctgctgtaacaaaacaccataaactggttggcttataaacaacagaaatttatttctcacagttgtggaggctggaagtccaagatcaaggcaccagtttatgtggtgtttgctgaggggcaactttctggttcatagatggcaccttctcattgggccctcacatggtggaaggggtgaagagtctcttttgggcttcttttaaagagaaaccaatcccattcaggaagttgaaggctaatcacctccccaaggccttacctcttaatagcattaccttgtggattaggctttcaacacataaactttgaggggaaacaaacattcagtccatagcaatgtggttctttccttggggagcagctcatattagttgataaatcaatatcccaatcaattgaatcaaagtttcaccaaaagttaaataacagtttaatatttaaataacaacttcagctacagctatagtctcctttccacactacgcattctctttctctgcttaatgaagtaatgaagtcatcttatttctcatagtttcccttacctattgaatctcaagtttgagagttaatctgcttgtcttttcctatatgttgttttcatgtattcatctccgtaccttcaaatatgacatattcatgccttttgtcagctttgtcatttatgaaagataacttatttcaaaattcagctcaccattagctgatgtatcatctgtgtgtagagttgttgctgttttggtgtgttttgttttgttcactggcattttcttttcctagctgagttgtaagttgtccaataaaataataaccagcacttagtaggtacttgaaaaattttcattaaataaatgaatgggaataaatattgcttaaataaatgaatgggaataaactaagccagttgcttaattttatgccataactaaacatttttattatcaatcttatgattttgttggaagaataaagacttattttggggcttcttacgcacttaataattataaattgttcttttgaggtcagagaaaaattcttttgactgaaatattgtattattctaggccataaaataatttttaaattataaatttaatacattgtcattataaaggtttgggaaataaagaagggaacaaggaagtaaaaatgaaaatcagctataattgtaccattcaaagaaacaataatattagacttatatcgtacatctaattttatgttctttttaaggtttactattttatcataagtgtttcccatgttattagtctcagaaagcatcgtttttgttgttgttttgtgttttttctttttttttttggagacagagtctcactccgtcgcccaggctggagtgcagtggcgcgatctcggctcactgcaaccaccgcctcccgggttcaagctattctcctgcctcagcctcctgagtagctgggattacaggcacacgccaccacgcccagctaatttttgtattttttagtagagacggggtttcaccacgttggtcatgctggtcttgtactactgacctcgtgatccacccacctcggcctcccaaagtgctgggattacaggcgtgagccaccgcgcccggcctgcaccgtttttaatgactacaaatctccttagtatgagggtctggaatttaactatttttctcttgctaaacttatagtgttattcctactactctcccacttttcgccattcttatgggtaatccagtaacattgttatgcaaaaatttctgccgatgtttctgtagaagagattcttcaagctattttgattcacaaggaattaacattttaacattattaaaaatcttttaatagaaactgccaagttgccttcaagcatggacaatttatattcctcctaacagaataataggaatacctatttcactccattctcacctgggttatattttagcaaaatacatccaatagaaggagttggacaatgtgactttggcaaaacaaaaaaactttagcattgcttctaaaagcttggaaacttttatgatgtttctcttaatattcaggttccaattccaataatgtcttttgtttctttgtctagattttctatgcagttcatgcttttcaagcacggagtgaccatgaactcagccttcaggaataccagagagttcatatactcaggttttgtgacctaagtggcaataaagagtggtggttagctgaagctcaagggcagaaaggatacgtgccagctaactaccttggaaagatgacttatgcttaagaaaataagccttcaacttttattttccagcaagttgttgattgactacctcataaaactgacattacaaaactttggaccagaaagcaagaaacctctgaactacagaaactgatactgtactgggttttcaggaatactgtacttcctaacaggattattgcatgaatgtattataaaggatacatgttgaaagaaatactaagccaacagaaatagcaaagcaaatgacccaagcttcaactatcaactatttaaaagtgaagatcttttgaaggagtaattatattcttttatcatcaagaaaggttggatccaaaggtttttcaatttacttttttttttactgtatgatgtattttgccttaaatgtttttgtttttcatattgctctcttgcaaatgcatacatgtttatatacatacatataaaccatatatattatgtagctttatacacgtatgtggataatatgaattatacacctatatgtataaatcagagtatacaccaaatatacataagaagaatataccaccaactagaagtctttgataatatattttgttaatgtttcgtttatatgttttgaactaaaactgaataacttgatattaacatgtaacattactgaatgcacactatatgccagacattgttctaagtgctttatatgtagtaacttgtttaatattcaaaacattatgaagaaaccatggcccaaaaaggtgaagtaatttaatccaaatcacattgctattaagtggtgggcctggacttaaacctaggtagtgtaaaccaaaaataaaattctaaggcttccaaccatctaaatagacttccccttcagccagggcttttttctttcttttcttgttgtttttttttttttttaaagagacaataaaaggaggtttttttattcaaaggtataactggataagtagatttgtttacaatcattcttgtgaaatacttttttaaaaaaatacgatcaacttctttgcaaatagtagacacatacctcaacaatgatgacctaatttttgatccataatgtaagattaggtagaaataggcaagctcacactgctaaattaactatcaaatactcagtcaaaactccatttgtggcccccacttcttgatctatttctgttccacttcgtcttctaccatcttgccgactttcctgagcaactgctttgtcgactctctctacctgaccaattgccagatcgacmacctgactggcctgaccagccactcctctgtctggaattaaaagatgtttccatcataatattctttaatttcaggtaatttagctggcactgagagtatccagccggaatcatgccactttgcctgtaacctttgactcaattggaggaatatcaaagcaaacacccatatttcctttcaggaggcacactctggtaatctgagacactgcattactattcagctttctaagttctttccaagcacagctgacatcctgtatttcctctaggctttccagagtcatggtcacaaaccccttatcagagttgattaaagatcatggttcaaagcttgatacaccagaaatgtgggctaaagctgcagccaatgcatctatcgcccctttctcttctatcagtatctgagctgatggttggaaaaaaatcaacagcagcataagaaatggaagccagagaccttatggcatccatgcttttaaatttaactaaatccattgtagaaggaacacctacacatttaaaagtaatttgtgttttttgttccacatgtcttagttgacctttctcttggttgataaaaacatatacaaacccctgtctgtccagctttacccacgcatccagagagatggatataggactcaatatcctgaggaggagaactttgaatcaccaggtcaactacaggaatgtccaaaccacgaggagccacattggttgccaccaaaactttataattacctctctgaagccttttagtgtaatttctctttgtgactgtgcaatgtccccatgtaaacacagtgcattctgttttgtgcggattcatggccatgtcagttacattcttcttcgtctcacagaaaataatagccctcccttcagatccactgtagacttgaaggacatctcattttcatctgtgttttataaaggaggaaattgaggacctcacatggagggactggaatttaaaaccaggtcttctgactttaaggcctttcttttagtgttttcccttttcttttccttaagtcactaaaatctgtagttatataatcttacataaagcatatgcaaaatagaaaaatgatagtcaccacatatctactaatgggattaaaatgtacaatcctaaaagcttacttgttagcacacttgcttatctgtccattcattcattgaaccagtaagtatttattgagagttagtgggaatacaatgctgtgcaagacaaacaagatccctccattcataccacttaaattctagtggggaaaacatctgcacataacaaactaaataaaatgatcataaaataataaatgctatttatataaaactggctactttcattactgctcagttaaagggtcttgtagctcattttatgacatgaaaaaaatcaaggtctaaaagctccttgagacaatttaaactctaataccaaatatacctctataaaataccaaactgagctaaatacggtatatgtgtacttatacatatgtacataacctaaatatacgtgtgcacacattatctatacaaagagccatactcagtgaaagataaattacctcctaaactaaagtcccctctgaggtacaacagaaattaaaataattgcttctcttctcaactctatgtagcacgtattttccatgatgggataaatgttttcatttcaagtgccaatgtgtgaactgtaataaacattactgctttcattttttgtaggtatggaggttacattaactgttatagttgcggagctgagtttttatgtcaggtaattttgtttagtccaaactggttttgaactataaacaattatggatatgtattttttggtttctttgaccccaaagggaaattggggtttatgtcaaattgatgttttatcaaaataaatctgtttckcaaagcaaaagtctctgtaggattgagataattcattatttacatatagggtaaacagacatttactgcctattgagatcataattgagataatggattatctcaatcctggattctaatttactacaaataatttagcaccattatttaacagagcagtttaaaataataatctttccttaaaaaaaaaaagaccaagcttaattttaaaagctttgtgtttacagagatcacctatcaatatactttagaataatgatgttagaaaaacctagggattaaggaagacagtttgagattagagatttgtagagtgaagatttagtagcacaaatcaagtttgatggaacaggctgttcatagtcttgtgaatgtgtgaatttgttggatatccagtttttttgctgtgaataataaactgtttctctgatgcagagggcttcctatcttctctcagaatatacatgtacaacaattgctggttaatttgttagcttgcaagtaagacaacaacgcagaccttccacattttctgacttaacccacttatgcctagtgttccattattgcaatgctcggcttatagagttatttatatcctactgttcaaggtcatcatcaggtctgatttttcaccaaaaaaatttgcaacctctggcataaatgggttaacaatgtacaaaacaatctcaagaattaatcattatataggagcttattgtatacaaagttagctaaaattaggtaaagtgctataacattttgagcactaagtaagatagccttttctttcatggtataggaagaagccatcagtgtgtgaacaagtcatatatttccatctgcaaagacctttgtgaaatggtatttttcttcaaaacttatcaggaatgtgcataaccaagatgaatcaaaattcaacatttattacgtactatgtgcatgtattacattggcaatgtaggaaaagtgagcaatgtgagaaaaaatattgtattaagcaccaggagagttcacaatttattggaaaaagatatacccttaaataattgaaatgaggtgataaaaaaggtaaagatataatatgaagtatgataaatcaattaggaaaatccattgatatgagaaatcaataatgaaaaaataattttgaaaaagatgaaataattgggagggagagggagagtcagttgaaatggggctagcacagaaaatgaacacccagaatacggggaggaaaatagaaaactatgttgggtcgtccctgccgccacataaggcacctcattcatcaggatcaactcttggggctttgctagaagatgaactatttctttttccttaaattcacagatgctttcaatcttctgaagatctcattgagaaccagtcattctaatcattgttttcacacactatggaaatcattagaataaaaatgttgaagattgatttaaaatgaaagtttccaagttttgttatataatayttagcattttaaggtaagaaacaatagaaatttgattatgaagacttttattaaattacagtgtattacagattatatcataataataagcctttcatctttaggctaatatgatacaaaaacctacttggccacattacttcttgagtttcttttgggcagctttcttcttgaccatctgyaatcgcttcatagcattgagctgtgattcttgtgaagttgggcctttaagggatgctgagggagagctgctggattctgaagtagttttgctggtagtacttccactaggtcctgatgttccactatttccattcccacttagttggctgctgcttcctggaactaaactacttggactaggaagacctactttgctgacattgtcacaactaactgagcgactaaggccagttttacccaaggttagaggtggrggtggttttaaaggtacagtgggcgtagtgctgttattggaacctattttggaacctattccacctttggatgatgttgccagaccagtcaaacccacaggtttctggttagctgacgaagyagcaggtttcccagtattgttttgtgttgttgaactcaattttgctgttgarggaccagcagaggaagttttggctgcaaaagctgcccatccagttaagccactagttactgacgaggaaacgctggcactagaagaatttcctgaaataactgtggatgtctaaaaaaataaagtaaataattacattagagccaagtttaatcagtacctgtataaacatcccaagttatgaattgggaaatttaaatcacaccaccaaattaggttcttatgaagctgatctgaaaaaccacacagaacaaaacttatctgtatctagtgggtattatcatttgcaaagcagaaaatttttgataccatattcttgttctaatgattccaaaagaaaatatatgaaattcctttttgggaattgcttttagattcaattctaagctatatctgaaaaccagatttagtgctttaacatastttttacccaacaaagtattatcgaccttagttaaacatctaattcttttagacttttctccaaataactagggatcatttcaaaaatttaattcactcttaatagcaaaaatgcccatacccagaatattcaggagaacatatccaagatgaagagattcagtcaatatttatttactgagtgactgtgtgagagaaagaagacagctgtatagattctaaacccattaaaaaaaaatgtcctcctaaattttgagcaacagttacaggagtacaaaatatatgcaaagttaattacttggaagtgtacaatttttatgatgtgttaaaaagttctcatgattttagtttcacaatttgcccatgattccggttaaactatcatgtaagagtctcctgctcctttaataaggattttatcaattgcctcattaggctgcacagtgacattttgggtaggactgatctcattctctgatatatttcataagggtataacacttcaacttctctgattaactttcctggctaatcagaagctcacaatggtaccaatgccactatataaatacatattgctcttgttcacacaagaatatattttttcactttcatattaggcacaaatgtacgtattcaaattaattttgaattgaacttcttattgacaccttttctacctttatactcttaagaagattcacaaaagcattacattcacatataggtaaaagataaaattttacaaaataacatcctacttaaaaaatggtagttattatacctaaaatatatccagttataatttagaactttactctgaaatagttgataaaacatttttagctcttgaaatcaaggtagccttcaatattgtctgcatgcatacatttttaatcaatgtgaaaagtaacaaaaatagagttctgagatattcgatttataagagaaggaatccagatatttgtccacatactctgaaaattgataggaagttttcttacagtaacatattaactatcttatgaagttatccagagaagaaaaactacataaaccatttattcctagaggaatatataccagcaatgagagaaaaagttagtcaagaagtaaacctttaattttcagttatgaaagacctawttttttttccttttcttgctattaaacataaaactgtctgccatatggttaaatgatctttcaaaaaacttcacaaaagaaaacccacctttagtaattaaaagaccaacacttaggaagtacaagcaagaaagcatgttctatgtgtctggcatttcattttaatggcttgctgttgcttagtattgcttttcaacaggatgacagatggtttataatactatcaggacacatagaagtaatataacacaaacaatggagaccaagtgatttcttactatttcagtgtagaaaacaaatttctcaagtttttaactataaatattttcttgcctatttgctagatgggcaagttagaaaagacatttgctttttatatgtgaatgggaacaatttttttatagtataaatttattcacttttataaaaagtgaattttttattaaagaaacacaaaacctcttaatcaaaacaaatatgacagcagtctttaatttgtttgccataaaatgatttcatgttgaattttctaaaaataaactttagtagtaacagattaatctaaaaatctactaaaaagtgattatatgcagaatatagcaactctaattactttcaataaactggttattcttacttctattccaattcaccaagttcctatatgacaaatcaataatggatatgccttggatagcaaatcttccctggcaaattaaaatgaaaaataatctccaaatataattatcaataagtttttaaaagtatttcgtattcatattctttttcatcacatcaagggtatgaagcttactacttacagtcacttagataaggcaataactttagagttttctcaggtcaatctttgagaatttgaggctattttttttttaatattttttcttccatatttagtgctatgcttaatattggaatgtgtacctcagtaaaagtattctttttgttatgaaattagattagaaaattatttttttccatgatataaaaaggccaagatattaagaaataatgtagtatgatttcaaggatgcaaacttaggaatgagaaaggtgataccctcactagacaatgtggtcccttggtataagaggtagataacattgaaagtttattataaagaaacaaaacaagacaaagcaagaaaactccttcaacagccaataagaagggagaaaaaaaaattacaaggccaatctgctcaagtagtgtggggagcaaaattgttgctactgagggcagaggtattttgaatttaaaccagatttctttttctttttttgagttgcagtttcgctcttgtcacccaggctggagtgcaatggtgctatctcagctcactgcaaacttcgcctctggggttcaagcgattctcctgcctcagcctcccaagtagctgatcacaggcaccgccactatgcctgggaattacaggtgcccatcaccacccctggctaatttttgtatttttagtagagatggggtttcatcatgttggccaggctggtctcaaactcctgacctcaggtaatccacccgccttggcctcccaaagtgctgggactataggtgtgagtcatggcacctcgcctgaatttaaaccagatttctgattgaagacaaatatctaaccagatgagaatggtaaagaatgtcattttggaatgatcatagactgttcgtatttgtgataaaaagaaaaacaacagagttagagattaattaatgatataaatgttccctttctacctaatataatagtagtaaagtcttaatttctaaaatatagccatttagtatataaagtttctcattaaatttttwatcaagcaactattttttagtcaactaaactttaagatataatcttagataaaaatagaatctactataccttgacttctgttctcttaaacgctagaaaagttgtctcttgtttcagtttagtttctggtttcttaaccaatggatctttgacagctggagttacagaaacaactgcaggggctggtttctgcggtggtttctgagttttttgagcctgcaaaaatcagtggattaaatcagatacaaaatcttaactgaatatacagaaagataatartccctcacaggactcatcactgaaatgaaatacagttgaacattttaaaaaatagtgtgatgataatgaatatatatgctctttgacaaattattatcatattaatggtcttacagattgtattagtttctaaacagtaaagataatattaagctttagaaataatacagaagagggttagttaaataccattttaacaagataaaattgttttttaaagagcaaaatcacaaactatatgtaaccgttagctttactcatgatgaagtacatttatttctcattggggtttgtcaaatacacaagagttttcttcttggggtctaggcataagtcgactcctcagttgctgagggcaaattaaaacacagctcagatcatttatatggttttaaatatagaacagggagaaaaaaactattgataaatgattaaactttttgaggtttttccacattgcaaaactaggcacactaaatctttagagaaagttaataaatacaaatttctatgttatgaaagaattttcacccactattattttataagcatcttcagttttattttgaccaataactgattttttcctttattttataactaggtacttgactaaattttcctataaactctaatcatttttgagtttattttttagtgttttctaggtagataattataactgtttataaatggttatgtgccatgtttaagagtaattttcagagtcaaacacagttaggattaaaacccagcaactggctgggtgcagtggctcacgcctgtaatcccagcactttgggaggctgaggcgggtggttcacttgaggtcaggagtttgcgaacagccagaacagcctggcccacatggtgaaaccccgtctctactaaaaatacagaaattagctgggcatggtggcgggtgcctgtaattccagctactcaggaggttgaggcaggagaattgcttgaacccattaggtggaggttgcagtgagccgagatcgcaccactgccctccagcctgggcaacaagagcaaaactccatctcaaaaaaacaacaacagaaaaaaaaacagcaactatttttctagatacattacctcaggcaaaatatgtgaatctctaaaagcctcattctcttcatctgtaaaatggtaatagcatttgtttcaaaggtgggttatgaggatgaattatgattatgtaagagtttagcatagtgtctggaaaatgttgagtgctaacaaaaagttactgtttattcatcattattatttacaaaggataatcaaactgaatccagaaaaatccatgcatactgaacggggaaagatgcttcccgccagccattccatagtctttgataatcttcataagcccatacagtactataccagggaatttattaacaatttgtcaccatttctggaagccagaatttggcctattttgctcttgtttgggccttcttgtgtaatcttgggctactgtttgccatactatatagtttgggtccttaaatctcaattcgtatcactttttatactacataccttccacatcaaagtacacctaccttcaacatcacttataaagcaacaattagatcaagaatattaagaatgttcgaagtaattcactgttgattacttgattactggtactagcaggaaagcagagccatcttatccttcattgcaaaaccatgttacgagaatgcatccctcacagtaaaacagaaacatatggctccaaaaccatggctttcaatcttaacactgccttccacccacatctagcactcctgaggttagactctgaggacccacctaacttgtatgttttaacagataaagactaattatgatgaagccccaggaagtacttctgcctgtgagatcatgtttcaatcttctgccttccctgttttatccagccatcttagaaactgagtaagaaatacccacaaccctttgtcctttactggtaatactagtttagggaactaggatataattactgattcagttttgttcaacaaaggtactaaaattttcattggatgactgcttcaaacattgcaaaatgtataaaattctccactaaggcactaactgccagaatggcagtactaaaaaccccacctatttctaaatgctgcaaaataggagtgtgttactaccttagattgagaaccactgcaataagtgatatgagtctctcacctgaagctggggaaaaactccactactgcgtagagagaaaactatagaactgaagaataaccttggaccctgccatacacgatcacaacattcttaactaggtcttcctacaatgatgtgtaccgcagaacttgccccagtttgaggaatctgtttgaggagaaaggggatatcaggtcctatttataatatctttgagataccttggaacaataaccaatgcacatatgagaatctcactcaaagcaattatagttagaatgactgtatttagaatccccactgttccaaaattatctcattaaaccttacatttcctggattctgatctttaggctcacttcagatcatgtcttttggtatttccccacatttgctcttggtgtattctagtcatgttataatattagccatgactccccatttagtactttgacttctggacacacagaccagattcactgttgatttctggtactaatctgcatttagcctggcatggtggctcatgcctataatcccagcactttgggaggccgaggcaggaggatcacttgaggtcaggagttcgagaccagccctggcaatgtagcaagactccatctctacaaaaaataaaaaaaaaattagctaggcctggtggcacatgcctgtagtcccagctacttgggaggctgaggtgggaggattgcttgagcctgggaggtcaaggctgcagtgagccatggtcatgctactgcactccagcctagaaaacagagtgagaccctgtctcagaaaaagaaaaaaattacatttgcttcattttatttaacttaagaacaacagaatgtagaatgtgtccagtcttgagctctgcttaagtgctatgccaatgaatacatgctcttactgataaattagatattatttgcaaagcagataaaagaataaacagtatcccagatgaagagaagaagctgagaagcagaamatatgggaacatgaaagttctccacatattcagggaatgacacacttagtctgtgtcagagtggccagagtgtatgaatgtgtatgctgaagcagtgagagagagggctgtaaggtagagtcgggtcaaaaagagaaggtccatatatgcatcctaatgagtataatctcattatataagtaattgagagccactgggcatatataagtaggtaaatattttagaagaattctaatgatagtaagcaaagtggattgataggaggcaaggagatttattaagtggctattgcaatagacaagtaatggatttgtggaacagggtaataaaagagaaatgaatagatttcagagacatataagaggtagaattagcaaatctggtaaacaatgggatatggaattaaaagaggcatcaaagatgttttctaattcaggcaattgcagaaaaaaaaaactggataatagaacaactttcacttttaaatatattgaccttaaagtatctatagactatctagttagctatagaagctcacccaggaagagggttagaaccataaacatagatttgacataaatcagaaaaaatggaggagaaaaaacttgggggaagaacagtgcttactttagatattaaaggagctaaagtgataataataatgaaacagttgagtacatactaaagaaagatagattattgtcacaatttgtttcttttgacaatttccaattcttagtggtttcttatcaatgctctggaatgcattgctcatctgtaataatttcacttgagatcctggagggctagtttaaataataaattaaataaaaaccaaactgagcagaacagattgtaacttgtcatagaaatttcctgttacaagtaagaaatatacacactattgatatacacacttttcatttactactttttatttcataggaataaataaaaacacttcctatttctgatttaactgattaaaaagtaaaatgggtatcccgagtttttacttttaactaagtacttctgacctttaaaagatatattggttagacaaatttatatagaaattcatttgattaacagacatgagaactctgcaattgagaatcactaatttaaggcaggggaagagagatggaagtgggagggagaggtggagaataagacattatggcaatttcttgttttctttaaaagaaaaattatgaaattcatttatcatttatctattttataagtgaataaaagttagaaaactatccaatataacaaatgaaaagatatttcactatgatattaaaggcaggtatgttagtcaacagtaaaaagagaaagtacataggaagaatgaggtaatggtcacttgaggacaatgagaaggaaagactaagcaacagagaaatgcagctggaaagacagatatgcacatataaatatcgcctctgtacacatcttatccatgcggtggtttaagctcactcagaaattttctatatttccttaccagatctcaacaaagagtggggctttgtatctcaccacttctcagtgctgcatggtattttaaaatgtttgtcaatacattgacagactagtaaggaatattcataatttgtgtgtcaccaatcttgttttatctatattagaattagataaaactaaaaagagaaaaatgcacataacatggtctggtctttagcaatagaaatattaatcacatgtacatrctatacatataaataaataatcagcttatattatttattttttcaatatcttaaatattcaaatctttgttttgaaagcacataccaacaaaaacattgacagactgtttaaaataaagaaaaatatgattcctaccattcttttcatttgtctggtacatcgggcacaataccacaccaggcgagggtcattcgcttccttgtctgtcacctgsggtttatgacaatctcggtggtagagattatggcactcctgacattctactaattgattgccagatgccaccatcatttgcctaagaaaacataccattaaacattacactacttttttaaatgccataatttaaagttatttcaggggccaggtgtgctggctcatgcctgtaatcccagcactttgggaggccaaggcaggcggatcatttgaagtcaggagttcaagaccagcctggctgacacggtgaaaccctgtctctactaaaaatacaaaaatcagctgggcatggtggtacacacctataatccccactactcaggaggctgaggcaggagaatcgcttgaacccaggagatggacgctgcagtgagccaagatcatgccactgcactccagccttggtgacagagtaagactctgtctcaaaaaaaaaaaaaaaaaaaaaaagttatttccaggttgttctggtaaagtttggtatattaaaaagaaaaaaaatcccagaaacccaaagagcaaataacaaaccccaacacttggcatgcacaaaagcataagcttttaaagcttatggtcaaccattaataaatatatagaatgccttaattaaatttggctattttctcgtcatttctcgtcataatttttgcctttctctcagaaggtagtagactctgattagtcttccaacagcctcataacattttgtatctccattaaattcccttatattagttagctgtatgttgttgttgttcttcattaatatgagtcacctaaaggtgagtactggacctaattatccacagtccttagcacattactgtgcacacatagggtgctcaataaatgtctgatcagattaatagaatgaagccatgtgtgtataaaaaagtataaatttcaacagcacaaaaagcaatcaccatagccttagattatcaaaggcatatatatcataatataataatcactttccctctggaacccaaaaatgcagaaaatgttacaacataacagatttaaaagccatagttgggaaagacaaaatagttgacaattttcaatatgctaaattgttatatgggcagttacctacttatctccaccccagttccaaatagtaaaaacaaaatagaaaatgcacaacaatttttctgattttgggggttgaggagtggaaagggtcatgtgttctttataaagtaacaaaagaatctgtggcaaggtacaacttacctacaaacaacgcargccaatcccatctccatggcaaaatcatcagcactggtctcctcaaaactggaaaggtcagccataggtaaatccttgctactttggacagtaatgggagatgactgtgtttctggtttctccaatctaggtttctttggaatatcaactccttcagtgatgtctgatttcatctataaaaagcaggcatcagaaaatgataaagtaatgtggtagaataaactttaagtcactgaaagacgagtgagaaggacaattggcaatgaacaagtccattttacagatatattcacatagttagggacagatgtgcacattaaagatctgtagaagaattgcaatgaatttattagtatattaaatgaaaccagcaagatagaaataaataaatcagaacagtttaacaaatatttgtatttctctttgtactcttctatctactaaagaattatggaagatcgatggatttacttagactagtatctaccatacagacttaacacatatttgcttcaaagcaaattcggattcccttctttaagatataaatattatcaatatacccattagatttggcaaaaatcaaaaagtctgataagacatggaatttggaattcttatactttgttgatgacagtgtaaatttagtacatctacttttgatagaaatttggcaatgcctagtaatgttgaagatgtcatatcctattatattcacttataggtatacatcctatagaaactattaacatgacatatgtataaagtagctcactcaaactccattgtaatagaaacaaaggagaaatatctaattgtgcatcagtaggggaatgataaactggttaatcattcccctatgataaatcagtaggggaatgataaactggtattatgtagtagctaaaagaaatctagatctacatgcattaacaaagatacatttcaaaagcacatagttgagtggagaaaaagttaccaaaggatatacacacacacagtatgataacatttacataattttttttttaagacagagtcttgcagtgttgcccaggctggagtgcagtggcacaatctctgctcactgtaacctccgcctgctgggttagagtgattctcacgtctcagcctcctgaggtgctggaactacaggtgtgcgccaccacacctggctaatttttgtatttttagtagagagggggttttgccatgttggccagggtggccaactcccgacctgctgacctcaagtgatcctcctgccttgacctcccaaagtgctgggattacaggcatgagccaccacacccagcttcacttatgtagatctaaaaacagagaaataatctaatgtagtttatgaatagccactatttagcaaaagtatgaaaacatacgggataatatactccatcttgagggcaagggttactgaagatatctttcaaatgtatttttttctaactactaaaatcttaattactatatgtagaaatcatctaaaaatagacaatccaagaatcatctttggcactgttcaggtgcataccactctataaagtttatgtttagtcatttacatctatactctttcccatcttttctttcttgctttcctttttttttgagacagcgcctcactctgtcacccaggctggagtgcagtggcacgatcaccgctcactgcaatctctgcctcctgggctcaagcaatcctcccaccccccacccgcccacaaacagctgggactacaggtgcatgccaccacacccagatgatttttgtattttttgtagagatggggtttcatcatgttgcccaggctgatcttgaactcctgagctcaagcagtctacctgcctcggcctcccaaagtgtatctatcttttcttcttaacaactgttccatctaggatctctgaggcatagattaaagtttacactcaaagttactatactccctaggactcaaatatttattgacaataacttttaaccacttaactttaaaatytgtaaattttactcattttttgaaaagtcaaaatctatagctatcaatatatattcactgagtgttgattattatatacctatacccattattatataaaagaaataggcataaaacaytgtttctttctgcttatggaacaactaatttactttcttttaacaagattaaaataaaatcttactttatcagcaggtctcttttcagcttccttctttaccttttcagttgtgaggaccttgccattattattaccagaaggaagactggatgatattttgggctcttgcttaatggaaatgttttttgtgcttgaaattttgggtggctccacatcctaaaagatgaaaaaaggtaccagtaattaaatatttagactgatcatcataaaaaaagatcattaatataaacaattttcagttaaaaattaagacatttcattataaccaatgtaatattcctttcttaaatagttaaatagctttattgagaaataattgatatacaaactgtaccttttttatttttattttttgggacagagtctcactctgttgcccaggctggagtggagtgctgtggcacagtcttggctcactgcaacctctgcctcctgggttcaagtgattctcctgcctcagcctcccgtgtatctgggactacaggtgcaccaccacacccggctgatttttgtagtttcagtacagatggcgtttcaccatgttggccacactggtctcaaactccggcctcaaatgatccgcccacctcggcctcccaaagtgctgggattaaagacgtgtaccaccacacctggcccaaactacacctacttaaagtgtaacatttgataagttttgacatatgtatacgtctgtgacaccatcactacaatcaacataatgaacatatccatcatctctccaaatttccttgtggccctttgtaattactctcttacaggtatacaccctatagaaaaatatgtctcccatcatcaagcaagaaaaatatgtctcccatcatcaggcatatagaaaaatatgtctcccatcatcatcatcacttatctgttttctgtaacaatacattagtttgcatttcctagaaatttatataaatggaatcatattcttttttggtctggcttcttctactcagcatatttattttgagattcatccatgttgtttagtgtatcaatagttaattcctttttattgctgaataatattccattgaatgaatagactacaatttatttatcaatttacctattgatggatatttgggttgtctgcagtttgggactattacaaataaagctgttatgaatattcatgtacaagtatttatatatatatctatgtttttatttctctagaaaaaataggagtgggttatatggtaagtattaatatatgcttaattacttgagaaactgccaaactgtggcagtaccattttatatttccaccaagcatatatgagagagttccagttccttcccatcctcaccaatgctttgtatggctactctttttaaattgtagatgttctaataggtatgtagtgatatctcatttagatttaatttaaatttccccagtaactaatgatgttgagcagcttttcaagtgttcatatggcatacatatatcttctttggtaaactatttgataaaatattttgcccatttaaaagaaatgaatctgtttgttttattactaagttaaaagagttcttcatagattttgggcacaaggcctttatcagatatatgatttgcaaatattttctctcagtctgtggcttgtcttttcattctgtttaaattcaattccttattcatgtattatagctttgctgatatagataacttgttatttgttgtcattaatagtatgcataaactttggcagctcttggaattccccctcccccaaaaggagggcactttcccatcattctaaacaaaactaaggcagctgagtgcagtctattttactgtgataatatgtaaaagtacaaaagtataaatgggaataatacacaacaatttcagaatagtggttacctctgaggggggaagagaagaaaaaggaaggaggaatgggtcctcagatctagtggtggcagggcttgatatattattatgctgattgtttagacaacgggttagcaaactgaggcctataaatagttttttataaacagttatattagaacacagccacacccattcattttataatgtatggctgcgttcacattaccatggcagaattaaatagttgcaatggagaccatctggcacacaaaatctagaattcttactatttggctctttataaagtctgttgatcactggtgtagacttagtaaagtgttgaagaaaatgttaataatgcagattaaacttaaaaatgtgtggtgggcaggtgtggtgacacatgcctgtaatcccagcactttgggaagccaaggtgggcagatcacttgagtccaggagtttgagaccaacctgggcaacatggcaaaatgctgtctccacaaaatataaaaaaattagccaagcatggtggcatgcacctgtagtcttagctactcaagaggctgaagtgggaggattgcttgaacctgggagggagagagcgcagtgagccaagattgtgccactgcactccagcctgggtaacacagtgagaccctgtctcaacaaaaaacaacagaaaaacaaaaacgtgtattgtgtgtaactaaaaaattgaagacaaagtcatgcagtattaaactattacctaattcagcaaaaaagttgttctagttgttgacggatgagttaagttttaactccattatttcacatttgccttcctcattaatgtaaatgaatatcaaccaatattcatgttagaatacacttggagacctggtaatgttagtaagcattacctccaggtgattcttatccatgctaaagtttgagaaacactggcataaatcactcttcttacacaaatctagtgatgaaaatattcagctgaaggctaaaattaaatggacctgggctttaaaaacctataacaaagtagtttctgaaaactgatcaagagaaatgaactctagctagaaacctaagggcagcgtgctttttaatcacaacaaatttttcatgttctttaagagataaacttccattttagaaccccattaaaacaattttttttctttagtaataataggtttccctatctggacaataccaacacccacagtggaatgaatttggtagtatgttttgtagagccatattgatttggtcgatctgaactcactgaacctactgcaatgagaatggatagaagaaatgaagtcacaatggttctgctattcaaaatacaataaaaaggcttcggagtactagacctagtattgaaagaaggctggggacaaaatgccagtgtttacttgggctctgagcctgggactagatcctctcttgagcttcagattctggttagacttgagctagtcatgttctattttctccttctcagtttgggatctaagtccacagacctgagtgatttggagtttgagggtcagagcttagaaggatttgatagaatgtcttagtaggtattagggaatataataagagttgtcattcagtgacagcctattatgtaccaggcaggtactacactaggtaactcatttactggatctccttcaatttttacaactctgcaaagtagttcttattatccccattttaccaataaacagactaagtgaaatgaagtttctatgtacctcagtttccttatgtaaaatgaagaaaacagttatctatcttaaaggatcattatcataattaaaattaattattcacataaactactcagaaaagtgcctgggacatcaagatacgttgtctattatcatcacacaattataagatttaagtgggatttaaaacaggtgtgtttggtatcaaaacatatattcttttcacataaagctgccattggctgctttgttattatcaagacaggagctacacagttctcagagttcatccatacctccttttctcttaaattatcctacccatattcaatttattttgttgaaagatctgtccttttacttgattttttttaatccttaaaatattaggcaataattagaagtaagttgtggttacattcagcagcttaaaaaaaattctgatcacaaagaatcggaaattaaagtaagtcgtaaacaagtgaattcatatacacataaagtagtagaacagaatatcctgcacccccagctgatttttctatgtggtgtaacagttctctgaaaacttgaagggaaaaaagaaaataaagaatataatttcttcatgctacaaggaaagattatttcggcagagattgttttgagatggtctatatgttatcaatgtagtactacaggccttacaaaactctctccaagctttttattcattcaagtaccttttgagatggacggtaactggaatcaatgccccgagccaaagattcatcaagcagtgcttttagcttttcagcagaatctttactctttgaatgcaagaaacctagtgctttcaaaaaaatgggatcaagttccaagttcacagtagcagccattgcaaacgcctgaaggaaaaaaagagaaagtaatctagaagacaatgcacaattatctatgttaaagttttacttttctgttttttaatttgtaatagataatactgtacacatgatataaaatttaaaatcaccaaaaagttattacaaataaaagtaaatttccttcttattcctgacaggcattatctagttccttccccctgaaacaactagcagtatcagttttctgtgtatccatatcgatggtaacgttttaaatccaggtaggcctctccctgccacagaactccttcctaactgtgttttaaaagatacacttcgcagtttcagtacatagaacttgatgggtttacgtcaagtttactctgtatcaaaatttcttctctcaaaccttatttccataacacaagggaagacttagtgtgcaggtgtttgtgtgtgtaagggctatcgtaagagggcaatggtgaaaaggtatattaagtgattagctatcatggtcactgctgccacttttacctcaactctttttttttttttttctaaactcacctcttcagttctctgccccaaccctaaatgtctcagaaaacatattaatgataaccttatttgatcacatttagattgtggtatctcatgcattaacctatttttaaaagtaaggtctctgagggataatatcatatctacttaaaacacacacacacacacacacacacacacacacacacacagagcctatgatgctttgtgtcctaaagagcttaaaaaatagccaagatggataaagatatacatcaaaggcttatgaaattccacaatactaaaaagttttgtttttagttaataccaatgctatcatgtggttctgcttctggttgtcactttttcaaagacctctccaggcaagaaattatcaaaataaaaatgtattctttgtgttcaatcctttgatcaatatactatggcttgaaatcttctatccttgaggttaatattgtattaatgcagcacacttgcattgctatagttagggaactgtcagcaattccacagttatctcccattttcaggggtttataacaccattaaaacttgctgtaggttgaatcctagcatatgaaagcacatctgaaaatggattttgttgtcccctcccctccagcttcactcctcatccttctccacatctgacaagaaacacacatacacatccctaggcttttttttttttttttttaagttcccaggaaggtattagttatctacctgataactacaaaattactgtcgaattctgtactgtactaaaatatcatctgaatcacccatggaaaggaatccaaaggccagtactataatgaaaaagtaaccttatctcaaactgttgtatttctaagaatttaacaaaattgaaaagcagcctctgtcacttcttaaaattatattattatatacatcacctctacataatgataggtacagaaaaattattttaaaatttactcatggggctggtcaccatgtacgttctgaggaaaaaatagctccttaataaaatttccaagattaaaagggtaaacctgccattcccccagcatatacaagggtaacagcctaatctcttttttttctttaaattccactcctgtgacagtttactaatctt

SEQ ID NO: 10851 - DNA, 14749 bp, Homo sapiens
atcatatacagtcaggtcttacatgagtagtggagggtgagttctgctcagttaggttgtgatcatatacagtcagctcttgttattcatggtagctgtgttctataaaatatttgtgaacactgaatttgtaaatactgggccattgttcttaggggaaatacagtttggtgcaaaagtaattacggtttctgtcatttcgatgactttttttttctttctttttttcctaagacagactcttgctctgttgcccaggctggagtgcaacggcacgatctcggctcactgcaatctccgcctcccaggttcaggggattctcccgcctcagcctccggagtagctgggactacaggcacgcgccaccacacccagctaattttttgtatttttagtagagacggggtttcacccatgttggccagtctagtctcaaactcctgacctcaggcgatccgcccgcctcggcctcccaaagtgctgggattacaggtgtgagccactgcatctggcccatttcaattacttttgcaccaacctaacgtatggtttaggtttctgtgaacctctgatgacaaaagtttcttcaactggtcaatacgtaaccttgttaataagatgctttatttaatacgtttcttcaaaataatgaattatatttggtatttctttaaaataaaacactagccaagaagggtttaatactttccttcccttgggtaacatgattgtacatttctttggtgtctagcctcacaccaatgctatctattacattaaatgttctcatcatctgatgaatccacacattcagccacttttcatctcttccatggcttcctcatgtactatagctgttaccttagcactttccagagtggccccacatacagatgggccgaaggcgcatccccctgtatctccacgtgaccctgtgtaagtccccaagaaaacataccaaagaccggccgggcgcggtggctcatgcctgtaatcccagcactttgggaggccgaggtgggtggatcatgaggtcaggagatcaagaacatcctggctaacacggtgaaaccccatctctaccaaaaatacaaaaaattagctgggcgtggtggcgggcacctgtattcccagctactcaggaggctgaggcaggagaatggcgtgaacccggggggtggagcttgcagtgagccgtgatcgcgccactgcacttcagcctgggcgacagagcgagacctgtctgtctcaaaaaaaaaaaaaaaagaaaagaaaacttaccaaagaccggataaaaggatgtaacgtggtgacatcaagctggctgccctgtgcgcttcctcttcctttttctgggtgtgtgtattcttgattcattaacactagacccccatgagcactgtagctcctacctgaaagaagtgtgtctaacacatggattttctccataaggcacatcacagccttcctgtgcttagggaccctaaataggacatcagcaccattcttgggggccgtttacagcaaaataaccatcagaaagcacaaaaatatgaaaaacacagtgctaaggagactgcaaaaaggacacatgtgcacgatatgagagccaaacgtgaaggcagagctttgcacgctccacctcggcggggaacgcgtgcatctggcgactcagtatcttcacccctctgcccgtgtcggagaatgactgtgaaaccgctgtattgattttggggttacaaatgcatttcagtgagtaggtgaatgtgcaaatacagaatctgcaaaagatgaggactgcctgcactctgaagttccccgtcgtcttgttaacccactgcacacagctgacggcagatcccctgggtctccatgtgacattacccaggaagacagaccaaagacagaattgagagagaacatcgtgatagcgaactgcctgccctgtgtatttccgcgactccccacccatgactcaatcacatggtaaaatgtttactgcgactccccacacctgactcaatcatatggtaaaatgtttacggcgatttttttaagtctacattgtggaaagaagcagcggcatgtatgctgcttagcaaccggcattttagctctccttgtggaaagcaaaccggtagagctgctggtgagcccttcatgtgggcctctgcggactctaaaagatgtcctttggggagtaaaacatggtgcatagaaagctgcggctttcccaacctcatgatgatcatttaacttggaataaagacaaccaagtaagggagggcaggggagggaaggggcagggtactgaaggctgcaaactgtaggaggaactcggaatctttggagggaaagagaaaggttcaaaagagtttccagggcaacagtcagcacagacttagcccactctttgcatcaagtctgaagagagaggaagagaaaagaggaagaagcgtgcagggccgctggccaccccctccccagagccaggcgggagggatggagggaggtggtgcctggaggggtttgggttggggggccctggctatggaggacaggttgggcaggcacaggaagggactggggatggagcagagctgacgggggcctgaggaaggaccgcaccgctctttcaagtagttgtgtttacgcatacatgtttcactccctgcctacactgaccacacttgcctttgaaaataaatttatgctgggcaccgtggctcacgcctgtaatccccacactttgagaggctgaggcgggcagatcacctgagatcgggagtttgagaccagcctggccaacatggtgaaaccccatctctactaaaaatacaaaaattatctgggcatggtggcgcgcgcctataatcccagcttctcaggaggccgaggcaggagaatcacctgaacccaggaggcagaggttgcagtgagccgagattgcgccactgcactccagcctgggtgacagagcaagaccttgtgtcaaaaaaaaaaaaaaaaaaaaaaaaaaaaacacacacaaaaaaaacacaaaaaaaccccagatttttagaaaaatgtctttttaaaatcagtgaacacttattaaacaagaaaaaggacaaaaagaacaggataatgaacacactttaataatcatttttaaaggcatgaaagagcatgttatcactcaggcacagggctgaccaaccagggtcctgcaggcccaagctggcacactgcctgcttttgtaaataaagttttattaaaacacagccacatctatttgtttacatagtgtctgtggctacttttgtgctacaataagagttgagtggttgtaacagagcctgtgtcgcccacaaagccaaaaatgctcgctacctgctcctttgcataagaagtttgttgacctctgctctagagtaaccgggaaacagtatcatcccagacactgaaccaccaagcagagaatgcaggtcctgactacacaccaatccatggctttgagcagcaaaaacggaaacaggcacatgaactgtaggcacacagccagccatacgcacaggcatgctcttttctagaaaagggagagagtttttgtcttgctttttttttttcttttttgagacgaagtcttgccctgtcacccgggctggagtgcagtagtgtgatctcagctcacggcaacctccgcctcctgggttcaagcgattcccctgcctcagcctcctgagtagctggaactacaggcatgcaccaccacgcccagcaattttttgtattttttagtagagacgggatttcaccatgttggccacgatggtctcaatctcctgacctcgtgatcctccctccttggcctcccaaagtgctgggattacaggcgtgagccaccgtgccaggcctgtcttgcttttttttacagtaataccttggttgaatttaaggatggaaactacacacacagaattcttacacgcatgagatagccaagataacaacaactaatatttaaatgccgagaacactgactggtaccactcgcactcttaaggacagcaccctggaactacatcgattccagtaaccatcccacgctctacccacttcacctgcaacgtgccagaacgcgtcgtagagagatggagatgctggatgaggattgccaggtatcaagccagctccaagagctctgatctcccagccctaggccccaaaccccagggccctgcattcaccctctgaccaccaagaggcggctgcagagtgaagaggagaaggaagcaacaccagagggggacagaaccacggctttgaaatacacgctgactgttcaaatatcctcctcaccactgaccctgcctccttcctatttacagccaactatctgtgaagatccttttcttttgtcccctgaaaggtcaccagtgacccttggagaccagcctgagatgccagggaccagggtcccaagccatcatccctggcccaatgctcctggccaaggtgagcagcatctccgcagttccttatccctcatgggaaaggctgttctcaagggaaaccatcaccagctctgctgagggcaattctgccccaaagggtctcctaggtctcaagtaagtgtctttattatttctgacagtgttgagttgcgccagactgaaacacatacctccaaaagggaaaatcactttatttttattttatttgagtttacttattcctaagggacttgatgatctcgctgtccatgactgcttcctgaacattcctacgtttgaggcaagactttggacgcctcccctctggggaaggtatctgctctgcagaagtggccttgtcttggcaacattcccttcaaggatgctaatgccttagggcatgaattacttgctttggggtactagagaagtaccagaagcttggtatgggctgagctatcctgatggcattttcagaaggagaggtacgtgaagttaaagtacttgctgctcaatttcagatagatagtactttgtttgtactgcaaatggcataagcaggtctgtcctgcaggatgctgggaagatgactgcataacattcgtgggatagagaagccaagttctcaagtcttccgatgaaggtgactctggcttgtgtaataaagtattggcagagatagccgaggccagcatgcatgctagaggttctgcaaacactgtcattcggcagtgtacacgatgattagttgtctcatcaaggagagcttagaagaggtccctgcagagaaccacccactctggctgaaggaccagcctttgtgatccaaccagcacacctcctattatgaggtcatgtcttgcttatcctgagaccgctggttggcagaggtcttgaactattaagagtacatgaagttaatctatttatttgctcatcgatctctttttatgaaacactgtagaaccctgaggtgcaagcagcatcatttgagatgcctctgaggcaggataatgcgtgggagagacgcgttcttcccgacaccatcctggtcatttggggctggcaccatgatggctctggaatgttggtggctgtgcccagtgacaggcaggagagaagtgatggttccccgtggggcctgcgattcttggtgaagcagcagttgtttccaggaggagacgtgtgatgagcattcatgagagccctcagggacatcagaaaatactggatggaaagagtttgcaccaagtggaggttttacattgcaagtatgggctggagccaacaagtctctgttatgattttaatagttgccactgtacacagaggaggatgaagtctggatgaaatttgggccacatgaatctattggatcctagataccagcattctatttatctgaataagataaaattcatggcaattcaacctacttctggagaaagaccagctgtagacagcaaacagtctcaatagaatcttttagaagaaatatatgatgtaactccaatttataaataacagaaggtttcaagtcaaaatcctaaccaatctgctttgatctcattgaacaagactcgcttgcaatgaatgactgaagtggatataaaacatgagttcacttatatgtgtcccatgaaacttttattactcatttatccttcttacctagaacaatgaacatcatcgcagtgacaaccatgcagaattagcagaacctgaattactccagatattctcattcttaagttctgctcaggaagtgtatattcatgccaaggccatggcactcaggtacgatattagaaattttcaaggtaattcacataatgacttatgaaagaaatagtccactaattccagaatacaattctgtcaagattgaaaactctttttagggccacagagtattagacttgaaagaatttgggagattattgcatttcctaataaaagcactgccatggtaacaggtgatctgctttctgcttgaatatttttaacttgggagaacttaccatatcccagtacagcctgtgtaatattctgaatagcctcaattattagaaagctctttcttctattaaacttaaatcttctttttaataacttctaacccatggccactggctttgttctctaggattatatggggtaaaaataaaccctgttgctcacatgggcccctcacactttaaagacagttatcatgtgcttctatcatgttaccaagacaaggccacttctgcatggcagtgctcttattaagaaatgcaataatctcccaaattctttcaactccaatactctatggtcctaaaaatgttctgttgtttaagaacattccatgttccttccattgctcttcagatacttcgttcatccaagctcacactagcccctttccaccctcacaatttagcacttctcaggtcaggcttgggtagtaaaaaatttgacctttcccaaagatagatgtggccttttccatgagcttctgggaggtaaactacatcatactcactgggagtgcctttgttatggtgagggttggccacataagatcttagggtaggatgggccatacctgatagtcatatggtccaagctggttgcaagagaaggatcaaccatgtgatttagggcaggggctttggggtcacacagtaccagtccacctggagactgagttagaccacatgggaaatcaatcaatcaatcatgccaatgtaatgaaaccacagtaacaactctggatacaaggctcaggtgagcatcctgggttggcagtgctccacgtgtaccatcacacacggatgccgggaaggtaatgtaatgtgtcctgacgacaatggaagcgtcccttttgaaaccgtcctagattctgccccatgtgtctcttcctttggctgattttaatctgtctcctttccaacatawtaaattgtagccatgagtattttccgtgaattctgtgagtccctctagagaattacgagcctgagggtcgttttgggaaccctccaaacatgcagttgtcacacgtgacagtggtcttgggtgggctctttctgctaactttgtagttggaccctaattgcttgcagtaggtgtcagtagtcttgggccgacttggcagactgggggccgtgctctccatgtttgaagtttggctgattctgaggagctcatctcaataagatcctaagaaccttgactataagagctgtgttttcattttgccctttctttgcagtaactcagccaatatgtacaacttattagctctaggtcagaaaggagaaaatcctacatttatttttattcaatgtagcataatcaggagttggaatgtcatcactttgatgaaaacccaaaacaacaacttagaaggtgaattagtggactttatagacaaatagaaaataatagatccatagatttctcctgaatcaatagactgccaaaacttacatattctaatgaagttaaagatgaaatgaagatgtgctgaaagattcggtaataagaccctgtgcacttactgagcatgcagactgttctttaatagatgtgtgcgtatttgatccacctgcaggatcagattaggaataatgatgtttatatcattactgcaatttagaatgcaaacacgactctgacatgtttcacattgtctgaagtttcacttccttttaaatttttttttggcctgaatcattatcctgagttatcagtgctttgcagtagacatttccatagacctgtcatttttcacagagcctttgcaacggtctgtgaccagctttactggtgggggggataaggaaacatctcagttatgttgcattataaccattacacatcttttgagtcaagatgagctcattgtactatttagaaactttgatctccttccactttaaatcatcctcaggtttaggagtatgtgctaatcacagtgccagagatctctgcagcaatgcaaaagggacttaggcactgctgggtgagagagaaggggtcaagagtcatgttgtcatagtaacccagaggctctcccttgattttttcttactcttgtccttccccagggacttttaaataattctcaggaagaaagaaactgcagagcccaagtggaattctggatataatgaaatcctgccccagcctggtggcttctctcagatctttcctcccggcttgccgcttcatcgtctctgaacctcctgtgtctccttcgtgataaacttgcatttttagaacattcctgtgcttttccatgagtgtgagtgagtgtttcaggtaagaaacatatgtgaagtttatatttgatgtggcattttgacagcacccctttctgtaattcaatctacgatctcccttcaaggttgacattagaagtgtgtagaatctgggctttgaaaaatctgcaggtgtattcagagttctttcaaaaagacgtgtttactaaataaggccaggaaatatctgaaagggtttcatttactattttctatctgccccctaagcaaaaccctaagatggcagcgcgcagcggggactgggcctaagatggcagcgcgcagcggggactgggcctaagatggcagcgcgcagcggggactgggcctaagatggcagcgcgcagcggggactgggcctaagatggcagcgcccagcggggactgggcctaagatggcagcgcccagcggggactgggcctcggggactgggcccaagatggcagcgcgcagcggggactgggcctaagatggcagcgcgcagcggggactgggcctaagatggcagcgcgcagcggggactgggcctaagatggcagcgcccagcggggactgggcctaagatggcagcgcccagcggggactgggcctaagatgacagcgtgcagtggggactgggcctaagatggcagcgcgccgtggggactgggtacattatggggcttatgttttccagctctggaaacccaggtgagtccctctaatgttctccaaagcggtacaagatggtgctttggggaagaaaatattggaatttatatttattgatctcattctttaaaaaaaaacaatggatttgagagatacaatacagtattaccaaccaacttattcagtgactctcttatccctccacattccttggaaaggtgaaagggaggttaaataggactaggtaaaggtctaggcttggtaattatactagattacaattatgattacttccagcctccagactttggtagagccaattttatgctctctatccaaataaaatagactatgcaagtttgagccccaagcagctgttgcatttgtattcacttgactgtgttctgatcttgtgcacacaaaaggcagacaggtgtaaccttgctccatcaggctgcatgtcagtgggcacgccttgtgttacagggtaaccttccaggagggatgacagaaaccagctcattaggccaggccagttgcgtggtaacatcaccctgtccggagggattcagactggtttgggaggatgcatttgttcgtgaaatgtctttcttcctgtgatttcatgcgcacgtctgtccctgtgccgtggcctttctgtttagtcagcagcgtgaagcttaaaacaggattctcattgtcaaggtcaggacgagccacctccttccacccctgctccctgctcctgaccagtggtctttccagcactcagttggggatcccgaatatggttccaggaggcctggtgaagcgccgatgccaccaagactgttattccccgagatggagtcctcggggcttgcccaatgccaccaagactgttattcccctcagggctcgcccgatgggctcagactggcatgaccgtggctgtgtgtgttacttcattgactggcagtctggaaggactcccccttatcatgtgatggtgacaagaaagatgatttggcggctttggacctggagctgggaggctgagtgaggaggatgaaggtgccttcctacacatccctgcccgctctgcaggctcggggcacgcacccctctattcactacgccctgaacacgctgtgagctttcgtgcctctcctgcatcggtgctcatcccaggtttcaagtcagaaatgccctttcatctctgtctatggaaattctttcatgtcctgctcaaatccatgaatccactcattattatccactactaatccttgtcattcagaaaaacaaggggaaaagtctgacagaactagcaaccccaagggacttgtgtccttagaaatcacctgccttttcctatttttattgtggtgaaatatacataaaatgtcctattgtaaccttgcaactaagcgcacagtttagtggcattgcgcccgttcacattgttgtgcaaccatcacatcctttatctccagaaccttcccaaacaaacaaactctacccattaagtaacaactccccactccctactcccccggcccccggtaaccaccattctactttgtgtctctatgaatttgcctgtgccaggtaccttgtataagtggaatcatacaatatttgtcctttggggtgtggcttatgttactcaacatgcttgcaaggtacatccgtgttatattaacagcatgtatcagaatttcacactttttatgagtgaataatatattccattagatttggaagcaacctaaatgtccatcaacaggtgaatggataaagaaaatgtggtatatatacacaatggagtactattcagccatggaaaagaatgagatcctgttgtttgcaacatcatggatggaaatggagatcattttgtgaaataagccaggaacagaaagacaaacatcacatgttctcacttgtttgtgagacctaaaaatcaaagcaattgaactcatgggcatagagagtagaaggatggttaccagaggctgggaaaggtattgggagagtatgggggatgtggggatggttaataggttcaaccaatttttgaaagaataagatctagtatttgaaagtacaacagggtgactataacaacttaattgtacgtttttaagtacctaaaagagtgtaattgaattgtttgtaactcaaaggataaatgcttgaggggatggataccccattctccatgacgtgcttatttcacattgcatgtctgtatcccaacatctcatggatcccatagatatattcacctactatgtacccacaaaaattaaaaattgaaagatacattcttttccatgaaacgtatattccattatatttacataccacattttctctcctcatttgtggatgaacaattgggttgttcctacctcttggctattatgcttaatgctactatgagcattggtatacaagtatctgtttcatttcctgctttcaattcttttttttttaaatgagacatttatttcactacaatacaaaaaaaaatgataactaggacaggtgacaggtgtgtcacctaacttgtgttaataatttcacaatatatatcaaatcatcacatactacactctaaacttacacagctttatttctcaactatctctcaaaaagtctgggggaaatatgagacgtttaatattgaaggaaaggaaactaagttggtaacactagacatatacattgtgtgtgtgtgtgcatatatatatatatatatatatatatatatatatatggatatacacacgcatacgatggaatattattcagccttttttcttcatgcccaggtttattaaaaagtgttcttctaaagataatgttactgaatgtttatatttatttattttatttaatagctttaggggtccaagtggtttttggttacgtggatgaactgtatagtggtgaggtctgagattgtggtgcacctgtcaccgaagtagtatatgttgtacccaaaatgtagcgttttaatcctccatctcctttccccttcggagtctccaatgtccattcctccactctgcctttgtggaccctcagcttagctcccacttatacctgagaacataggaatgtggctttcccttcctgagttacttcacttagcataatggcctccagctcccctgctttccattcttttgggtaacctaggaatggaattgctggaccatgtgacaattctatatgcgactcttggaggaactgccacactcctttccacaatgactatgccattttacattcccaccagcaacgcacacggactgcaattcctccacacccttgccaacactgattttctgttgttgttttaatagctacatcctgctggctaggaagtggtaccttcttggggtttgctttgcatttctctagcaactaatgatgctgagtatcttttcacgtgctccttggctgtgcatatatctccgctggagaaatgtccataagattcctctgcccatttgtgaactgggtgtggtgatggttgttgacttacaggagttctttatatattctggatattaatcatagacatatgatttacaaatattttctcccattctataggttgtttttcaacctcctgatagtgtcctttgtcatataagattgccttttcatttgtagggaatacttcatcagtcttcagtttaactaatttttctttagcatctgtggttcagaagccttctaacataggctatacctgtgaagagagcctaacgatgagagtggcccatgattccctgtgctgttttgtgttaaagatacttgtccaatatgatccttattagactgctaaccagtcattggctggggaaaacttcaggggctattgttaagtgcattttctgtgtattgtcgaggaacaaatttcttttgaaatcaagcataacctaggataaggaagatgatgaagccaactctattatgatgccttctgggtatcatgtgtggtttaaagaaacatgatcctggccaggcacagtggctcatgcctgtaatcccagcactttgggtgatctgaggcaggcggatcacctgaggtcgggagttcgcgaccagcctggccaacatggcgaaaccccatctctactaaaactacaaaaaattagccaggcatggtggtgcgtgcctgtaatcccagctacttgggaggctgaggcagaagaatcacttgaacccaggaagcagaggttgcggtaagccaagattgtgccactgcactccagcctggtgacagagcaagacgctgtctcaaaaaaagaaaagaaaagaaaagaaaagaaacatgatctccatgatcctacagttctcacaaaatgcaccaactggataactggactggcacttggcacaaagaacagtgcatagtaattggaaggaattaaaaggaaattaagctgaagaatgctttccattaccaatacaagcctgagaaaagacgttacacagaagccacaactcatacattaagtaacttaagggagaatctacaaaattttaaaggagaatgatgtggaggaattatccatttcttgaaaaagaattaagattagagttttttagtgatgtttattttgtttgaaaagaaggtagctattgttgcacaattcttgcatcttttaagttggtacgtttgataagctattcatttctgacatgggataaatgtagtttgtgttcaggctctaatcactgttatccctgcaagaccctaactgagccgtttctcaaagtcctgctgcggataagaagataaggaaatagggggccgggcttggtggctcacatctgtaaacccagcactttgggaggccgaggcaggctgatcacttgaggtcaggagtttaagaccagcctgaccaacatggtgaaaccccgtctctactaaaaatacaaaaattagccaagcgtggtggcgtgtgcctgtaatcccagttacctgggaggctgaggcaggagaatcgcttgaacctgggaggtggaagttgcagtgagctgagattgcgccactgcactgcactccagcctgggtgacagagtgagactccatctcaaaaacacaaaacaaaacaaacaaacagaagcagctaaggaattaggaattaatcacatctgactcatgctactcatgccacctctttggtcccttttgtttgtctgttttagcttcaaaacatctcagagcttttcaggagtgctgcgaagggacttggtgagttgcctggatggcccaaatgtcactcctgccacctccttcctgga

SEQ ID NO: 10852 - DNA, 66392 bp, Homo sapiens
aagtgctgatattacaggcgtgagccaccttgcccagccaaaagtaaacatgtgttaaagggtcaagattatcttttgaaagctgaataaaatactgtactctatgggatgttgcaaatttctatagaaacagaattataactatgggagctgaaaataatgagtgccttcttcattccacagtttttctaaaaaaaaggaatatgtaagtgttctcaggacaatattctggaaaggtagaaaatacagtttcaataagaaataaagccatcttgtaattaactttttattactaacttacctttgtatattattcaagcccttaaataatgcaacaactttcttccagctgctcttttctaattgactcctttaaaatttttattataaagtcagattcatcttctaagcaaattaattcagaacgtgaatgttactccaatgaatatagcaaacctcttagtcatgtaccaactaaaaaatgatcatttgagagaaggcatattgaaacaatactgtattcccacatgtctcaatataaatactgaaggtgaaaacagattcacaatccaattgtaatgccagcatcctcactttttcttctgtgttgttttaagagtccagtgactttggttcctttgtaccctctacttttacattgctatcctcaaacatttgatctggtttctattcttggagagcaataaaatgttttagaaatgtaacaaagttcagctgggcacggtggctcacgcctgtaatcccagcactttgggaggccaaggtgggtggatcacctgaggtcgggagttcaagggcagcctggccaacatggtgaaaccccatctctacaaaaatacaaaaattagccaggtatgatggcgggtgcctgtaaacccagctactcgggaggctgaggccagagaatcacttgaacccaggaggcggtggttgcagtgagccgagattgtgccactgcactccagcctgagcgacagagcgagactccatctcaaaaaaaaagagaaatgttacaaagttcagcattatcaaacaacttgagtacttaaaaatcgccttctctgtggagtctacaggaatggaatctaaggcattagggttgttgccataagcgggtacagcaggacaacggtgttggctatagcaataggcagaggaagaggaggagtcatggcctcagaaattcagaaaagaaaatgtgatccaggctctaccctatagaagaagagatcagatcttatggtcaggaaaggaggaagctggccaagatgcagcgtgaggatttcagagcgaacacacacattgaccttgcagctgcatggggtgcgtgatgaaggcaggtttggccactgacaagaggaaatcaatatgatgaatcaattgatatcactctatcatcacatatggagaggaggtatgaatgcttgttggtaattcatagaaacagtttgttggctgggtgtggtggctcatgcctgtaatctcagcactttgggagtccaaggtgggtggatcatgaggtcaggggttcaagaccagcctggccaatatagtgaaaccctgtctctacaaaaaatacaaaaaaactagccaggcgtggtggtgggcgcctgtaaggtgccagctactctggaggctgaggcaggagaatcgcctcaacccaggaagcagaggttgcagtgagccaagattgtgccattgcatgtctcaaaaaaaaaaaaaaaaaaaaaaaaaaaagaaataaacagtttgtcaatgggtcacagatttgtaatcaaatgaaagctggaaataatgcttggctcttgttgtcatgttggttctctaccaaaaatttctgcagatcttcttggcaacgttgttttagactggtgcataaaaagggctatgaatttagctctgcatttgccctcatttagtgctgtttgtatgttgccactgaaggatgtagttttgggttctagttgatagccaccagtgcttatcaattggcagataaagtttcagggattctctacttataattggtttcacttttaggggctggaagccaatccaaattaccccggtgagtgtttgttactcgtgggtgagtgttcatggctaccgcaccccagcaaattaccaggcaggtagttatgatggaaaacctggaatttggaattcaagccagttacagaagcaagaataagcacaggacttcaaatttggaaatgccattctgtggagtgaagtggtaccctaatttatatatttcaagtaaagaatttggttaaatgaatttctgttaagtaagggaaacttgtggtatattactaccattgaaaaaatggtttcgtctttgcacttccttccatttgcatagttcatatttatgacacccaattctacttcagcacctttttggcatatcatccccatcagaaaacgtacacaaattatggtgggactcaagctacagtaatagctgagaccagaattcacttgatcccctctgttcgcaattcatactgcctcctgtacgcaagaagagccgtgcatactgggtattcattgaattatgaatgtttccagctctggcaacaaaacaaataaccaacaacccccccaaaactgattagctattaaccaaccccacacaaagtctgaactatattaacttcattaggcattctttaatctgtggtagaatggaaatacatcctaaaattagaagattgtaaacagagaggttttcttttcccccacttaatgtttaattttaaaatattctatcttaatttgatatggctacccagaatagaaaaaatgttagcttcaacttacttctttacttcagcaagccttagctctgctctgaaactcttctaaagaagcaaaaggctcttaattagcacacacacaacaggacaggattcacatgcacatgctgcaggaatagtgtttctgcattaacttacagcagctgtgaaatttaaataccactagcagcaaagacattttgtaaaataccgcactatatttcatgagaaatttgcgccctcttttggataaagattgttaagacatttcaatatgaactttttttaaaaaggcatgcagtttttaaaaaataaacagttttattgtaaggaccgtgggaaaggacgagaaagaacaggtgtgaggacattgcaaagccagtattaacagaactagaaggtgaagattttgtaactgcaacgcatagatggcactatgaagcgccttgaattaggaatctatcgttttcttttaatcaagatgtgttgagaaattgtgacaatcattacaaagtaatgatttttaggaccaattttctctagaaaacagtagccaaagctcatcttcctcttgaggctgtaagttttgtatggttaaggataaattgtcccttggatgatttttcttttttctttttttgagacagagtcttgctctgtcgcctgggctggagtgcagtggcgtgatctcggcttactgcaacctccacctcctgggttcaagcgattctcttgcctcagcctccagaggagctgggattgcaggtgtatgtcaccatgctagctaatttttgtatttttagtagagatggagtttcaccatgtgactaggttggtcttgaactcctgacctcaggtgatctttctgcttagatgaagcagatattaaggactttttttttttttcaaatttaggaaaatacacaaatgtatttaaagatatcttgagagacatttaaaacatattcttcatttttcttctttaactgaccatctcaatagacttgtctattacagtatcacagtctctctgtccaccacccatctacttctccatccactgccatctttcctacctttccctttccactgaaacaccataggcaaaagtgacaagtggttttgtgctacctgacttagtgaacagtccccattctttatcttgtttgttttctctgcacctttttcatagttgctcagttccttctttgtgaaatactttattctttcggcttccatagccccattcttgcctagatttctctgcctgttccacgattcgtctccatgtctcctcatgggctggtatctccagcattctgtacttggcacttaccccttttcacatcacagtctttccctgaaccaactggtggctccataatgggattccctgacccagaatcagttcttctgatgtcccatgtgcctatgggacatcttctcctttctcctggtggctcgcaggtatggagacctcaattatgtctacaactaaacctctcacccccacctcccccgcagctcccttctgtattttctccactgaaccatgaaccatatttgtttgtctacccactcagtctgccaagcaagttatgagtgttcctgagtcatcttggatggcgctcttccctctgtactcctcatcactcaatcttgttgacactctttctgaactgccatgagtcattctcacctctccaggcccacactactcttcccagtttagaccctcatcacctcttccatccactagcctgactggtcttcctgccccagggctcaccccttctaatatgactccccagctgattttcctaaaagataagcctgattgtttctttacccctttaaaacccttcacgggctcctcattacttgcagaatgaaatctgtgtattttatcatgacacaaaaggtatcctaggatcttcagcccatcacctgccatgctgcaccttggaatactctgctggatcatagcaagcatgcatggcagtgttcttccacccaggatgccttttttgcttaattagcctggagaattccttttaattactttttaaaaaaactctttcctcccccaatagaccaggcctgagagtcactctctcattcttggtggcgtgcttccattgttgcatttactgcgcagaattggagtttgtatccatgtccctgctgagctgtgagcgctttgagaataaacacagattcttattcatcctcactgttgttgttatattataaccatgattggctaccgtttattgaatgccaggagaaaaaaaaccctgaagtttggagatattaggaaaattgctcaaagatgtattgccatttagaggcagagttataatttaatcccctttttttaaatgatccaaaacacatgttcttatcaaaatgatgcactacaacttagaggtttcctggtaatactcctactagtagtagttattataactatcactgtgaatcatgcattatactaaattctttatataacaatcagtttctgaagatggagaattgatttttttttgaatttttaacggtttgatataaaaagttatttttaaaaatgtaaaataacaaaagatatttactaaagatattcatacatttgacaggagtatagttaagcttaggtggaccagatgacccacaatatcccttaccacataagattttataattctacaaatatttttcctcttttgattttaacaaatcttttcttaaatttattttattaacatatcgtcctggcagtagcttcatatggttataaccatgttttcttcttctttttctttcctatttgaaggaaaaaaaagacacccaatgctttctgtgtgttttcatatgtaaccttctacatagcagatgctgctaaattgctggggatataatgagaattaaaaaggaaatacaattctttttctcatggagctgaaaatctagtaggggagacacacattacccaaacgatccctcagtgaccatgtaattataaactgaatcaaatgctctctaataaaggactactgtactctgaaactgtataacaaagaacgtgatctctgctctgggtcagggagcatgtccctgaggaaatgggcgggggctgaggcttggtgagtgaggcggaatactcaagcctggtgccggggagsagagcctggcagacagagctctgggtagagtctgggtagagggacctgtggtgggagaaagagagaagatcagagtggaggggagaagcagggttggggccttgaaggtactgctgagcatgtgggtccttatccttaccctgcattgcccgcaggcctgacctttgcttcattyttcatggctgccaagtgagagtgtggcccctgcaggtaagatctaactaagtcttggatgtctctgtatctcaccgggtaggcagatagtaaaagctcaataaatacttcctaatttatttgacctacaggttttcccctccaccttcttatacctgtacaattactagaagagactcaagataccagcgtgatttattttttaatggattgaacaaattagttatttattatcaaatagtcccattggaaaacaattctgtgaaatgtattaggggagtgttatatctaaagattattgaaaactggttctttcttctaaaaatctacttttgttttccccaacattttctcataaaactttataaaatatatagcaatgttgaattttacagtaaacaccccatatatcatacccaacacctacattctaccataaacattttatttgctttgctctctcgctctgtctctcttcttccccctctccctccctctatcaatctttttttttttttttggaatatttaaaaataaattgcaggcctcagtacaatttctcctaaatccttcagcaagcatatcactagctagatattaatatttagtttttcttttgatgtaaaaattacatacaatgaaatttataaatcttaagtgtacattcactaacttttgacaaatgcatacatctgtgtaaatgaaacaaacactatctttctagaaagttctctcatactccttcccagtcgatcccactccccccgtttttcttgtgttttccacagtagactagttttatctattctagaactttatctagatacaatcaaacagcatgtactcttttgtataaggcttctttcagtatgttttaagactcatctatgttgttgcacatataagcagttcatgtcttcttttttttttttttttttttttgctgagttgagttccagtatctgaagctatcacagtttgtttatccatttttctgcagattaacatgtgagctattcccagttttgggcaaataaagctgctatgaacattcttgtacaagtttttttgtgaacatgttatcatgggtaaatatctaggatcagaattactgggtgggagggtaagtgtatgtttagttttataagaaattacctcaccatttttcaaagtgtactattttatattcccactaaccatgtgtgaaacttgcaggtactctacattcttgccaacgttagatgttatcagtctcttgttttagccattcttgtaggtattcaatgatatcttattgtgattttaatttttatttccctgataacttcatgatgctgagcactttttcatgtgcttattgcccattcaaataccttcttttgtgaagtgcctgtccaaattttttgctccttttctattgagttgtttctttgtttttgtaagagctgtttctataccaggctgttatcagatacattcttagtgaatatgttctctcagtgtgtggcttgcctattttctcaaaggcatcttttgatgagcagaagttttaaatgttgatgatgtctaatgtatataaatttttttctcttatggttattgcttttttatgacctatcttatgaaacctttgcctacccccaagtcatgatgatattctcctatattttcattttaaaccctttgcttttagctgttttttatgtggcctatgatccatctctaattattgtttgtttggtatgaatcagaggttagattcatttttccatatggctctctggctactttagcaccatttgtttaaattcctgttggactgttttggtgcctttgtggaaaatcaaacacmtgtgtaagcgcagatctattcctttatctttttaaaaatgtaaatactagccgggagcggtggcttatgcctgtaatcccagcactttgggaggctgagatgggtggagatcaggagttcgagagcagcctggccaacatagtgaaaccccgtctccactaaaaatatcaaaaaaaaaaaaaaaaattagccaggcgtggtggtgggcgcctgtagtctcagttacttgagaggggaggtagaagaatcgcttgaacccaggaggtggaggttgcaatgagccaagattgcaccactgcacttcagtctgggtgacagagtgagaccctgtctcaaaaaaaaaggtaatactgagcaatcaacatccaaaagtttccttcttttaatttaaattttacatcctgtaatctggataagagtttaataatgaggatataatgacttttgaccgcctactagaaaaattgatgccctatggcttctttaaaatatgaatcaatttgtttctctttcagggatataactttcatattgctaatcaaatgcattggaatctttacttgaaaattaagttggccttgaaaatgcaaaataaaaaattatgttactgccattatatgctaatttaaagtctaccatattttgttatttaagaaagatgatcatccaggtgtggtggctcacgcctggtaatcccagcactatgggaggctgaggcgggcagatcatgaggtcatgagatcgagaccatcctggctaacatggtgaaaccccgtctttactaaaaatacaaaaaataagccgggtgtggtggcacacgcctgtagtcccagctactcrggagactgaggcaggagaatcgcttgaacccgggaggctgagtgagccaagattgtgccgctgcactcagcctgggtgacagagtgagactccatctcaaaaaaaaaaaaaaaggaaagatgatcagtttcttctcattggagtctaatatggttgaagggctagaggtgtttctaggaaggatcttagtatatgaacttaggtaagtgagtttcatgttttattttttatttgtaaagaaagaaaataattctttgactgttcctattataataaggtattgtaaagatcagtgaatttcagggccatactttaggaaaacatatggataaaacaataaaaaatataagcacaaggtagttgataaacacaagatgttttccttgagtgtctatgtagcaggtatttttctttgtgtaaaagcttgtaaccatagcattaacattctcctttatgaaatttgggatttgatctctttgccctaatgaagatagacacacagggtcctttcgatgagtatactcaggcagggaaggrcgaagagtggttctaagtccttcttggcagcctttcctgggcttgccaccccagatggatttgcctgctcttgagtccagtaattcaatagcctgtttccttccggtaggggttgcccaaccgcttacaacctgccatgagtcttcgtctcatgccactcacaaatgttgtggtttaaacacaaagaattttaacatctctcacatcccaaagtaaacagcagttctggaaatgtcacagggctttcagtgcatgggaaatggattctgtgagatggatttaaataactcatggtccactgtggaaactttttgaagctgctccccctccccatttcccccctgtcaaagtgattaggtgaatcargaggaaacaaataaaggtgcttgaaaaagtgaacctaatcacacactttctrgttggtgtttgtgggcactaaaaagcattatatgcatgtggtttgaggttttaatatgtgaaatttattcacctttaatatcttttttgatttaaatataatcaactcaatgttttaaatagtgaaagtgaccttctataataattatatcacatttgactctaggataatttacaatgttttcctcaccagaattattaaaaagcagtaccaactsttcacatctaataagctagtttcaagggagagctatgtcctgataacccaagaaataacaatmttaaaccctaaattatttgggaaaaaaaagcraaactggaatattaactgtaaccyacttatttgtataaaaatcctggatatgaccagagatttttgcacacttcatgtagacaagtagggaaagaaaagagattatcagtgtcctacaaaagacttttggggaatggaaaaggaccacttctgtatgaatactacctcatgaagccaaaaataataagagttacaggaaagccaggtgactaaattattccagcctagaggcacgctcacctagaagctaagaattctactgcaaaggactgaagttcccaatgcccttggcagcaccaaaaaaataacatattaataaggcgaatggttcttaacaattcctttcaagccctgttttctatgtaacasggtacattattttgaaaaaaatgtgtttattcactttaattagttagaaatcttactcctaamtagaagtatcccagaagatctgatgaaacacctgccaatcaaaggaaaagaaagcaccactaacttactgattgaagaaataaatggatcaacagagcaaaaagagatctcaatagtatctgttgaattttcttctgattattttgaggattccttttaaatttagaaattataggtaaatttataggtaacagcatgcctccatatgatattaagacaaaaattaaaaaaaaaatactagacatgggcagcaatatcttactgaccccaccagttctacattaaaaacaacaacaacaacaacaagaaaaacattgttcccagctttgtttcagaaagaaacaaaacacccttgattggccatcacycagttatgtgtcttggcaccttttctaactctctgtagacaaccaattcatactatgttcaagctctaaatattagtgactgtggtgtcttaatgacctacttaacttctctctttaacttggtgttgccaacttattgaataaactttttktcttgccaactacccatttaataaaatggctcattaatgcagtcagatctccttcagtggctttgccgtggtgtctgtacttttttctgctgccatgagctccacacatgacattctccctttccttagctttactcaatatggctatcagtctttcaggagaaggaatcatcttgtttatttctgtttgatcttacttgttgctgataccttatttgaatttatcttttggcagatggttggatcatccatccagttctttgcttcctctagctgatatccttctttgctgtactatatgggaaaagcaagaaatatttgacaccaaaaggtatgattcacttatgcattagtccgttttcacactgctgataaagacatactcgagactgggtaatttataaagaaaaagaggtttaatggattctcagttccacatggctggggaggcctctcattcatggtggaaggcaaaaggcacatcatacatggaggcaggcaagagagaatgagaaccaagtgaaaggggaaaccccttataaaaccatcaaatctcatgagacttattcactaccacaagaacagtataggggaagccacccctatgattcaattatctcccactgtgtccctcccacaacacgtgggcattatgggagccacaattcaagatgagaattgggtgaggacacagccaaaccatatcaacttgtatatgstggcattatagagacagatacagccagtcacacagggaaaggaaaaagatttgaacaaagcctagaaacaactacttgatgtagccagaaaacatgctgtcagatcacagcacagatcctagaatcaggaaatctccaggttgccacaaatcctagtggtcaatggttcagcatacatccaattcaatgatagcagtcgaatagcaaaaaacttttccctacaaatgtcacactcctgttagaatgaatggctatagctgacacactctgcctttggatgcatagaatatttcaccataagatgatatacactcgccacagagttttttwattttgtttatttatttatttttgttgttgttgttttcgagactgagccttgctctgttgcttaggctggagtgcaatggtgcaatctcagctcactgcagcctccagctccctgattcaagtgattctccyrcctcagcctcctgagtagctgggattacaggcacccaccatcatgcccagctaatttttgtattttttttttttgtagacttgaggttccaccatgtttcccaggctggtcttgaactcctgacctcaggtgatccacccgcctcagtctcccaaagtgctgggattacaggcgtgagccactgtgcctggcctgtttttgttttttctwtatcagaattttaaagagagaagaaggtggacttctggttaaggatgggagacacacacatttgtatttgtttcctcatgaaattttattaaaaagacagtaaatgaatttcttaaaaattattgttgaaaaccatcaagaataaagaggaagcaaacaagaacataacattccttttatgaaagttgaaaatagcattcatgaacagtaagctgcctaacagaactgagaggtttggtcctaaattggcaataaggaaaaccaagaaacaacccaaattatattgcagaactgccacaattagcaggcccctggaagctttggaagaaggtggcaaaaatgggtctaaaacaggaggatttgttgaaagtccaattagaagtttgacactcatatttcatactcagctctgttcaatgggggcaaatcctccctcctcacctgaacagaaagctggaagtatactctctggggtggatgaaattttggttgttgaactaggggacacctgttccaaatgaagaagggagtttcattattaaaacagtgtgattaactaaaaattttacactaaatgctaagacagctctcctttccttctcgccatgtttatttatttatttatttatttatttatttattwatttatttgagatggaatttcactcttattgcccaggctggagtgcagtgacgcaacattggttcactgcaacctccacctcccggttcaagtgattctcctgcctcagcctcccgagtagctgtgattccaggtgcccaccatcatgcctgtctaatttttgtatttttaatagagacggagtttcaccatgttgtccaggctggtcccttcttgccatttttctacatttggttctcaaaacacaaaacattggcagccaggcctaaactccgtatacaagagactgactgtgagatccatctctagagaatggacagtttcataaggaacaacttaaagrtactgacattgaagtttccctagtaaaatggctcattacaaatgtccactgtgagcttctcagtggacaagtccgtctacagtctcagagcttctaatgaattcttaaattcccatgctgaagaactgactggcagacagttgaagaaatttccaacagggaagtcaaatgaacaaacaaagtaacttgtaacaactaacatggagaaaacgttagatggggagaaaaaaaatctaacaattataattaatattttcacagaaataaaagaaaatattgcatccatgagataagmacagctaaagaacattcggagaatgcacacaaacactctctcggaaattaaaaaaaccatagttgagataaaaacacaatggaaggtttagaagacaaagttaacaatatcttccagagagaagtgcgaaaacattgagacttagaaagtagaagagaaagacaaggaatatagaagaacgatccaggagatccaacatccaaataagaggatttatagacccagaatcagtgaggagaaatcctcactgcatgggaaagtacaggygcacaaagctagatgcaagttgtttagtcaattttaataaggttattctgcagtcaataacagccctagaatctcggtggcttacaacagtgaaagttgggctgggcatggtagctcatccctgtaatcccagcactctgggaggctgaggtgggtggatcacttgaggccaggagttcaaggccagcttggccaatatggcaaaacctggtctctactaaaaatacaaaaatcagctgggcgcggtggtgcacgcctgtaatcccagctactttggaggctaaggcatgaaaacagcttgaaccaggaggtggaggttgcagtgagccacgattacgccactgtactccagcctgggcgatagagcaagactctgtctcacaaaaacaaaaagaaaaaacaatgaagatttatttgttactcacttacatgtcatttggggttagtagacaacccacagaatgggaaaaagatatttgcaaatatgataaggatctagtgtccagaatatatcaagaactcttacaactcaataataaaaacccaaataacccaatttagtaatggacaaaggacttgaatagacatttctccaaagaagatatgtaaatagccaataaacatatgaaaagatgttcaacatcattagtcattaggaaaatgcaaatcaaaataataatgagttaccatttcaaacayactaagatagctttaatttaaaagagtacaaataggccaggagtggtggctcatgcctgtaatcccagcactttgggaggccgaggcgggcaatcacctgaggtcgggagttcgagaccagcctgaccaacatggagaaaccccgtctctactaaaaatacaaaattagcagggcgttgtggcacatgcctgtaatcccagctactcaggaggccgaggcaggagaattgcttgaacccggggggtggaggttgtgttgagccgagatctcgccattgcactccagcctgggcaacaagagtgaaactctgtctcaaaaaaaaaaataaaaataaataaataaaataaaaaataaaagagtacaaaataacaaatgttggtgagagcttggagaaattagaaccctcatacattgctggtgaaaatgtaaaatgatgcagccgctgyggaaaagagtctggcaggttctcaaaaagttaaacctagaattactatatgactcagcaattattatcttcttggtatatatccaaggtaattgaaaatgtatgttcacacaaaaacttgtatatgaatgttcttagcagtattattcacaatagcccaaasgtggaaataacctaaatttctataaactgaagaatggataaacaacatgtggtatttccatacaatggaatatcatttaacmgaaaagggaatgaaattacatgctacaacatgaatgacttttgaaagcattatattagttgaaagaacccggacgcaaagaccacatattacacaattccatgatgttggttgcacaacatagtaatatactaaaagccactgactaataacactttaaagtggtaaattttatgtgacgtatatctcaaaataattaaatagaaaaacagagttaatggctgcttttcaaaacgtgtgaaaggcctcattcatagactcaagaagcccaacaaattccaaacyaaataaagaaaaattcacaactatagccatcattgtgatgctacagaataccaaaatcagagataaaaatgttaaaagccagtcaaagcagagtgagactctgtctcaaaaaaaaaaaaaaagccagtcaaagtacctaagaccaaaygtwggacatatagcttacttttcaatggtaatagtgaaagccagaggacaatgaaattatatcttaaatatgttaaatgaaattagaattctatattcagtagaccagttgttcccaaccaaggtaattttgctccccaggagatactgttagttgacacaactgagaarggaagtgatacggtcatctcatgtgtagaggtcaaggaaactgctwaatgtcctacaatgcacaagacagccccaacaacagttatctggccaaaaatataaagcgtgccaaagtcaakaaatcatgccgtaacatatctttcaaaaatgtaaataagccrggcattggtggcttgctcctgtaatctcagctactcaggaggctgaggcaggagaatcacttaaggccatgagtctgaaaacagtctgggccatgtagtgagaccctatctctaaaaaagaagaacgcatataaaatgaaaaaawatttgcagacaaatgaacgttgagataattggctatcagtagatctacawcaaaggaaataaacggcaaatatttacctgatcttttcaggtaaaagaaaataatcccacaagtaaaattgaagaggcaggaaggacaatgaaaatagcaaatgtgtgagtaaacttaaacggatgataataacattaagcaacagtaacaattccttatgtggtttaaaatacatatagaattaaaattacaagaattgyatataggtcaagctgagagtaaatgaaattaaagtgttctgagattttattttggttcagagtgagagtgataataccatatagcattagaatcaataagtcagttgtactctaggggaacaactaagagactagtaaaagagtataaattataaattaacaaaaaaagatagaataataagcaaattaatacaaaagacggaaagaaaggagtggaaaaggagtataaaatgtatgggacaaaaagagggtgaaaacatagtaaacttaaatacaaattattatcataaatatattagatgtaaatgaactaaatgttcctaagggcaaagaactaaagtcaaagattttcaggctgaataaaaaataaaaaacaaaacccaagagacaaaacaaaaacatgaagataaagaaaagttgatagataaaaaatgaaaaagatatataatgtgaatgctacctaaaataagactgatgtctattaatattagacaaactacttagggcaaaaarcatcatcacacagttaaagagagtcacttttaatgatgtaaaaaaacccaattcattagtaatatataaaaattctaaattagtatatacttaataaaattgcctcaaaaaataaagtgaaattgacataagtactacaggagatagataaatctacaaccataatggggggttttagtgtacaatctaaaaaatcagtaaagatatataaggcttgagaaacactaccagcaatctytaccttctggatggctatacatcacccaagaatcacattttgaatcaagcatccatggaacatttactttgtaagctaggtcacaaacaaatctcaataaatttcaatgagttggaatcagagtatgttttctgactgcaataaaatcaagctagacatttataagaaaaatgtaatagaaatcctacatatttgaaaagttataaaaatcagttgtcaaaaaagaaattataaaatttagaataaattttatactgaatgataatagaaatacaagacattaaaacttgtggaatgcaagtgaagcagtatttagaggaaagttataaccataaaatgtattttaaaaaagaagaatgagaattcatcacccaagcatgatctcaaayaaacagaaaaagaatagcaaattaaaaccaaagaaatagtaaagcaagccttcatgaaacaggaaacagagaacatcaagaaagctaaaagttgtttctttgaagacattagacaaacttctggtgagactgagtaaaaaaagaaaaagaaaagaagcagcacaaacaaatggtatcatgaaagaaaaaggaggcatcagtgtagatcctgcagtcattaaagaaagaaacaagattcatgaattacttaaggtcaataaatataaaaatttagaaaaaaatgaacaaatctcttcaccaaattacaacataccaaaatgaacacaagaagaaatagaaaaatgaaatagtcctataacaattcataactgagagaggcaatttaaatcttttccattaaaaacaaaaaacaaaacctctaggtccagatgggtttactggtaagaactaccaaatatttaaagaagaaataacatcaatcttatacaaattcttcctgagaatatgaagctggtatattttgatacaaaatcctaataaacacattataaaagaaaggaaaattacagtgtgtaattgtcattcatgaatatagatgcaaaattataaatgaagtgttagcaaacttattccagtaatatataaaaaggataacataattatcaggctggttttatttgacatcgcagagtttggtttaatattagaaaatcaaccaatgtaattcatcacagtaacagattaaaagagagaaataatatgaccatcccaatagatgtcaaaaaagcattgaataaaatttgactcccactcatgatttataaaaatcttatcaaaaaaggaatagagaggaactctatgaatctgatgaaagtagatacacatccccaaagcaaaccttatacttattgataaaacattgaaagtttttcttttgaaatcaggaacaaaacaaggatgcatactattgtcacttcttttcaaattgtactgtggcctagccagtgttgtaggcaagaaaaagaaacaaatggtataagaactgggaaggaagaaatgaaattattgtcactcacaaattttatatgattgtatgtatacaaaatccaagagaatctacagaaaaattattagtattaatatgagagtttagcaagtttgctaaatccaaagccaacatataaaaattaattgaatttctatgtatatgcatccaacaattttgctgttttttttttttgaggagtctcgctctgtcgcccaggctggagtgcattggtgtgatctcggctcactgcagtctccgcgattctcctgcctcagcctcctaactagctgggactacaggcgcatgccactacgcccagctaatttttgtatttttagtaaagatggggttcactatgttggcgaggatggtcttggtctcctgacctcatgatccacctgcctctgcctttcaatgtgctgggattacaggtgtgagccaccacgccygccctcatccaaacaatttaaaacatgaacttgtccaggcgctgtaactcatgcctgtaattccagcactttaggaggctgaggcgggtggatcaccggaggtcaggagtttgagaccagcctgaccaacatggtgaaatcccatctctaataaaaatacaaaattagcagggcatggaagccggcacctgtaatcccagcyactggggaggctgaggcaggaggattgcttgaacccaggaggcagaggttgcagtgagccaagactgtgccattgcactccagcctgggcaacaagagtgaaactccatctctaaataaataaataaataaatgggaacttttttccatctaaaaatagtgaataactagaaataaaatttaaaataaatatttgagatctctatgcagaatgtcttaaatcatatcaaatgtatatgtatatgaaaaagaaacctattttaatatggaagttttgcttaaaatcaatctacgtagaccaagagcctttattaataacctagaaagattaatctggtattagttctgattaggtttagggttagggttaatatggtggggtctattatcatgsgtgtgaatgcactcactagagcacaggcatacgcatgttcatctgaacaaacacacacacatgcacgcgtacgcacgtgcacacacacacactatattccccaaacattgtaaagaaaaacagaaagttttgattgcatgagcaactctttctttgcactttagattttcatacgcttttcatatctgattttcrtggrtgatttccatggatgattttcatgtctgaatctcatttacttcttatgttgttaagctttcctctccctttcctctttacctagacccagagatgctcccagtatgttagagcacattatttaaatttagatttaatgatactgacttccattaatgcttttatttgttgtcttraaactcatccttgagtctacagcaaagacttgccctgtggcagcttggtgyactgttaagagttaggaactaatagcttgaacaaggactgagttagaaatttgtgtctgccacttactgactacttgtatggcattgtgaaaatttcttcacctctctggccaakgtttctacatctgtaaaatagaaataatacctcccattcctacctccagggctattatgaagatctaggttgatcaactgctgtataacttctagctaactgtagctaacacttccataccaattctttccaattttctgttaaaatgaacagacctcagatttgtatgttcctgcctaaagcagcaagcatggatgcaatggcrgcggcagcccttttgtkaccagacatgagagaaaggcccagagagtcacagagaccttgcatccatctgcttgtttaggtctctggtcsagctcagggtcaccaaccttcacacttcttgtttggtgacagaaaaagcccagatctttaagccactgttacctgtgttttctatatctgcaagtaaattcaattcttaactaatacacyaagctctaatgaacttgtatgatgtgcctgacactacactaaatacctgatgtrtgttgtgctctttgataccccagaacagctctcctacaggacactgaggtgcagagagattaagcaatttactcaaggtcacatggctctaccgatacctgtcacatactcatggaggcctcaacaattgattcagttatttaattattgtcagaaagatgacacaagatcacactctaaaccaaaatacttttgtgaccaacatcagccaatattctatagcgctgatcacatcattgagttacctagggtccatgttgcaaccactctgtcttagagcagtyatcaggaagttgaactttctaaaattagacttcttttatatttatttatttwtttttttttgagacagtctcrttctgtcactcaggctggagtgcartggtgcaatcttggctcactgcaacctccgtttcccaggttcaagcaatttttgtgtctcaacctcctgaatagctggaattacaggcatgcgccaccaccatgcccagctaatttttgtatttttagtagagatggggtttcaccatgttggccaggctcgtcttgaactcctgacctcaagcaatccaccttcctccacctcccaaagtgctgggattacaggcgtgaaccaccacacctggcctaaaatcagacatttttatgtatagattttttttcttaatgactgcagttggtaaatccaggttttgcaaatgttctcatgtaaataattgtggatatgatctataacagaactttgtgacttagatcatcartttttctaggtttcttgaagtggacccaaaacagtttgagtaacatcttggccctgcctataaagattctctgtgaggacatgataataaaaaagaatarcgactaaacactgagtgctaactatgtgctaggcatgcttctaatcactttacacgcattcactcattctaacctcacaaccctatggcaggtaatgtaattatcaccatttttcaggtgagaaaatcaaagccaagaaatgttaagttgcttgtcccagacttcttaatcactataaaatggaagaaaaagaatttgaaccctgaaaggctggcttcaggaatatgtcctgtctaacttttaaaatggactgttcrttgattatcaaacatatgctcaatctctctttttttttttttttttttttgaggkggagttttgctcttgttgtccagctggagtgcaatggcgcratctcagctcactgcaacctctgcctcctgggttcaagtgattctcctgccttaccctcctgagtagctgggattacaggcaccygccaccacgccyggctaatttttgcatttttagtagatggggtttcaccatgttgaccaggctggtctcaaactcctgacctcaggtgatccacccgcctcagcctcccaaagtgctgggattagaggcatgagccaccgcgcccgacctcagtctctcaattggtaagacagagtgtctatacttcagaatcttgtcaggaaattctccctgcatgttttaaagtgtgatgtcaagatacaatcatcattgacaattttctgaagaatakgaagtgtatccatatccttgactcaagccagtttcattgtttgggactacagtgtcttagttccctttggaactaagcttttgtttagcttttaatattyaattcaaacatcaactttccttcytggattgcacccttctcccaccaccggatccctaggtkcggggggtgtctaccccaacacactcccattgtttgtctgtgggaagagctccccaagggcaatggctgccccgacttatttgtctgtatcgccagctcctaagcaagggctcagtaaatggccatggaagtcaggaagaaagaagaaaggagagagggaaggaagttaggaaagagaaaaatttaagaatgaaaaaacagaaagagatggaaagaaggaaagaagggaggaagggagagaaagaragagaaaggaagagagggagggcrggagggaggaggacagggaaggaaagagaaagaatgaaaaagggagagagaaagaaaaaagggagagagggagggaggaaggaaggaaggaaggaaggaaggaaggaaggaaggaaggaaggaaggagagaatctattaacttagagaatggcttcatcacaatggtctgtatgggtaaatattgcccatggttttcagatcatctcatacgcctggatgtaggagacactctcccctcccacacacattctgattaaatttttggtttatagagcaaagaattcagaaacttatattaargatgaagatcttaagaagatgagattcccctccgtgcccttctgtgcacacrcagagatccaaagccttttccatagctgcctgacaggtttcactgctgcccygaagaagtccttgagacttgcagcaggagaaggatctctgtataatctttgtttgcctaataataggdctttaagggtttttaaaaattggtttcctttggggatcatttaaatttcccatttccttgtaaatatttttggtaaaaacattatcctcttggatttcagaggaagttaaaatagaaaaagcttgaaagcattcacaaagcaatgtgctctcaaaacacagccattcatttgaagttgtcttttagtctgaatccaaatcctccagtcaatacaaaccataatatgctgctyggtctctgtggatccattctgcctcaagctatgagcttcaaaattctcaaagagttggacttcaatgctgtttcttatattttataatactatttaatctgcctgaaggtgtaggatgtaatgtcatgatactgtacaaacttctgggctactggycaaccgatacagatgagaaatattctattactrtgaagctggagttccttcctactatttcatttgtatacatttgtattcatagcaattatttacttaaatattttagcacatgtaattttgaaattataaaggagatcttttttttttttctttttttcttggagacagagtcttgctcaatcacccaggctggagtgcagtggtataatctcagctcactgcaacctccgcctcyggggttcrwtcaattctcctgcctcagcctcctgagtagctgggattacaggcatgctccatcacgcccagctcatttttgtatttttagtagagatggggtttcaccatgttggccaggctggtctcaaactgctgacctcaagtgatcyacctgcctgtcagtttggagccaagtaggcagaaggtcagcagaggactagaaagaaactctctgttcccaaaccagtcaagcgccttcctctgggctcgcgttctacaagccatcatcaagcaaaccaagctggaactatgtcagccgcctcccccatgcatctaatcaagaggtagttagctgtatgatggcacagagagaaggtgagctctgaggtgaatccaagacttttcagtgaccacagtttctcttggttagggcccctgactcagagcctcacttcatacagtggggaaggacctgtaggaaagacttacattcatgccacaaaaggcagtccattctgttcttgagtgtaacatctttctgtcttaaaaataatagtaattaaggccaacgcaggcagatcatttgaggtcaggaattcaagaccagcctggccaacatggcaaaaccccgtctctactaaaaatacaaaaaattagccgggcatggtggtgcacgcatgtaatttcagctgctcaggagtctgaggcatgagaatcgcttgaacccaggaagtggaggttgcagtgagctgagatcgtaccactgcactccatcgtgggtgagagaatgagactctgtctcaaaaaacaacaacaacaacaacaacaacaacaaacgtaattagccaggtgcagtgggttgagtgcctctagtcccagctcctcaggaggctaagataggaggattgcttgagcccagcagttcaaggctatagtgtgctatgatcaagtctgtgaatagtcactgtactccaggttggtcaacatagcaagaccccatckaataatgattgcaagttgcagccaagtctcctgcaagttcaccttccatagtgtatctcaaatctgtctcctctttaccatcttcagcgccatctccatgcaagtctgcgggacatcatctcacaactgagatactgcaatggcttccatgcttgcccttgtcaccttaaaattcatctcctacttggtaaccagagtgagcctcttaacttataaagcaaatcatgtcacacacacccctacctgcttcaaccccttaaagggctttccatttctcttaactaaacacctaaatgcatgaccttgacccacaaagccccatgttccctgatccagacctcatctggctttcatccccatcatcggctactctcacctgctgacaagtgctagaagacccttgaggctacctgccttaatgactttgcacttagggatccttttgtctgaaacacttttactcctctcttctcaaaccttggggtctgtttaaatattatctccatagaaagggtatcacccaccctctacataaaaggtagcccaattcctctacccaccattattggttgtttgctggtaaacatttagcaactggctcctgagggtggggtgggtggggtaggtgggggaatccctgattgttaacgtttgcttatttctgtggtgtaaattctcctaccacagctaatttctagctatcagtctgaagtcaataggctggaaggttttttctctttccttttttcttttctgagacagggtcttcctctgtcacccaggctggagtgcagtggtgtaatcacagctcactgtaacctccacctcccaggctcaagccatcctcctgcgtcagcctccagaagtagctgggattacaggcatgcaccaccatgcctggctaattttttaattttttgtaaagatgaggtttctctgtgttgcccaggctggtcttgaattcctgagcttaagccatcctcccgtcttggcctcctaaattgctgggattataggcatgagccaccatgcctggtaataggctggaagagttctgaagcataacaatcagttattgagagctgatgcaagctggctccagctcttcactgcatgattgtctatcatatagcactgcttatttcctttaaggcacccatgaaaagctgtcagattatatatgtgtttctacacttgtttttgtgtttatctctatagacacagattttatagacagagattacaatgaaaattccatgagaaaaggtctatctcaaccctagtccaatgcttatcaatgtagaatatatccaatatgtatctatgaatgaatgataagagctcattctgtatacatgagtcttcccttttacagccttttcattttctcagtttctctaagtttaaaaaaataattttttatttcagggaaaaagctctattttactgcttttaacacctagaagccaagaaggagagaggatgttgagcaagaagggtgtgaaagaagaaagggctggaagcgtttgttagaggggtgtcatacaatatgacatggaaggaatttatagtttaaacccctctagtgagatgatttttagtcattatgttaattggaaaataagtttatctttagcatagaacacattctgccccttgttatgtaaactataaaatttcttcttcatcacagtgcctcctgcccagcacagtgcctgccagacaggggatatgtaaatagtaaataataaataatgctcttgactatggattctaagggccattctacaatggtaggaaagttccaaattcaagctaataaaacatttattggactgggcatgttggctcatgcctgtaatcctagcactttgtgaggcggaagtgggaggatcgcttaagcccaggagatcaagaccaacctgggcagcaatatagtaagactctgtgctccacaaaaaacttaaaaattagctgggtgtggtggcatgctcctgtggtcccagctactcaggaggctgaggtgggaggatcacttgtgcccagcaggttgaggctgcagtgagtcaagattgtgccactggactccagcccgggcaacagagagagaccctgtctcaaaataaataaataaaaataaaataaaactcttactgtgtgccaggtattggtgaaaacaaaagtcaaaacctggcactttctgtgggtgaaaagctgatttttccctaatcaggttcagtctattttcctaaggaagcctatagggttgtaagcctggacacacaagtgcagtgctctagcctgattgaaagcatggccagcgtggtggaggtggcagagaggagacagtaccaggtgactgggggacatggcacagggctgcagctgatactgctctgggcccctgggaaattcccaggacagcatcctgtgtggcacaaactaagatacagtccttgggtgaaatcatctccctcaagggaagttaaaacactcgctatccccctattctccaatctctcccttcctagacttgttggcaaaacacattgctcacatttacatcgaaaacagatacacaaacccaaaacaaacaaaccaaaaacaacaaaaaaggagagagaatctttatctaagatgacttttcttagttatatcattggtcctagccttgttggtcaaacacattgctcatattaacatcaaaaacagatatacaaacagaacacaaacaaacaaaaaccaaaaaaaaaggagagacgatctttgtctgagatgacttttcctagatctatcattggtcttagccttgttggtcaaacacattgctcatattaacatcaaaaacagatatacaaacagaacacaaacaaacaaaaaccaaaaaaaaaggagagacgatctttgtctgagatgacttttcctagttatatcattggtcttagccttgttggtcaaacacattgctcatattaacatcaaaaactctggggactgttgtggggtggggggagaggggggggatagcattaggagatatacctaatgttaaatgatgagttaatgggtgcagcacaccaacatggcacatgtatacaaatgtaactaacctgcacattgtgcacatgtaccctaaaacttaaagtacaataataataataataaaaagagaaaaaaagtcagaaaaaaaagatatacaaacagaacacaaacaaacaaaaaccaaaaaaaaaaaaaaaaaaaaaggagagagaatctttgcctaagatgacttttcctagttctatcattggtcttagccttgttggtcaaacacattgctcatattaacatcaaaaacagatatacaaacagaacacaaacaaacaaaaaccaaaaaaaaaaaggagagagaatctttgtctaagatgacttttcctacttttatcattggcctaggtctgaaacaccaaaggagaagcttcctctcctcttctttctctcacctctgcctactgcagaaaactctttcacaaagaaacacttttgtatgaaaccagtttccttcacatcactcaagtttctcaacacttgttctgttaataaacaaacataggtttgaaagtcttccttgttttaggactttcaaacctatgtttgtttactaacagaacaaggatttagggtttttttctctttccttttttgttctctgccattctatcataggttttgctttttcacctaaagaaaatcccacaatggcttggataaatgatactaatctgtatttacagtatctcactttactccttgctattttgagttcttacagttgactgactttcagatgtatgaaaaaattggaccaagttcttgaaaaactggttgtcaaatccyaattctgtagatgttccaagaattcttgagctttaaamaatgatccctgtcatgaaatgttttattttctagaaaattcttatgcctgacaaatacatcatattcatagagtacttttatattagatttcaggagctttacatttktttggctgacagagcgtttccaacaccctgaacattttcttagtacctttgttttatacttggaggactgaggcctgaataacttgtctcacatagcaaggtagtcagtaatggagtaagtttccarctggtttattggagacttactggttcattggagactcactccaacaaattttcacttaatttcctagcaatataatttatgaattatcaatattaaaatatttctttattgtgcaaagacattttatgtgcttccaagaattgttttcatagtgtataaaagagaatatacatattttatataattatgtatacatattatatgtatatacttaagccataaaaacaattcaaacatgaaggtatagaaaagattatggtaaggcaaatgagcaaaggcttaataaataagcaagtaatcaaatgttcaaaaatcaatgctatgtaaagataagatctttacccttaaaacatttaccattaacccgggaaaacagaaaacaaacagtctytaattgatgccagcacaaagarctagagtccttgtgcaaaatacaaagaccttctggaaatggcaaaggaaggaatgaattcataaactttaaagtgtgctcagaggggtcaggacaagcacaggcttctcaaaggaggtgagtgctctttaggtgggaagatggtgaccacgtggattgagggagaattgcaagattggcctaagcaaaactcaaaggcagaaatgtccagattttctcccttgtcaagtgttcttcactggargccagactctcgctatcattccagggtgtccctctggggaaagggaaggaacaccaccacattaaatgtgactcatctcagtctcagaagctgtggtgtgctggaacttgcttgcaaaagctcaagagagctttcccgttgcaatytggggaagtgaatgacaacacattggtagttttggtagtttagaatcagccaagttgggagtatttacaccacagaaaatgacaaatgctacaaatcagctccccatgcctatcctacccaccaccttttaaatgtttaccagcacacctggaagctgtgcattttacagtcagggtgctattgtggcagctgtgtgagaggaagagaaaggagatctctgggagtggggcagaagaaacaagtaaggagtcggaggtagagacaaagacgatggtggcaggaaaccaccaatgaccatcaagaagagcgagtgagtcacctaggaattcatgggaaagagatgagtccagaggggactggaatcaccgtagggaaaagcagagttgcttagtgctcttactatatgagtgctgacttaagatgttaaaaatctgcttatattcggtctgacacctaacatttttatgaagctaaaattattgttgctttgctatgtcacccagtcacttgtttctgttcactggagcagatccaaaacaattctttaatgaattttcgcactgcctgcaggtacwgctgccactcacctctgaattaaggaatttcaggggtgatctcattatgctcaattttcctcgatgtcagacctgacccccagccaatttcctgttaaagtgcataggtccatctttatggccacagggaggggctggtcttcatacacttgccattgtaaacagacctagcagtccaataccatattcacagtctcttattccaaaacttgccttttctcctacattacaaaccttagttattgtctaagtagttatccaaaacagaaacttgggagtcatctctagtttctctatctctttcatctcccatgtctgaccagtcagcttaatatctttagtatctgttcccaactgcttctgttactgccttacatcaagttctcatccctttttccttgagttccacaaaaactgcctaatcatctaggcagtggacatcttcagcctcaccatcctccagtctctgccccatattagactcacatggataaagcacacagctgatcatgtcaaaccaacaggggtttcctcaaagttttctagaattttcagataaagttcagactcttcttgtcaacccacaaggccttatgaaamaacgctcatctagttcctcagtcccattgctcatgaatcctccatagccaccagctctttgtgcttcagcctggaacccaccagactacccggctcctccaactacttcattacttacctaattcctactcatccttcaggattcagttaacaatcacctcgaaaaggaagtctcccatgatgtccagaatgatccagatatcgctccctcttcccctcactcctctctgcttctatggtgactgtatccatttcaatcccagttctggtcatacagttgggcggttgtccgccttccttacctcatggcaagaaccatgtcctctttgaccttgtgtccctttttactagcacttaattgatgcttgatgtatrtttggacaatggtttgtcctggacttgattttccctgtagctgggatagttagcttgagaatacaggggtacatatgatacagaaaataatgcaaagcagggagtaatatgtacttggccgtattctgtgactctaaaatgtaagagcatgaaagacaaagatgaaacattcttagacaggtggccttatcaacactaatgcagagaagaggagtcaggaagaggctgctggacctggccacaagaatgttaatggtgaccttatattaggtagttttagggaatgcaatgaatggcatagaaggatagggtgtgggagaggaagctaatgaatatatgttagttcagggtgtgccagatgctttacatacataattttatgtcatctttattttttatttattttatttatttatttttaagacagggtcatgctctgtcacccaggctggagtgcagtggtacaatcatggctcactgcagcctccacctcctgggctcaagtgatcctttcacctcagcctccctagtagctgggaccaccggcatacgacaccacatctggctatttaaaaaaagttttttggccaggcttggtggctcacacctgtaatcccagcactttgggargccgaggcaggtggatcacttgaggttgggagttcaagaccactctaaccaacatggagaaacctcatctttactaaaagtacaaaattagccaggcgtggtggtgcatgcctgtaatcccagctactcaggaggctgaggcaggagaatcgcttgaacccaggaggcagaggttgtggttaaccaagattgcaccattgcactccaggctgggcaacaagagcagaactctgtctcaaaaaaaaaaaaatttttttttttgcaggtgtcactatgttgcccaggggcgtcttgaactcctgggcttaagtgatcctcctgactcagcctcccaaggtgctgggattacataggagtgaaacaccgcacctgaccccacatcgtctttataatcactctaggaaataggtttatgtccttcagaataaaaacaaaaaataattaccaacaaaggagttgaaactcagaggttcaaataacatacatgaagtcatgccttcttagtgggtgatgtgggattcaaaccctggtttattacttcacaagaccacatgcttctcattataccataytctttatagatgtagaaggagacatcagaataaagctggtagaatttacccgagccttaaccctactcttcccccaactcaaaaatgtttatctgttgaagatggtaggaaattaggataatagccaaaattcacaaatcgatcaaaggaatatttttttctcaaaggagaaacttggatgttttcaaaggcaagtatatctttctatatttattcttaatttccatgaaaagttgtgctgattgggataattttaacactatgttgagactttgtaagtccatgtgacaggatggtatcatccaaggaccacagtgagaaaacaaggatctaaatacccagggttctatgttcagcccggccccaattcctcgtggcctgctgagaaactctattttgggagctttactgcccccaaacccctcccccatgcatcggtgtgagtgctgaactgggcaaaagaaggtaggtcacttttaggagtttgtggggtggcaaccctcctcttccctccccttccttttgaggagaaagagaattttagtcttctcagaaggctgatggaccctagactacaactctcaccaagttggataaaatagtaaagaaatcagacagtgttgatggagagaccaaaccatacttggttcaccaactgttgtcctgactgacaggaacgggtccaccttgagcagagaagggccaccatcagtgagggcctgaggcttgaatctctggggtttgcagacaccaggtgggtctgaggtggcagaacttctcccagagggaggcagaggggagtctcttgagaagagaggcagtagagggcatgaaaaagatcagaaggagagataaacatccatggagatacctttccttttggatgcctgcgtcttcaagggcggaattacacatttgttcttcctgcactgactggctgttcttttgagatctgcctgactgtccttaagaaaactccatcatagttcagtgtctgtttggaaagagaaggctgctgtagcagaagggactcatgggaagggatggaaattaaatttcagctgtttggcagggctctcgtgtagacagggctgatgagaacatctctccaccagtccatcccatgtgacacacacacacaggcacacacacacactagcatcagcagctgcagacattcctaaggtggggcattaagcagtgaggttgaattccctaaccctaccctatcaaggattaattagttctcctttgaagacagaaaggagccaggcgcaatggctcacgcctgtaatcccagcactttgggaggtcgaggcaggtggatcaccagaggtcaggagttcaagaccagcctggccaacctggtgaaaccccatctcaactagctgggcgtggtggcaggcacctgtaatcccagatacttgggaggctgaggcaagagaatcactggaacctgggaggcagaggttgcagtgagccgagattgcaccattgcactccagcctggacgacagagcgagactccgtctcaaaaaaaaaaaaaaaaaaaaaaagaaagggaagggtcttggcacaagccaaattacaaatgtgtctattttatgtttattcaagcattagccctcactttgtaaacatctgctttgcccactgcctccttagttcattttacctgttatggcagtgattcgacagagatgagagctttgagttgtatttgcttcactgtctgccaacaaccaccctggagccaaaaatacccttcagataaggcacaaagggacttggcctgggctgaaaccaaaatcaacttccaaagaccatagtccttatacgaatgagagctcagagctgtgcactgaagaaagtgagtcagccaacgacttcaagtccccatgtgcccattgtaagacatccctggaatgtggctctctgcatttgagcaatgggtaaacaatggggctgcaacaatacctgcctttaaaaatgagtgggttctgctaaatttccagagagagagaaccagatctgattttatatttttagttaggaaattccttgttttctccctgtggacgctcagaacctgataccatcctatcacatggacttgcagtctcaacatagtgttagaattatcccaaggaacacaccttttcatgggaattaagaatgaatacagaaagatgtatttgcctttgaaaacaccaaagtttctctactggcaaaaaatattcctttgatccatttgtgaattttggctattaccctaattccctgccaccttcaatagttaaacgttcttgagttgggggaagagcagggttaaagctcaaggtaaatttcaccacctttaatctgacgtctccttctacttcttgaaattagtgagaatttccagtgtaataatcaacagtgacttacgcagataatcaaaatgaatgctttttaaaaatatgcaaagctggccagtgtgatggcttatgcctgtaatcccagcactttgggaggctgaggtggggggatcacttgagctcaggagtttgagaccatcccgggcaacatagtgagatcatatccctataaaaaggaaaaataaaaatattaaaaaatattttaaaattgccaggcgtggtggctcatgcttgtaatcccagcactttgggaggctgaggcaggcagatcacctgaggtcaggagttctagaccagcctgaccaacgtggtgaaaccctgtctctactaaaaatataaaaattagctgggcgtggtggcacatgcttgtaattccagctactcaggaggctgaggcaggagaatggcttgaacctgggaggtggaggttgtagtgagctgagatcaggccactgcactccacctgggtgacagagtgagactctgtctcaaaaaaataaaataaaataaaataaaaaattaaggaatatgtaaatgtcatctcatattttagtaaatgtgattaatgtttcttgcagaggacttaatgtttcttgcagaagtaaaaaatgtaggcagacagaagagaatattcctgttttcctgtccataaatatgcccatatatagtcttctgtaacttacactattcacctcactgtagtcctctttctggttcaattgtcatacttcttcagtgatgatatttgcttgcttggctggctttatcgacaatctctacttcaaactcttttcaatgaccaaatccaggaaatattttaaggtgtgcattttcctgtaattccatgtagtatccatgactactccttttcatttcaatgtttaaaattctgataaaatacaggtaacataaaatttattattgtaaccattttgaagtgtacagttcagtagtgttaagtatattcacatttgtgcaaccagtccccagaactcttttcaacttgcagaactgaaactctgtaccattaacaacagcccgccatttctccctcccccttctccctagcagccaccattctactttgtgccactataattttgactaagtgccttatataagtagaattatacagcatttgtttctttgtgactgacttatttcatttagtattacatccttaagattcatgtatgctgtagcttgggtcagaactttcatcccttttaaggctgaataatattccattgtaagtatataggacattttgtttatccattcatccacccacggacacttgggtttcttccatgtttcagtttttataaacagtgctgctataaacatgggtgtacaaatatctctttgagatcttgctttccattcttttgagtatttaaccagaagcggaatttctagatcatacggtagttttatttttaattttttgaggaacctatggacagctcttgatataacatccttccctttggttttatataaaaatgcattcttttgaatattgtacctgtatttttatcaatactttttaaccctcaatattagccactttccatggtttagtgtttgaccctctaatgtttttttctttacattttctcctttggtaaacacattcactcttgtggcttttattaatattatcacctctatgaaaatctacatattcacctctggcttctgtcttgagatcaaaatatttagctatatattaaatatctccaatgggcaaatatccaaaatacaggcccaagacagactccatctgtgaatccatttctcttcacctacacaggaagcatttgagcaaatttaaccctaccacaagatagagccaaccaacagttagaacagtatgcttgggtggccactgggaacctgttgagactttaagttttactccyatccctttcattcatccatacaaatgtgtccatcagaagagatagatgctccagaaacaggacatctttgctgaagacctttttactgagtgagcataatgcatcgggagagtgcacatccccctcacttaaaacwtgctgccggttgggcaaagtggctcatgcctgtagtcccagcactttgggaggctgaggcgggcggatcacttgaggtcaggtgttcaagaccagcctggccaacatggtgagaccctgtctgtactaaaaaatacaaaaattagccaggtgtggtggcgggctcctgcaatcccagctagtcgggaggctaaggcaggagaatcgcatgaacctgggaggtggaggttacagtgagctgagatcatgccactgcactctagcttgggtgagagagtgggactctgtctcaaaaaacaaacacacagaacaaaacaaaacacaacaacaagaaaaaacatgctcccaagctgttcctcaccataaacgtcctggcaacagttgaagtggggaaaactttctagagaaggagtgactaggctgattcacaggtttgtacaaccactccctgaggctgctcagacatttgagaggtgagaaatcacaagtaaggccagacttcctataattaagcaggtgggaggacaaaaaaattaagattcgaagtgttactgcaattatgatctcatttgtactcccagactggtgatttcttttctagatgaattgtagactatatgcccaagtcaggaagcttggagttcagctaaacttctttttctcacctttaaaatctaacaagcttccaagtgaatctatcccttttaacatgtgcggaagtaaaatactatagcttaaaggattgggtgtgggggctggggtggttataaatggaacacaactattgtaaaattcttatattagatgctatgaattcaaagtagaccctgataagttaagggtgtaaattgtaatccctagaacaactattttaaaatgccaagaagtatagctaaaagatcaataaaggagatagaatgaaatattaacaattattcaataaacagagaagatagaaaagaagaacaaaaagcagctggaacaaatagaaaccccccaccagcaggatgtagacttgaacccaactatatcagtgattacattaaatgtaaatggaccaccaaacatttcaaataaaggcagagattattagactagatttttttaaaagataaaataggcaagacccaattataagctgtttataaagaatgcacttgcaatataaagaaacagacaagttcaaagtgaaatatggaaaaagatacccatgcaaacaccaatcacaagaaggctggggtagctgtattgacttcagacaatgaagacatcaagacaagaagaattactagaaatgattagagtcatttcataatgataaaaaggtcagtttacaacaagaccaagaaaagctgggcatggtggcacacacctgtagtcccagctacttgggaggctgaggcaggaaggtctcttgtgcccaggaggtcaaagctgcagtgagctacgaccgcaccactgtactccagcctgagagacagagtgagatctctatctctaaaaacaaaaaaaatgggctggatgtggtggctcacgcctgtaatcccagcacttcaggaggccaagtcgggtggatcagttgaggtcaggagttcaagaacagcctgatccacatggtgaatccctgtctctactaaaaatacaaaaattagcgaggcgtggtggcatgaacttgtaatcccaggtacttggaaggccgaggcaggagaatcgcttaaacccaggaggtggaggttgcagtggctgagatcaygccactrcactccagcctgggtgacagagtaakactctgtaaaaaagaaaaaaaaagaaaattaagaattaaaaaaaatttttttaaaaagaccaaaatgatctgccctcgatggtatcccttacatgccgcgccctctctgcttcttccactccttttgctcagttcaattttctttgtttcccaggagaattgtgtcacccttccattcaaatccatcccagcaacaagtttatttttaaaacgaaaatgaggtcacttctctaattaaaaacttttaatggtttctggtggttagctggataaagttgaaatcccttcattagcttcttattggtgtctcaaaggcttgccccaacccacctctccaactttgtcattcactgatcatcactcatgccagaccctactcacagcaattgcttcttgttcctcaacaagcattgcttctttctgtgcatccttcctccacttgccagagacctcctcccttaccttcctccacacattcctgaaacatccttctgtactcagctacaagctgtgcataaactggcctctcccatcctcccactccaccctcactctactccaacactggcctcaaatgtagtgagttgtctcccatttgaggctcactcttggcatttgctgttccctctgccaggcgcactctccttcctggatcattgcatggcgactaactcctttgaggcattgaggcctcaggctaaataggtacttcccagagatgctttccctaacttcccattcttatttagaccccgcctcactcgcatgcaacatgctgttttactgacctctcagccttgtttatttatctgtttagagtgtgtctctccacttcaatagaatggaatgtagactctaggagaatggggagcctttgggctttattcgaggatatattctcaaattttagaacagtgcctggcacatagcaggcagtcagtaagtatttgcagactacatgaattggtaggtgggtgggaacatttaacatagagcaagcttgtccaacccatggcctatgggctgcctgtgggccaaggatggctttgaatgaggctcaacacaaatttgtaaacttccttaaaacattatgaaattttcttgtggtattttttttctttgtgctcatcaggtatcattagtgttcatgtattttatgtgtggcccaagacaattcttccaatgtggcccagagaagccaaaagatcggatacccttggtataaaggaacttttttctagtgctaaatcccttcccaacgtgtcaggcttgctttgtcagtgcctgggtcagtgttggggctcygctgctgattccatttatcacccccttaggcagtttccctcccagactctcaggccttcctgggaaccttccacctccactggcagcagggctggtcaggtctggatcgctcagtctgccccggtgcctgtctatctgcctgtcagcatgcagatccaaatcacttagtcctgtctattttcttttcttttttttgagatggagtttcactcttgtcgcccaggctggagtgcagtggcgtgatctcggctcactgcaaactctgcctcccgggttcaagtgattctccggcctcagcctcccaagtagctgcgattacaagcgcttgccaccatgcctagctaatttttgtaattttagtagagacggggtttcaccatgttggctagggtggtctagaactcctgacctcaggtgattcacctgcctcagcctttcaaagtgctgggattacagatgtaagccactgcgcctggccagtcctgtctcttttcaatgctggctaatcagaaaagggtgcttaataattgctgccaatcatgacttataaaactcttttaaacacaactccaagcattttcatggacttcttaaaacgtattcctggcatggacggattaatggataaacaagatgtggyctatccatacgatggaatgttattcagtcttgaaaagcaaggaagctctgactcatgctacaacatggatgaaaattgaagacattatgccaagtgaaaagccagtcacaaaaggacaaattctgtgcgattccacttatacgaggtatcaagagtcatcaaattcatagagacagaaaatagaacggtggttgcccggcagtggcagaggcagaaatgagttctttaatgggtacagagtttcagttttgcaagataaaaaagttctggaaattgcttgtgcaacaatgtgaacgtasttaacactattgagctatacactcaaaaatggtcaatgtggtaaagtttatgttgtgcatattttaattttatcacaatttaaaaattataaaggagaggaataggcygggcacgatggctcatgcttgtaatcccagcattttcagaggctgagatgggtggatcacttaaggccaggagtttgagaccagcctggcaaacatggtgaaaccccatctctactaaaaatacaaaaatcagccaggcgtggtggcttgtgcctgtagtcccagctactcgggaggctgaggtgggaggattacctgagcccaggaggttgaggctgcactgagccgtgatggcaccactgcactccagcctgggcaacagagcaatccctgtctcaaaaaaagaaaaaagaaaaaagagtatatcacccataaaatattttgcccatagacatcttgtgtgtgtagttgtactggaaactgaaattctctttggaatgtttcctactgtgatgctgctggagaaggatctaaaggaatgaggatctggagtttggcgttgtggatccctggaggattcaatgaaacagtagtgagaaggcaggatagtcatgctgggagatgagggctgcctggcagctccaaggaggtgctttcctcaggtcacacactgaccttcagattccctctcaggaagaacctgatccataactctgaatgctcctgggatctgttaagcaagaatctgtgttttaattttattacatctagaaattaatagactgtraaaatttccccttggtttgctttttaaaatcatcttgtattgtttctctttttgttgtgtttttattttaaagaaaaatgttcaagtttaccttctcaatgtcctaaacctttaagttcaacatcattttacttttcccaagatgtcccttcacttctcttctcttctttgattttttctttccttccagaattcccctttctagtattcagtggcctgttttcttttgagagraaaatgtttggcaacttactctttggctgcaaaagtgctgaacaggttttaaacacttggattttcccagctggccctaatcctttgcctgttacataaagggaccacttaagcccctgaaattgcaggggacatttgtgttgaagttcactattctaggattatttggtgaggtaggtatggwtgtgaaactgcaatgcacattcaaagatgacactaccacgagtccaaatctatctgcacaaagccgggaggatgggcaggcctgcctccctctttgtgtggctggtctgtcctttgcagagtaacagctctgcttcctgtcagggctgtggcggttggcacagagtcctggcactgagctcagtggccccttcttccttaagcccagccacactgcttctgattcctggctcatgcttgccatggcttctcttgtgattttctttcaatgctatattgtcctctaagagcctaaaatagaagcttgaccatgatcctttcatagaattcaatattcagcctcaaaataaattaaatattgccacataataagtttcattcactataatatgtttattaataaccgatataatagattgtttaattatagttaattattgatactgacatttcatgattatagctgacattttttttttagtgcttcctttgtgtggccccgtattgccctgtatagaagcatttcgtcttcacaacaactctatgaggtaggtactattatcctcgttttccagctggaaaacaggcctggggagattgagaaacttacccaagtcccacagctagggagtggtggagctgggattgagttcaggttgtctgttttcagacccagagcctgcactggagtttgtgtgtccctatgtgcattccacagaacccagtagcagatggtgcaatgaggaaaacaaaaggagtgtcatgtactggaggcytgggtccccctcagatccatatgttgaagctgtaacccycaatgtgatggcatttgaggtggagtcttcaggaaataattaggtttacatgaggtcatgagggtggggcccccgtggtgggattagtgcccttacaagaagagraagagacaagggctgggtcactctccagaacatgagcacacagtgagatggcagccatctgcaggccaggaggagtgccctctccaggaactcaatctgcyggcccttgaccgtgaacttcccagcctccagagccatgagaagtaaatgtctgctgtttaagccacccagtctatggtattttgtaatcgcagcctgagcacagtaagacaaggggtagtgctttttaatcaaatcaattttgaaaatgccccatacagtactatcttcctatcttaaaggaccaaygatgcctattgaaatcaaagactctgaaaagtcctgcagtaaaggaagctatttaaatttgtttaaacaattgcttctcaaactttttgactatggaatatctccccacttatgaatatctcaaagaacacactggaaggtactactggaagtgaagcatatgcgtcagacgtgaatgtgtgcttatttaccaggtgggatgaactgcccaatgaagccataaagttgtataggcgagggtttggtagttgaaaagaggagagaagaatgcagacacagcctgagaaagggcaaagggccgtatccaacatgtgggaagtgccatttcagggaaaagagcccaratattccggaacatctggggaagataaaaggaagttgttcttgggataaatytggtgagaacctactttcaagagcagagtttagggcctgtcctggctggaggagctgattttaagaacagaaagaacagtccagtattaaatgttaatttgaatataggaggataggataaaaaatgactcagaattattatgttatctgggctgaaaagcgtcatatttactgcccattagaaattccttacaggctgatttcctaaagttagcttcatttctttctttctttctttcttttctttttttttttttttgaggtggagtctggctctgtcgcccaggctagagtgcagtggcgcaatctcggctcactgcaagctccgcctcccgggttcacaccattctcctgcctcagcctcccaagtagctgggattacaggcgcgcgccactatgcccggctaaatttttatatttttagtagagacggggtttcactgtgttagccaggatggcctcgatctcctgacctcatgatccacccacctcggcctcccaaagtgctgggattacaggcttgagccaccgcgcctggccgagcttcatttctttctaggaaattacaagacatggactcaaataaaaggctcagttgaccaagggaacaagatcttgtttagtcctggtaatacccaataaatatttgctaaatatatgcaaaggggcagggcacggtggctcacgcctgtaatcccagcactttgggaagccaagacggacagatcacttgaggtcaggacttcgagaccagcctggccaacatgatgaaaccccgtcactacaaaaaaatacaaaaattagccagaggttgtggcatgttcctgtggtcccagctactcaggaggttgaggcagaagmatcgcttgaactcaggaggtggaggttgcagtgagctgagattgcaccactgcactccagcctgggcaacagagagagactccatctaaaaaaaaaaattaattaattaattaattaattawattgaaaggacaagaaagggaggattaattgcacaatttgggttttgcatccttaaaatgaaatattaattttaccaagcagttagttttttaagagtaggggtggaggggagaaggtgagattgctggcagaaagataacaaattacacaaaagccatcaaggtgttgtgtgatcttacgatgaggtttcatgtctgttcatctgtcagatgatggggccagactaggtggtcttaaaggccctgtccgtatctaccatcctaagattctctgttcttcagaacacgctagaggaagtttgggaaagcaactgttttattcagagataagtacacttaatacaattcagacaatacatttgtaacgggcatttaacacagcaatcaattgtacaagtagattctatttactttttcttttattaagcggaagaataaataaacataactggcctcaattatttaacactaaaaatgttgacattgtagagataaacgtcaacaccaagaaatacgttttccatgttctccttaaaacaaatagaaagtttgaatgatatcaataattatcccttagaattgggatgtattcaggttttatgcgtgttacatagagcaaacaggctattttcaatttctgtgtttgtatatttacctataattgccaactttctgcaaatgatgtttcctcttgtgtaaataccaactggatttagcaaatgtcatgattattcgtgccacctattggtgaaatgtagtatgacagcatcttttgtgtgcaagacagctactatggggagaggaaggttgtcaggacaaattaaacaggaattctgtactcaagaacggtggagaatctatcttttatgaggcaattcaaaatttgaacactggaagggtatttgatggtagtaaggaattactaccttttttatttcctattattttttaattgtttatttttaggtgtgacattggtattgtggttatgttaaaacgtctttatcttttagagacacatagtaagatatttatgaatgagcgaaaatgatatgtgtaacatgatttaaaatagtattagcaattttgatacatgcacaacgtggatgaaccttgaaaacgtgctaagtgaaataagccagacacaaaaggacaaatatggccgggcatggtgcctcacacctgtaatcccagcactttgggaagctgaggcgggctgaatacttgaggccagaagtttgagaccagcctggccaacatgatgaaaccccatctctacaaaaaatacaaaaattagctgggcgtggtggcatgtgcctgtaattccagctactcgggagactgagacaggagaatctcttgaacccggaaggtggaggttgcagtggagccaagatcatgccattgtactccagcctaggtgacagagtgagactgtgtctcaaaaaaaaaaaaaaaaaagtgggggtaggcaaatatatagggtatctagagtgtcagattcacagagacaaaaagtagaatgatgattaccagagactgggggaggggaagtggggagttaccatctaatgggtccagagttttagttttgtaagaactcttttctggagatgggtggtggtgatggttgcataacaatgcggatgtctttaataccactgaactgtatacttaaacatgattaaaatgcaaagttataacatgtattttttagcacaataaaaaaaaaattagggccaggtgggtgcacctgggctggcaaggaaggggcacccgtctgggtgggtggggcagggaaggtacctgaggtcactggcttggcggtagcggcaggggtggcagaggtgraactgcagagttgcagggtccactgacccttaccctcagctggrgaataaccctmcagatcaactgcaagaacaaaccagcaatcctgagaggagccgcagaccctctgaaggaagcggactgcccctgcaggacacaggagacaccccaaatactgtgagtgccccaactgcggaagtgggaaagggggaccctcctcttccaaacacacatcaccactggggaagcggaaggtctgtttttgggagaagtttccaactttacctcaagctgagtcaagttagagagctgagccgagcaaaatacaagggtagaggaagcagcagaaaggtcctgggagctcgttgggtccccaagcagcccattcctgcctgacaccacagggatccatcaggagggtggccagaggagaagggggtaaaactccatagggagaaggaattctctagctgaactttataacaatttgaaaggggcaagaagcctcctgaccagaacctrggggagagcatgaatctggtgtgcagacttcacatgcagggggaagaactgaagcccttttcttccacagctggaagggaaaaagccttgggcaagttttcaagcccatctcaccctccaccaggaaacagactcgaggctgttgggggaggcacggtgggagtgaggccgacccttcggtttctgtgggagctgggtgaggcctgtgattgccagcyttccccaacttccctgacaacctgtatgactcaacagaggcagccataatcctcctaggtacacaattccagtgacctaggaatcccacccccatcccccacagcagctgaagcaagacctgcccaaggagagtctgagctcagacacacccagccccgcccccaccttatggtccttccctacccgccctggtagggaaagacaaagggcatttaatcttgggagttctagggccccacccaccaccagtccctttccacatgactacagctgatgctttctggaaagcaccacctcctggcaggaggccaaccagcacaaaaatagagcattaaaccaccgaagttaaggaccctcayggagtmcattataccctcctccacctccactggaacaggtgctggtatccatggctgagagacccacagacggttcacatcacaggactctgtgcagacaacctccagtaccagcctggagctggctagactcactgggtggctagacccagaaaagagacaataatcactgcagtttggctcacaggaagccacatccacaggaaaaaggggggwgtactacatcaagggaacaccccatgggacaaaagaatctgaacaacagccttcagccctagaccttccctctgacagagcctatccaagtgagaaggagccagacaatcaaccctggtaatatgacaaaacaaggctgttcagtatccccaaaaaatcacactagttcaccagcaatggatccaaaccaagaagaaatcccggatttacctgaaaaagaattcaggaggttagttattaagctaatcagggagggaccagagaaaggagaagcccaatgcaaaagtatccagaaaatgatacaagaagtaaagggagaaatattcaaggaaatagatagcttacagaaaaaaataatttaaaaattcaggaaattttggacatacttttagaaatgtcaggtgctttggaaagtctcagcaatagaattgaacaagcagaagaaagaaattcagagcttgaagacaaggtcttcaaattaacacaatccaacaaagacmwagaaaaaagaataataaaatatgaacaaagcctccaagaagtctgggattatgttaaatgaccaaacctaagaataatcaatgttcctgaggaggaagacctcacatttcaatacaatattgaatataaatggtctaaatgctccatttaaaagaagaaccacagaatggataagaactyrccaaccaactctctgttgccttcagaagactcacctaacacataaggattcacataaacttaaagtaaaggggtggaaaaaggcatttcatgcaatggacaccaaaagcgagcaggggtagttattcttatattagacaaaacaaactttaaagcaatagcagttagaagagacaaagagggacattaatggtaaaaagaccttgttcaacaggaagctatcacaatcctaaacatatatgcacctaacactggagctccaaaatttataaaacaattactattagacctaagaaatgagataracagcaacacaatagcagtggaggacttcaatactcygctaacagcactagacaggtcatcaagacagaaagtcaataaagaaacaaaggatttaaactataccttggaacaaatggacttaacagatatatacagaacatttcatccaacaactgcattctattcaacagagcatggaactttctccaagatagaccatgtgataggccacaaaatgagcctcaatagatttagaaaattgaaattatatcaagcactctgtcaggccatagtggaataaaactggaattcaactccaaaaggaaccttcaaaaccatgcaaatacatggaaattaagtaatctgctcctgaatgagcactgggtcaaaaacaaaatcaagatggaaatttaaaaattctttgaactgaatgacaataatgacacagcctatcaaaacccctgggatacagagtcgaaaggcctcttcaaggaaaactacaaaacactgctgaaagaagtcatagatgacacaaacaaatggaaacacatcccatgctcatggatgggtagaattaatattgtgaaaatgaccatactgccaaaagcaatctacaaattcaatgcaatccccatcaaaataccaccatcgttcttcacagagttggaaaaaacaattctaaaattcatgtggaaccaaaacagagcccacatagccaaaccaggactaagcaaaaagaacaaatccagaggcatcacactacctgatttcaaactatactataaagccatagtcaccaaaacagcatggtactggtataaaaataggcacacagaccaatggaacagaatagagaacccagaaataaacccaaatacttacagccaactgatcttcaacaaagcaaacaaaatcataaactgggggaaaggacatcattttcaataaatggtgttgggataattggctagccacatgtaggaaaatgaaactggatcctcatctctcaccttaaacaaaaatcaactaaagatggattaaggacttaaacctaagacctgaaactataaatattgtagaagataacattggaaaaacctttctagacattggcttaggcaaggatttcatgaccaagaacccaaaaacaaatgcaataaaaacaaagataaatagctaggacctaattaaactaaagaacttttgcatggtaaaaggaacagtcagcacagtaaacagacaaccacagagtgggagaaaatgttcacaatctatacatctgacaaaggactaatatccagaatatacaacaagctcaaatgagtaagaaaaaaaatcccatcaaaaagtggcccaaggacatgaacagacagctctcaaaagaagatatataaatggccaacaaacatatgaaagaatgctcaacatcaccaatgatcagggaaatgcaaatcaaaaccacaatgcgataccacctcacttctgcaagaatggccattatcaaaaaataaaaaaaaaaccagtagacgttggcatgggtgcagtgaacagggaacccttctgcattgctggtgggaatgtaaactagccacagtggaaaacagtataaacagccactatggaaaacagtgtagagagtccttaaagaactaaaagtagggtcgggcgtggtggcttacatctgtaatcccagcactttgggaggccaaggcaggtggatcacctgtggtcaggagttcaagacaagcctggccaacatggtgaaaccccatttctactaaaaagtaaaactagcctggcgtggtggtgagtgccttgaatcccagcttctcgggaggctgaggcaggagaattacttgaacccaggagccggaggttgcagtgagcagagatcatgccattgcactctagcctgggtgacgagagaaactccgtttcaaaaaaaaaaaaaaaaaagaacaaaaagtagaactatgatttgatccagcaatcccactactgggtatctacccagargaaaagaagtcattacatcattacaccaaaaagatacttgcatatgcatgtttacagcagcacaatttacaattgcaaaatcctggaaccaacccaaatgcctatcaatcaacaagtggatgaagagattgtggtatatatatagtggcacatatatatatatgatggaatactacgcagacctaaaaagaaatgaattatcagtgtttgcagtgacctggataagactggagactattattctaagtgaagkaactcaggaacrgaaaaccaaacatcatatgttctcactgatatgtgggagctaagctatgaggatgcaaaggcataagaatgatacartggactttggggacttggggggaagagtgggagggtggcragggataaaagactacaaatatggtgcagtgtatactgctcgggtgatggatgcaccaaaatctcacaaatcaccactaaagaatttactcatgtaaccaaataccacctgtaccccaataacttatggaaaaaaaattgttaaaaaattgttaaaaaaaaaatttgaggccaggcatggtggttcacacctgtaattctattacattgggaggccgaggtgggtggatacttccaccaattgcatctttcttttttttttttttttgagatggggtctcactctgtcacccaggtcaagagtttgagaccagcctggctaagacggtaaaaccctgtctctactaaaaatacaaaaattagccagacatggtggcaggcgctggtaatcccagctccttgggaggctgaggtagagaattgcttgaacccgggaggtggaggttgtggtgagtcgagatcacgccactgcactccagcctgggtgacagagcgagactccatctcaaaaaaagagaaaagaaaaaaaaattaggccaggctcagtggctcatgcctgtaatcctagcactttgggaggctgagacaggaggatcacttgagcccaggggttcgagaccagcttgagcaacattgtgagaccctgtctctacaaaaaaattttttaaaattagccaggcatggtggtgtgcacctgtagtcctagatactcgggaagctgaggtgggagggtcatttgaatctgggaggtcaaggctgcagtgaaccatgatcacgccactgcactccaccctgggcaacagagtgagatctcatctcaaaaattaaaaaattagaaaaacttagaaccatagggaatgggagtacagatgtgacaagattgtccatgagttcatgaagtatgtgagagtttatactcttctctgttatttttgtatgtgtttcaaattctctataatgaaaaatttctttttttcctaatgaaactcctggtctaggagggaagataaaatgtgaacatgaataacttctacatgacagaaagagataaactaagagaagtgcagaggaaatttcaagaattactatgcttccacagatgaacccaaatgcaaagcttagagcagtgataacatactctttagccagtcttcagcattatttgtactgaatattcaaaaatgattttgtgatgactttatatcagtgtaaagttctcttcataggtaaccctctaagggaaaaatagaaaagtaagtcctgcaaacaggagatagtcttcttgggaaacttcagttctgagcaagaggatgctaggatagcagagactggacaagagtgttctcctagaaatgacatcataggctgccagaacaaattgcctgtgagaatagcatgtgcttaatcaggagatagatgcagagaacacccataggtgtaggttagaatcatgctaaagagcaacaggctggacacggacagttcaaatccgtgcgaaacacaacacaaagacgatagcacagcgacaacagcaaaatctccacttcattttggccatgacttttcacctcttttctccaccaaaaaccttatttctttaaattttccatgtgcaactcattgattgagcacccaagtatcaggcaccatgttgaacactgaggcggtaaagggagagtgtagttctgcctccccaaagagctcacaacgtggccaggtggaggcacatgcacaactgagaggctaaaatgtggctactgaatcatatggccaggatggaaaaagaaaaatctttaggaataaaaagcaaggcacctttcattctgtttgagatgcctgtgaggcaggttcactgtactctggttaccaattccaggggagatcctactacatggaggatagcaaagatcatcactatgccaaccaaccaccaggaagaggagtccagatacttctgccaattgcatcttttttttttttttttttgagatgggggtctcactgtgttgcccaggctggagtgcagtggtgcgatcttggctcactgtaacctccacctcccaggttcaagtgattctcctgcctcagcctccagagtagctgggactacaggcgcatgccaccatgcctggctaatttttgtatttttagtagagatggagttttgccatgttggccaggctggtctcaaactcctgacctcaagtgatccacccacatcggcctcccaaaatgcgcctattgcatcttgggctgcaatttctaccacttgcaggagttgagggagacagaacactcacagaacaagttaggcaaagcaactttattcatcacagataggcagcaaggcacaacagaagcctagcatccattgcgagctgattctgcaaggctcaggaagctactcagaatggatggagtcttgtctgcacatgccccacaatgcactgtagctgaggcactctgaaagcactccactctgggttttataccctggggggaaactgggatcactggaccacagcattggaggacatcttgtcctaagaggaacagaaacagaatctggcatrttctggacagcttttccttatctcagaatgttgtttccagcacattctagcrttattctgagaactacaagtgaaaaatgggggaagagctgggttatcaaggycatccaggcacttatcctgcaatgcccaggaaagtcaccccagaggaggttacatttgagttggcctcaaagcayggctagaatttctagtccttatctggaggaaatagagtgaggaaaaacatacagctgagtatgccaaaaacacaagttgtccagtgaatgtgtgtaaactcaggctgaaatttagcagggatgatgagaaaggagatatggattaggcctgattaggaatgccctgatgtgccattctagggaatctggagtgggcccgggcttgaaaaccagcagtgatgaatggtagaattctgtttggccagatcagatttgaaaataattttgaatrcctttggataggaaattcagctccaatgactcatagacctgtggtgtaaggcctgaaattaagattcaaaactaagtgctgccttgaccatggaggctggtaaaatcagggtacagaggctcaaatggattaactgcaagttctcctcccactctgctcctggtggataaagtcctctagccaagcaaccctccttatcaaagggaccaggcgcagtgctaggcttcaggtccccgtcagcctgtagaattatccaagcaaaccaaacacatcctcttacaggaaccaggggcacctcgccctcttgttactacaaagcctgcctcccacagctcctggtggttcactctgttcccarctgcaacccccacgtggctctctgtggggcagtgtcgtccttccctgggccatgagcatatgtgactaattacctgctgcccayctcatctgtctaggcttggatgttgtacattcaaccatcctctcaactctagggcggaatccctccctcaccagtggggtgaagtggaggcaaactaaatcaaactaaataagaccccatcataccatgttgtattgcactctgcttcttttttttttttttttttttttttttttttgagacagggtctcactttgttacccaggctggagtgcagtggcacaatcttggctcattccaacctccacctcctgggtccaagcgattcttgtgcctcagcctcccgagtagctggractacaggtgcttgccaccacacctggctaatttttgtgggktttttttttttttttttgtatttttagtagagacggggtttcrccatgttggccaggcyggtcttgaactcctgacctcaagtgatctgcccaccttggcctcccaatgtgctgggattacaggcgtgagccaccacacctggcctcatcctgcttctttacacacttacatttcctgcataactgaaaaaacttgaccttgtaacacctcttttcaggggaatgacatataaaattattcataatgacagactatgaaatattttaccaatattttcctttaagaaagattagggaagtagtgtttaggatagattctacatggaacaaattagaagtagaaagaccagtcaagaagtatctgaacagaatgatagccgagtggtgtgcagtggatactgtgatatgctgcccagaaaggacagtgaaggacatcaggccccagctgctagaagtgctgctgcagtcagcctgtagctcttagccctctcagaaagtgactgagctgcagagagctgcctcacccaaggacatgccctatctttgtccttttgggctgctatcctaccagagactaagtagttcaaaaacaacagaaatgtatttctcacaattctagaggctgggaaggccaaagtcaaggcaccagcaaatttgatgcctggtgagggttggcttcctaactgatagacaatgtcttcttactgtatcctcatgtggtggaagggataagggagggacctctctggggtgtcttctataagggcactaatcccatcccgagggctccatccttgtgacctaatyacctcccaaaggccccacatcccaataccatcaccttgggggttagcattttaacatacgagtttyggagggacacaaatattcagaccatagcacactcrtgcctggggaagstcatatcgagtgaccaatggatggtggagcataagggcttggccagctcagccatgcttggcatgtttctaaaagtccacctaactccagagctcttggtgaggtttgctgagactgtcagccttgggttgtagctcaacgtcactgctctgcccactcctgcttctgtcccctaccttccacaggtgtggtccctcccacaggcagcgccttcatgaaatgcctctttagagtctggtttctggggatacaacctgtgatgcttaaaaaattaagaggccgggcacagtgggtcatgcctataatcctagcactttgggaggccaargcaggaggattgcttgagctcagtagttgaagaccagcctgggcaacatagtgagaccatgtctctacaaaaaattttaataaaaaagaaagaaaaaaaattagagatgagaaatgaggggaggagagggaaattgagaaataagcttagataattttcaccctaagggtaaatctcccaaataatgtttccccatcttctcagagagcccacagtctgaacgaggagaaagctgttcartgaaaaatcaataagtagtcaggtgaatcctccaggaatctgcacagagtggcagtgccacaccttttacataaaccaacctcctcactctcccctcctcagcagctcccaggcctgaggacgggcagcgtcactttctcccaagaamgatggagaatcatttctcaccagtaagaatgttggcctcacattaaattcgtgatgtytaatgggcttatttatgtatttatttatttttgaaatggagtttcgctcttgttgcccaggctggagtacagtggcacgatcttggctcattgcaacctctgcctcctgggttcaagagattctcctgtcttagcctcyggagtagctgggattacaggcacacgccaccaygccmagctaattttttgtatttttagtagagatgggggtttcaccatgttggccagggtggtctcaaactcctgacctcaggtgatccacccacctcagcctcccaaagtgctgggattacaggcgtgagccaccgcgcccagccagtttattcatttatacttcaatcaggattaagtacatcatgagaataaaacaatccagatggttctgagactgaatctgagctcctgggtaacacagcagggtggatctggactagacttcctgccctggatcagcaagattggtctcataggtgtgcactgaaggcagcccgagaaggtgtgatttgatgggcacctagaagacccatctatccccaaaagacatgactcagtgaggctctagaccctttctgccacagcagcttcatgtgggctttgtagatcagcacagctcttagacccagctgtgcacggtgcctgacttgggccatatatattagagaaggagtcaacaaactacagactttgggccaaatctaacctccccatccagacctgtttctgtatagcctatgtaaaaaatgttttttacattttaaaaatcttttgtaaatttttaaatttgtaattgttgtgggtacatagtaggtrtatatatttatggggtacatgggacgttttgatacaggcatgcratgtgaaataagcacatcatgtaacatggggtatccatcccctcaagcatttatccttagtgttacaaacaatccaattatactctkttatttttacatgtacaattaagttacgttatgattgagtttttacttttttgagkcagagtctcactctgtcgcccaggctggagtgtagtggtgcgatctttgctcattgcaacctccgcctcctgggttcaagtratcctcctgcctcagcctcccaagttactgggattacagacatgcaccaccacacccagctaattttgtatttttagtagagatggggttttgccatgttgctcaggctggtctccaactcctgatctcaggtgatccactcacttcggcytcccaaaatgctgggattacaggcgtgagctactgtgcctgatcgagtttttacatttttaaataatggaaagaacccaaaagaagaatattttgcaacataggaagattatctgaaattcaaatttcagtgttcacaaatgaagttttcctggaacacagccatgctcattctcttaaatatcatctgtggctgttctcatgcccaacagcagagttgaataattgccacagaaaccacatggccctcagagactaaaagtttactacctggtactgacccctgctttacagctttgctgcttcattctgtggtctgaagaccagcctcaccagctttacctgggaggctgttagaaacgcagaatcttggtccctgccctagacctactgattcagatcccaggaaatttctattcccatgaatgttggagaaatgtcagcttagagggttctgcccyggccatcctctgctgcccytcccctcagtgcaggcaaggtcygcactgagtcacagatttaacattatagttagtcataaatgttttaaaattatgagtctgcaaggtcaagggcatgcgtcctcctggaaactcttccccatctaggccatgctctgagtgcctgggaattttctgcctccagggtcaatgccagcttcctctctggggtccattctagcccaataggtggtcaagatgcagctgttacagggtggacggagagtgcctgtgcttgaatttatggatggtgtgtcctcttgctcaagaagcaagttcctcatggcataaagtgggaagacaaaggggaaggatggcagctgggggttagctcttgctgtcccattaccttctggcttgggctatagagccyaggaattctagcctgccatgtagttatgtatatatatttgacagtttattcacttgatagataacttctaagtatttcaacatagcttatgggccttcattggtactcttgaatgtgaatagcgtgtctattgaatatttctcaaygtgtgttctgaggaccccatgcagcagaattcacgtgggttgtttgcttaaaatgcaaattcctgggtcccgtttttgattatcctgaatcagaatttttgagggtggagccaagggatctgcattctaayaagtttcccagtggttctggttcacaccagagttttaggaactcttgaaactggggtagggtggacaggagctggctcccagtgggcaggagcttcaggggagaagaaaaggaaccagccagctcaggggaccacaatggctgccagcttcagacgcttcctatttctctcattatctctcttcctcatctggcctgagcccagctctgggtgtgagctgtggagagaggttttctgccaggattgggcaagggcattctccyctaatacagggccttcagagactgctctaccgaaggaagtgtctgagtcaatgtgaaactggaaagaagagagatatggtttggctgtgaccccactcaaatctcattttgaattatagctcctacaattcccrtgtgtcgtgggagggacccggtgggaggtaattgaatcatgggggcgggtcattcccatgctgtttttgtgatcgtgagtctcacaagatctgatggttctataagaaggagctcccccgcacaagttttctcttccctgccaccatgtaggatgtgacgttcctccttcgccttccaccatgattgtgaggcctccctagccatgtggaactgtgagtccattaaacctccttcctttataaattccccagtcttgggtatgtctttattagcagtgtgaagatggactaatacaaagaggaactaggggagcttggaggaaccagagactcaatcagggattcaagtgaagtctctgttgcaaacccttgagcaggtgagaacccctggactcttgcaggggatgtgggaggagctgtacatacagacagtgctgtccagccaatgtgggttcaaaccctgcatctgtcactggctatgtgaccttgatcaagttccttaaggtctccaggtttgttttcttatctgtaagatgagaatcctcttctgcaaaccatgtctgtttaaaatatgtgcttattttgaaagtgatgtagcaacattttctctagttaatgttctttctccctcataattttaaaacatttattcatgactataatgttaagtctgtgactttatttttgctaaatgtccatctcagagaagaatatgactttatatagcgaagtattttttaaaaaatagccttagtaatgcatatttgcaataaaaatatttgacaatcctaataccttcaggcttgtcattggaatgaaatgtgataattaagtaaaacccattcttgctacaaagatttaagtggtggccactttttttccccccgagatggagtcttgctctgtcacccagactggagtgcagtggtgtgatctcaggtcactgcaacctctgcctcccaggttcaagcaattttccctgcctcagcctcccaagtagttgggattacaggcacccgccaccacacccggctaatttttatatttttagtagagatacggtttcaccatgttgaccaggctgttcttgaactcctgacctcgtgatctgcctgcctcggcctcccaaagtgctgggattacaggcatgagccactgcacccggccggtggccactatttattaggaagcttgttatcttctaccactgcacctgctgatgattgctctcacaggcacttaaccactggctaataaaatgaaagttccttaaaccttacgcacaggaagccacttaggctgcagttgcagccctgtgccagggcagtgcttggccagtgacctataactccctgaggctccttgtgagggagcaactcctgaagtcacatggcgaagatgctcacaggacatgattcttaggatgatcccacctgtcgagaccacaggctgtaactcactgtcacaagttagtgatgaacgcggaaccttaatgaaaccgccagcgacagctgtgccatactgcaagtcaccactagggggaagcagaatacaagcatccgggtaagaaccaacgaagcgctgaggaacgtggcccaggaagccaaatggggatgggaggggagaaggatcctaggcgcaccctccctgttcaccccacccaccgggcagacctgcacactcctggtcttgctctcaaaccatctgattcctctgtttctctgttctctggtcctggtacagcacattatatcttccgtatggcaaaggccagtggttctctaacatggctgtatgtttaaatcacctggggagttctgtaaacgctctacatcctggccttatctcaattaaatctgaatctccagtgtttggaagcagggatcagtgctttttatatttatttatttacttgcttatttatttttgagacagagtctcactctgttgtccaggctggagtgcagtggtgcgatcttggctcactgcaacctcagctccctgggctcaagcgattctcatgcctcagcctcccaagtagctgggactacaggcatgcaccaccatgtccagctattttttttttctattttagttgatatggtgttttgccatgttggccaggctggtcttgaacttctgactcaagtgatctgccagcctcagcctcccaaagtgctggaattataggcatgagccactgtgcctggcctccagagctttttaaaacacaacaggtgattccaatttgcagccaattttgagaaccactgttttaggcaaaagatctcatttcttttcacatgaaagctggctttcattgttagaggactcctccaagaagcctccctaacgaaccacacgttttcctcctcctcctccatctgtccacgggcctgtctgcagctgatgccagtacttatcatggcttaagatacatatgggttacctgagggtgttgcagattcagattcgttcagtctggggtgaggggttgagacgctgcctctctaagtcccaggtgctgctggtccacagaccatccacagtagggttggcaggacatcaacctgtgtttccgcatgtgcacctttgcagttgttctctgttttgcattccttttctgcttctgtattaaccatgtttctcctttctgtaaacctgatgctttaacatctgccccgcgtgcatctgcaggacacaccttgctctgtgcaacccaataatatgtctccctcactgtccccctccccctggaaggagtcctccgggtgatatgcttttcaaatgaaaaccaacccagagctcgcatcccaaccaattcccttatctggctctcacactccaggccactatccccctgccctaatcacccaggaccaggtatctgacaaataggaacagcctgtatgccccagagcctgctgaaatgatttaaactagccagtcctgagctagctaaccctgccttgcccactccttcctgtggaaaccataataagggctctggccacgttctcttctccctctgcctcttgaccagccctcgtgctgccccgggtgtccctgcatggcgtggcgtgcccacttctcttagatctgagagtaagaaactctctcttcagtgagagtcatcatctgatctattggcctcaccaaagctgaataaaattaaaacctattagagcaactcccctgctaggaggagaggcgtggctggttcccaacttgtctgcatcccgcctctcctcccagtcttgcttgggtccctgctatgctgctcatggtatgaacacaagaccctgtacacacacagaaaagagcacaatcagtgactgttgaatgaataagtgaacaaatgtagggagaaaaattctgaacttggagacctggctctgccactaacagctgtgagagattgtgaaggtgcccccgagactcagtgacttcatctgtcctgttatttcatagtgaggccacctgagcaatatgtgttaaagccccttttcatccacatggtagcatcctcctttctctctccatctcctacttgtcactggtgttcagggttccagccttgcccttcacacactgcctgggaggtcccatctgtttctgagtctttgaatctttacccacagctgctatggtctgaatatctgtgtccctccaaaattcacacgttgaaatccaaatgcccaaggtgatggcgttgggaggtggggccttcgggaggtgattagatcttgagggtggagcccccattaatgggattagtgcccttatacagaaggctccggagagctgcctcacttctgccaccacgtgaggacacagagagaagactcacctgtgaatcagaaagcagccctcaccggacaccaaatccatcagcaccttgaccttggacttacttcccaccctccagaaccgtgggaaatacatttctgttgtctatgagttacccgatctaaggcattttgttatagcagcctgaacagactaagacaccagctcaggctcccctcttgagctccacacacgtctaaccaaatgccgacaatccatctctatcctgtcaacctgcctgtaagtcatatttgacacattcaaaatcgagtttatcatgcctttgcgcctcccaaaccagctcctcccctcatatgtcctatcaccacaagtgcccagaaggggagtggcacacggaaggaagcaatctgggcgatgggggtggaattagatggcagagatttgtgacaagcatagaagaccacccagcacgctcaggggcagcatcaatcataagtcacatcacagcagagccatggtgctcatcacagcagagccatggtgctcaagtcccgacagggagagagggtgagggagagagagagagagagggaaagagggagagagagggacagagagagacagagagagagagagagatgcagggaccctcgacccatgcaggtgggcttgggatcatgagagcacatgaggatagaccccaggctggcttcactgagacgccacccagagaaaggcagctggaggatgaggtgggaatggagcccttgccaccttcctggagctccaagccagtcaccctcaccaggggcccagaggccattggggcaaacagcactgaaactctttcaaaccctgctggccacttccctcccttggggagcagcagagaagcccactggtggccagtgctcagtcagcacagctgaggtgggctggcaaaactcctggctctctctgtctccgagaattggctggggcatctgatggtggttgcagagcctcatctcccctctcttgaacttagcggagatcaggctcagcagatctgcccaggtccccaggaggccgggctggttacagtctctggggaccaggtgctccccttttgaaccaaggttatttctcccaaccagggagcttccataatcacagggatgtcccctgaccccatccctacaaatatgtagagtgcaagggagcaggcagcagggggcaggggtgggctcttaatccctggcagggagctgctgccgtctgatcctctgatccgagttgtgggacagcactgggtgtgtgctcctacttcctggcttataggtttcctcctctgtgtggcaccagcatgtgtgtccttgactccttagcagagaggagccaattcactctgtctgtgaagccaaaacacaagagacctgcaagttttgaaccctcctctccaccaagatgtgagacgtatactggcagatccctgagatcccattaggctcaggccctccacccaccgcctcttctgggctcaagcctccctctggcacctgcagcacagaacagcctcctccagcctggctccacgcctgccccacccccatcttcctccaccctaccccctggaatgagcttcccaaaaggcagatcttaccaggtctctctcctccttggagcacttatcaatctctacttgccttttccattctcttctccccatccgtttctacatatgggtttcctccccagtttcactgagacagggccattgcccttgcaggcctccctgctgtttctgaatacacagcttcttcttggatttgttctcttactctcttccctgctagaagccgtggctaacctgttcttatcttccctgactgaggtgggcctatttctccgctctgtgctcatagcagcctcctctaacctccatttgagactttgttttattgcaggggtccccaacccctgggccatgggctggtaccagtctgtggcctgttaggaactaggccgtacagcaggaggtgagtggcaggcaggtgagtgaagcttcatttgtatctgcagctgctccccatggctcacatcaccacctgagctccgcctcctgtcagatcagctgggcattagattctcataggagcacgaaccctattgcaaactgcacatacgagggatctgggttccctgctccttatcagaatctaatgcctgatgatctgtcactgtctcccatcacccccagatgggaccgtctagtttcagtaaaacaagctcagggctcccactgattctacgttatggtgagttgtataattatttcattatatattgcaatgtaatcataatacaaataacctgcacaataaatataatgcatttgaatcatcctgaaactaccctgcgacccccgtccgtggaaaaactgtcttccacgaaaccggtccctggtgccaaaaaggttggggaccgctgttctattgcattacattctaatactttattttttatttctgtttccttcactgtgggcgagccccttcagggcaggggtttgttccctccgaagcttaacagcctggcggcagagctggcctttgaaggttttctgtgaaatgagttcaccggtgattctccagatgtggtccctgaaccagcagcatagcagggcccaggaacctgtgagaaatgcaattctcagtcccgccctgacctgccgagtcagagctctggggacggcacccggtcctcagccctcggttcccgtagcccttctgggtgattctcatgcatgctctcattagaggtcagctgaataaggcacgtgagagcctaatgaaatatgatgtgaatgggatttgctattactactcagcctagactgaaggatcctggggtggtgagcggccg

SEQ ID NO: 10853 - DNA, 14268 bp, Homo sapiens
cttgtgctcagccgagttttaaattatgcagatgcatgtgtgcattagtttctcttccccttccacacaagtgcatctgtgagggcaagaatgacaatgggcttactttccactgttccccttgtgcttggcacacagaaagtactcaagaaatacttgctgaatgaagaatcaaatggcagtacctttccagattctgctccatccatttcacttcctgaaggaacaggaagctcggaagcaggagctccgtgtctggggaactctgtttgagagaggatgatcccagctgtggcatgctgggactccctggaagggctcgctgcaggcctgcgccccacttgctttctgttttgtaggactcacccgcaaaaaggactgcttctctccacaagctttgcatgtccacttgacactcttttttacctgcaatgaaatttcagaaatacaactcagataattatttaaaacaaaatggaattgggctggactcggtggctcatgcctgtaatccccctttgggaggccgaggcgggcagatcacaaggtcaggagttcgagaccagcctgaccaatatggtgaaacccagtctctactaaaaatacaaaaattagccaggcatggtggcgggcacctgtaatcccagctactcaggaggctgagacaggagaatcgcttaaacctgggaggtggaggttgcagtgagccaagattgcaccactgcactccagcctacacgacagggtgagactccatctcaaaaaaacaaacaaacaaacaaaaaacaaatggaattggatctgaaattttttttttttaaatcccaagtagctgggattacaggtgtgtaccaccacgcccagctaatttttgtattttagtagagatggggtttcaccatgttgaccaggctgttctcaaactcctgacctcaagtgatccacctgccttggcctcccacagtgctgggattacaggtgtgagccaccatgcctggcctgaaataatttttttttttttttttttgagacagagtctggctctgctgcccaggctggagtgcagcggcgcaatctcggctcactgcaagctccccctcccgggttcacgccattctcctgtgtcagcctcccgagtagctgggactacaggtgcccgccaccacgcctggctaattttttgtatttttagtagagacggggtttcaccgtgttggccaggatggtctcgatctcctgacctggtgatccacccgcctcggcctcccaaagtgctgggattacaggcgtgagccaccagggctggatctggcctgaaataattttaaaaactgatggaaggagtccagaaacaaaccaaagcatgtgtaaacatttagcgtatcataatcataaaggtggtactttaaaagtgagaaaagaacagactatttaacaagtccgggttggtgctgggaaaactggctatctgtatgaaacacaatcaaattgggctgggcacagtggcttgagcctgtagtctcagcgacgagggaggccaagactactcgagcccaggagtttgaggccagcccgggtagcatggcaagaggctgtctcacaaaaccaaatccaaacaaaacaaaaccactctgaaagacccaaattgaagctgtaaaaaaaaattccataatattcctgtctcgcaaaaccaaatccaaacaaaacaaaaacactccgtaagactcaaattgaagctgtaaaaaaaattccataatatttaaattcttgttaaacttgggtctaaaaaaaattccgtaacatttattttcaattcttgttaaacctgactagatgtgttctctcttaacatataaaatgcctaaaacccactctaatgctggagaatctttaccagcattccacatggaagtcaagaacaagccagggttgcccgctattatttaccatttttttctggatgtactagccaatggaattagaagaaagttgtaagatgtataaaaattataaaggagcggaaaaccctatcattatttatagacataattataatacctgaaataactcctgacctcaaatgatctgcagacctcggcctcccaaagaaaagccaattttttaattttaattttaattttaatttttttgagacggagtttcgctcttattgcccaggctggagtgcaatggtgagatctcggcttagtgcaacctccacctcccaggttcaagagattctcctgcctcagtctcccaagtagctgggattacaggcacgtgccaccacgcccggctaactttgtggttttagcagagacagggtttcatcatgttggtcaggctggtctcgaactcctgacctcaagtgacccacccaaagtgctgggattaaaggcatgaaccaccagcccggctgctacctgacataattttttatccgaaaaccaacataatgaaatgagaagccactaaaaccagatagtctaatacagtggttaggtacaaaattaagataccttcaaaaattaatatagcttttatatgagcagacatctaattagaacacataattgataaagagtccatttataacagcaacaaataaaatgttaccaagggataccaaggttacttgaagaaacgtaatggatcatgtttaacaccacaaagatgtctaggttgatccattaacattaatacgattaatatgatcctaatacaaaatcatgaggttttcgggggaagtatccaaaaggattctaaggaggacaatgagcacctaccaaaaattgaactgggtaatgacttagcaattttacttctcagcttctaccttaaaacaccaataaaactgtggattttctatgagtatataaacaagtaagaaaagttgtttttttttttttttttttgagacagagtctggctctgttgcccaggctggagcactgtggtgtgatctcggctcactgcaacctctgcctcctggattcaagtgattctcctgcctcagcctcccaagtagctgcgattacaggtgcccgccaccacgacctgtattttttgtatttttagtagagacggggtttcacaacattgcccaggctggtctcgaactcctgacctcatgatctgcccccctcggcctcccaaagtgctgggattacaggtgtgagccaccgcacccggccaagaaaagcctttttaaaagtttaggactcacagaacctggtaaaggaattaattgtgggaactgctgagatagtatggttctgccactccctagatggagaaaccacttgattcccgtgtatttcggaattctcatgtctctaagatgggaatgatgcctaagtcaaaggttgttgaagttaaacgtgttaaagtagtacacagccgacttgcaattaaaattaaagtagtacatagccgacttgccgtcctctttggtttcaagtaatttttctttgtttttgagacagggtctggctgtcgcccaggctggagtgcagtggtgtgaacacggctcactgcaacctctacctcctggactgaagcgattctcctgcctcagcgaccctgagtagctaggactacagatgcgcgccactacatctagctattttattttgaattttagtagagacaaggtctcgctacgttgcccaggctgctctggaacttctgagctcaagtgatctgccctagtgggcttcccaaagtgctgagattatgggcgtgagccaccggggccaagcaactcacatttcataaggttgaaaatgaccacgagggtcaggggcgctggctcacacccgtagtcccggcactttgggagctaaggcgggaagaacacttgagcccaggagttccagaccagcctgggcaacacggccgaaacctcattcctacaaaaaatataaaaattagctggggatggtggcccacacctgtagtaccagctacgtgggaggctgaggtggatcagctgagcccgggagatgcaggttgcagcgagctgtgattgttaccactgcactccaatctgggcgacaaagcgagaccttgtctcaaaataaataagtaaataaataaataaataacactggtgaacatggaagagtgaaacaggaaaacaaacaaggaaatagaggccgggcgcagtggctcacacccgtaacaccagcactgtaatcccagcactttcggaggccgaggcgggcagatcacgaggtcaagagatggagaccttcctggtcaacatggtgaaaccccgtctctactaaaaatacaaaaattaactgggcttggtggcgcgcgcctgtaatccaagctattcgggaggctgaagcaggagaatcgcttgaacccaggaggcggaggttgcagtgagccgagatcacgctactgcactccagcctggcgacagagtgagacgtgagactctgtctcaaaaacaaaaaaaggaaataaaaataaacggaaaatttgtttttaaaaaacagcatgaaacattagacgtggaataatttaaaaatgcaaatgatctccctttatttgcaactcttaggacccagctcccgaaagaaaataagtaaaaagtttctgagcccttaaaatggcccttacaaacgcttagcattaaatgcaagcttacagacacatactcagcatcttgctgactttttaacatacctcttaaacaagtctgatccacgccgggcacaatggctctcgcctgtaatcccagcactttgggaggccgaggcaggcgggtcacctgaggtcaggagttcgagaccggcctgaccaacatggagaaaccctgtctctattaaaaacacaaaattagctgggcatggtggcgcatgcctgtaatccagctactcgggaggctgaggcaggagaattgcttgaacctgggaggcggaggttgcggtgagccgagatcgcgccattgcactccagcctgggcaacaagagcgaaactccgtctcaaaaaaaaaaaaaaaagaagaagaagtctgatgctattctttctcagggcatagcagattaccaataattaggagggagggactatcagaagcagatacggtgactgcagtgttaagtgatatcaagcagggagacaggtgcgatccggaaaaggttaagtggcattctctatctggcacgctgaaagttagggaggcaaatatgtcctagaaacacagattatctgtctttaagactccggggcccgtggtttatgcgtcggcgaacagccatatcaagtctctggccccgcggaaacggacggcggcagaggcgcggggcgacggagagggcgcccaggtgtggagcagggacgccgccgcggcgcgctcggtctctaagaaccgtcctccccctctcactgaaactgcgacagcgctacttcgtggggtaggctctgcgtaaaggatgctatactcaaccggattctcccactacctgctacaattcacaagaggccacctccgcagaaccattacctctggtttgtacaagaaccaaacaaaaagctcagaacgttatgcgggggcgaccccaatgagacccgccctcagcggtccctgcactccttcgggcccggtgcatcccggagccattcgagacaacacccacagccccgccactccccgtccgctgtccccgcgccggaggaggaggagggggctggcacccgccagacctggtgcgcctggaagaggcggcagctgcagcagcgtagcacccgagaacgctgaagcgacgccatccctgcttgtgcagtcgccaggcagccaagcgcgtgcgctctgcatttgtcccgccgcggccccgccccacgcacgcgctccgaaccctctagtcccctacgccgtctcgcatgcgcttatactcttcgctccggccgccgcggccccgcccctgcgcactgggatccctctagcctgccgcgcctctcgctggtcatctgcgcccctccgacctcggaaagagtcctgggtgcgggattcctggtagccgactcgtcgtctgaccagggccgtgcccgcatcttcctaaggcactggttscggccctggggagactggaattgagacgacagggcctccgctgaccagtccttggacacaacgcggagcggggctgaggggccgccctgccaggcctgcgctgccgtgcttttaggtagcagcgaacagttagcctttgaaccggagcccggggtggaatacggggagacggaggggctcaccacacccacgcttcccggagagggcggcggaggcgcgcggccgccgagcgcgaagccggtccccctgcagccccgggagcgtcccaggcccaccctacggagggtggaggcgcccccgcagcccgacgctcacgccgcaaccctgtgtggcttagggttgtaacctcgttggaaaataaaatacaaaaaatattaaaattacctcccaccgtacaaccctcggtgtctagggttgtaattttaattttttttccaacttttacacagtgactatcaccaaaaaagcgaggtgttttttttttgttttttgtttttggagacagtctcgctcagtcgcccaggctggagtgcagtggcgtgattctcctgcctcagcctctccagtagctgggattacggatgcccgccaccacgcccagctaatttttgtatttttagtagagacggtgtttctccatgttggccaggctggtctcgaactcctgacctcaggtgatccacccgcctcggcttcccaaagtactgggattacagacgtgagccactgcacccggccgacactcgcttttaacagcagaaaccatcccgttgaagaaaacacccaatcctgacaagggtgcagggagggctacccctctgacagggtgctgggagaacggtcaagtgcaaaaccgtggaaagcaacctggcaatactgctaccccaagaaaggaatcccttcacctaggtgatttattattcattccctagtgttccctgaagaatactaggaagaaatggaaatcagtgttctgaagaacggcacggactcttaggcagttccatcagcaagaacctgagtttgaagtgacaacgtgctgtggagaggcaaggttacagaattacagtacatcgtttgacttctgtgacaccggcattattttctggcgtgtgtgtgtgtgtgtgtggctaaggtcgtaggtaatgctaatttttaaatttttccaacttttgtacagtaagtagttagaaaaaaaaattgagagacaatatgccaatagacaatggtcagataacgaatgacaataaactgactgcagcctctgcagtaaccgggcagtcggctgcttgggaaggacgtggtcaggactgcttgctcctctattttttgtaccaccctccccatgtcagaaccaacccaagaaagcgctccccaaaccagtcacagaaaacatcctgcttcttgttagctcacctccagtttccaacagcctgcggtcagaaccacctggagccttccccgttttccaccccctgsgtccttgcsyctacccacacsggggatgttgctgactcccttgctgwagcaagctctgaatactgtttctcatttgggtggttttccttcatttctacgtttgagctactgtggctgagaacagaaagcatctgcaaaaaatgttttatgcttaatgaaaggagtagaataaaaatttcatatatgacatcagttaaactctgaaaaaaaatacagaataaacaccaaaatactgagtaatctgtagcactaggaaaaattgttctacttttctgtatatttttctccttttggcaatgaaccggtaatcctttaaaaattcatgtatatagttttttttcttggaaattataagaatgatttgatgagtggtttgatgcaacttatattacttggtaagcagttttaaaatattcatgtttacttataaaatttaaattttttatttgtattatctatatattatttaatgttactgttctggttgttaaacattttgagttatcttcccaggttgaatgatttatggattaaagtactattgtacattttcgtacattgtatcacgtgaataggccagattcctctttcctattctttggttaatttctttggtgtattcacaagcttatacttccatatattaaaaacatttatcttacctctgtaaagacaaaaaatgggaaataaaaagccatttatccaaattccaagttattcaaatctaattgaatataatcagtgtaagacttaaaattgccaaatatgtggggttattatatcttaattatattaaggccaacaatggtctttttggtataaatcatttgaaattattttatggtactttgtgtaaatactagaaaggaaattgaagccaggcatgctggttcatgcctgtagtcccagctactagggaggctggggcaggaggattacttcaggccaagagtttgaggctgccatgagctatggtcatgccacagcactccagtctgtctctaaaacaaacaaacaagcagaccgggcatggtggctcacgcctgtaatcccagcatgttgggaggccgaggcgggtggatcacgaggtcaggagtttgagaccagcctggccaatatggtgaaaccccatctctagtaaaaatagaaaaattagctgggcgtggtggtgcacgcctgtagtcccagctgcttgggaggctgaggcagaagaattgcttgaacccaggaggcagaggttgcagtgagctgagatcacgccactgcactccatgctgggcaacagagcaagacttggtctcaaaaaaaacaaaaaaacaaaaaaacaaagctacttaattaaaacaaaaacagcagccacagagatatacaatagtacctgagtttcaccttctgcagctttagttacccagagtcaacagccacctggaaaagagatgagtacagtacaagaagatattgtgagacagaccacatttacaactttcattacagtataaccgttacattttattattagttattgttgtcaatctcttaaggtgcctaattcataaacttaatcacaggtatgtatgcataggaaaaaacagtatgtataaggtttgttattatctgtggttttagacatccactgggggtctggttttagatatccactgtatcccctgtggataagggggtaactgctgtatcttttagtagaagcaagagcagccccatgtgggggctaacactggacactggtcagtttcagctcctcatgcaaagtgagggtatccttgtggctccagccctggggccccctgcggtcacctttggctccacagtctggttcttgaacccaagggcagacagcttgctacagcccaggcctgaggatgcacttccttcaccaggacccacaacccctgcccatgaagacctgtggagctcagggcatcccctgatgcaggttggtcaggacctgcccagcttgcaccagcaggttctgcgtctccatctgacctggcagaccttgcactcttccacccactgtggaggactaagtgtcttgaacttccagaacacagccagggccccatacttggcctggggagaagttgggaggcctaagcagtggttgggggccacagcaaggcattgcacacagtggtttttatttctttcagggatttattaaggcattgagcacagtgtaatttctagccaagtgaaatgaatccaaggaaatatatcaggacctgagggatgtttttttaaagttactggaaaggatgatgagctgagagcacgtgtacagccacgcctgtgcgcagcgcccactctgtgcaataaacatgttctgcccatgttcctcagtcaggaggttcaggctcccggagagcacctgagggttccatcactttggtgcccaacaagcacatgccccccaacctggtgccaagaggcaggaatgacccccataccacatagctgcaggaaagcatccacggatggagggactcagctggcctggccgcagtgtggagcacagaggtatgaggcaagcaagggcagatctgagagcctctaatgctaggcaggtgcagctggtgcgaggcgggctcccaccaggtgtaaggaaggtgggagccacagcctcttcctgggcccagaagcagccggcgccaggagatgcaggcccagggaatctgtctaaggcagctgggtctgcaccagccttctttccactcacaactcactgctcctgggagagcaggaggggcacacctttaaagagaaactgataagggaggaaaggcaggaggagatgaggccagccccactgatgacaccttgggccaggcctcacagctgcaggcatcagccggaaactccaggctgctcatggtcactggcggtgctgaactgtctctccactttcttttggtccttgatcttgagtccaatgtccactctcttctcaaagaagttcaccagcacggactccgtcaggatggaggccaggatctgctcaaaggagatgcaccagtcggtgtcgacggtgccgccgatgcgcgctgtggggctgcaggcctccccgcccaccagcaccgtgtcgtctgcaaggtcttcacattgcagggagcccgtgctgaccaccgagtaggaggacatggacatgtcgtctttggtttcatcgtcagacagcagctgggagggtgagccctgtccctcgccgctgcccccctccaccaccacctggctctcctgtggggcttttccgaggtgtgtgtctccgcctgctttggcttgggggtctcctgcagctgggggctgaagctccctggctgcgtcctgatgcagttcgggtgctggtggctcgtcctcctcagtggcacagtccctgggcttcctgcctgtgcgggctgagaacttcttccccacctctccgatgcggagcaggaggctggccacggtggcgatggcgtggtacaggtcctgctccatggggtcttcactgaacatgttgtaaagcgtcttgcacagctcaatgaactgctccttttagggagaaaaacagaagaacagggagatggtaaaagaccagtcagacggggtccatattagccaaactgatgacaagcaccagcctaaggatgttggctgccgtcttgctaatcatctccatgagcctcatcagtcccatctcacagatcaggacacaggctcagagaggccacacagctcttcaaaaggctttcccctccagctgcctttctcttggcactcagagcatgctggtctgacctggggcctccctgtttctaggtccgttctgttggcacagggagatggatttctaccacgactctaaatccagtcagtacaaggacttcgttgtgttttagaatcacctttggttttaatcagaagcagcctcaactcagcccttgaatgaagctctttagaaggtgatggtgaggaaaatacagcctgggtcagctggggagggggatcctggggaggggggtgctggggagggtgggtgctaggtcctgaagccacacgtctaggcctcctggcccaagaatgggaagaatcctcatcgcacgtggtgcccaccctccaggcctgctgggggagtggtcagattgcagggtcccctactgggcacagctagaccgtgggtctggcccgagggccatggtcaggctggtgctccagacttgcctttggctcaacgcttgcagtttggagctggggtctcccattttctggctttgagacccttggcaagacaccatgcttctgatctgcgagaccagtgaatgaagagcgggtgtggaggatgcatgtgagcctgcgtgtgcagagccctgggcagggctgggagggtgcagggtgtggaacgcatatcttgtcaaaggtagcctacaagcctctggctcctggttcacagacactcactcaatctggaaacatgcccctatacaaggccctggagcaactggcctcttgtctttctggaatcatcgctgactggcaaccaggactaacgggctctagaggcagggaggagccttcccacccaccaggagatgctgcagtgcaggtgcggtgatgttagggcccagtcttggtcagaactctccagaaatgtctactgtgggctccagtggagcctacctggttcatcttgggaagatccttaatcgtctccttctgagcctctttctccttggcccacattcgaaggtagtgccgatagtccggagagctggtccccttctcctctgcaggttaggaggaaagagattaatctttgtcatgtgagacggctgcgggctgacagcagggagaggaagagttgggtgttttctggcatggagttaccagggccctatcataaaacaccctggcgtttgggaaggtggtcatgggaaaaaaacccagaacagccacaggttttccctaaattgctgcagtggttggacctaagctgatgacaatgatccacaatgtcttctctcagatggggagtcacagggcagctggagagaagctggcaagagagggctggctgggtgcccgtggggctggtggagagcgtggagcctcctgtgcatcccgaggcctgctccctgatcgggggacgcatccgccatctcccggggtagggggctccctggcagtgactggggaaaagaccagcaagcaagggtgcctcaacgctggggtctctaagaacagcggcagagaatggcctgtacctcctctctcctcacttccacttccttcttgctcttcctgtggtagtgcttctggacaaacgcaaaaataaaaagaacatgaataacattctgctgttgggactgcaagctcctggggtccttgagatgtagtctgtgtttctgtacagccagccccaggccaggccctggggagcaggtctcccatgccacacctcctgcctggcccgcccagccccgccctatggcaccagagcaaaagggcctgagcattccctcacttggtcaggttaaaataaaggccgccaaaccctcaattccttttttcaaatgaatacaagtctcaacatgctggttttgacgtgaacaatgatgagggctatagaccagtctgaggactaacgaattctatagttcctgctagaactctggggaatgttcctgctagaactcaggggaaccctaatgaccccttccacccgcgcctgctgtgcctgttactgaggggtggtctgtgcacagctcctgtgcttggtgcagcgtttcggggaggacatttgccggaactggcgcgcactatactccctgcgtgggaacatgcacctggggagagaagcagccgaccagctctcctggagctgttccccaaaggcagtgtggctggtgggggcacctcaggcaggtcggcagcaccccagttctgagctgctctcgctggctgtctggtggcagtgaagggcacacctctctgggctcaggcaactcaccctggaatggaggccctgcttcctgggggccacatgcggtctgaggccagggctctgcaccaacatgccgctcccagaagcatgcgggacaagcctagagtggcctgctggttccatgtacaacagaaggtgtacctgcttctgtagtttctgtccttgaaatcaaggtcctcaagctcaagtcagcctctgccactgtcaccaggactgccatgggcatcttggtacacactatttttggttctcttttgagtcggttccttggtgtgcattatcccccatgtgaaaccaccaggtggcattatggtcggttttgcaagtgtgctgcatgtcaccagctcgactgcgaaagcccagggcctagcatgctcccatcacctgggatcagatgctcccaacaggctttaaacatagcacagggatgagttctaacaggcactcaacatgcgtgtttttccttaacaaaaaacgtgacgtggaacatgaagatttttcctaggaaagcatccactattctttccagcccccactcagccacactgtgtctttcacacgctccaatgacagcattttgtatttgtttcctactcacaggaagacagaatgtctctaacatgtggctgtggaggccttgccctgggcctgcttggcgcctagtgtgggggccttatttaccgcccacctacagcagacacggaggcg

SEQ ID NO: 10854 - DNA, 130030 bp, Homo sapiens
tcttggccctactgtaaacacttgaaaagtgaattaacatttatatattttaagttaaaatatatgtttaatatatatccacaggccaggcatggtggctcacacctgtaatcccagcacattgggaggccaaggtgggcagatcacttgaggtcaggagtttgagaccagccttgccaacatggtgaaaccccatctcaacttaaaaaatacaaaaattagctgggcgtggtggcacacccctgtagtcccggctacttgggaggctgaggcaggagaatcgcttgaaccctggaggcggaggttgcagtgagccgagattgggccactatattccagcctgggtgacagagtgagactccatctcaaaataaaattgtacacataaaattgtacgcgcgcacacacacacacacacacacacacacagatgatttttgtgacatcacattttgtcaacttttttgattaacctactaactgtcctgtaagaaagaaatattttcaaatacctccacttccaaacattagaactatggctggtgttgtaggtagagccatatgagtttctgttactgcaagagggtgaatcacagtatatttcttaaaggccgaaccatagaggatggattgtggttcccagtgtggtacacaaaagatagattgtggatgccagcatggtatgtggaggactaatcgtggctcacagagtagatttctttttattccacataatcaactctgttcttctttccagagcaacaggatgtggtagaaagaatcctagattctaatcagaaacagcctttctctatgtcagtgtgttcttggtaactaacctaacctcactgtgttcttgggaactaacctaaccttggcctagtttatttgaagttggcaatttcagtaatgtttttagatctaacatagccctcaatgaatattagttaaatggacctgaaaacactttggaaatcacaaaatattaaatcccatattttcatactgtgaatatattgtttgctcagttattgttacatctattttattatacaatgattagctataaatctgtgagctccatgagattccagatcttggctcattaatttttgtacagacacctgcacctagccaagtgtctaggttcttctcgtatatagaaggtattcagtagatacaatttatgtgaactaattagaaatcccctattttgaaccagacattttgatggtaaaacttattttgataggatataaaatattcgtatcattccagttttagatattgttatagaggtgtttttcttactttctcaaagtctactaaaaatatcaaagaagtcaaaaaagagggaaaatattgtcatctccaagaaagcaaggaagcctcacaactgcaatgatacaaattacgaagtccatatattaaatattgaaatagataatcaaacccactaagagatgttgactcagacattatcaataggtgcctttcccccaaaaatatttggtagtttttgattaaagagagcttagtttctgcgtgatacataagaaaagtagagaataaccatgtagaaatcccgcctgagactctagaatggtagggaagggaagcctcagagggactttctgccaacaacctcgttctattctctaccactttgtctttcagcccaggcagtctgtcaaagaaggtggaagaagtaggtggtacactgctgtagggaaacttgctgtgatccatgcaaactccttaaataaaacaaacaaacaaaaagaaacgagggaagaactactttcaatgttaagaaaataaaatatttggaaagaagatgtttgagttcgtaagctgaaatagtggctgccaacttcctcagtacatttccagctatccccttcctcttcccctccccattgtactacttggtcagttgctatctcattcaaagaggagtagcgatcagaaagggaacagtggataaactcatgcataaaactaccattttctgtttcacacatggagaggaaaacaagcaaataaatgacacaagtgtatatcacaacaaatacgtattctaaaaatagggttcagaaaggagacagatgaattcaaagaagagagtatacagcaataaaagcagtgaaaacagaacaagagttcagtaaaaaatgaaaatggaaatgaaaaaaatgacagaaataaaatagacactggaagcaacacaaatagaataaacttgattgaaaacaaagtcacaagcatagatactaggttggaaaaaaatctgacaaaatgaaatgtgtatgaacagtgtgaagtttttataatgaagaaagatacggaagacagggaaaagagagacaacatgtacgtaattggtgatcctaagaatagggaacagaaaaaaatgaatcaataaaaataaaaaataaaaagaagaaaattgttacaaagatttgaatcttcaaattgaagttcatactctgttctaggacaattttagatagaacaatgaatactgagagatactttaaactgtttcctgaactccaaggataaatattcaaccagatgaacatttatggaaaagataccagctacatgtaaggagaataaaggttggctttcaatttccacgtaatatgagaacccagagaagcaattactacacaattctgaaggaggggaagtatgactcaagttttattttcagtcaaatatagtatcaagagaaagacattctgaaacaaaacttagacaatatagaaccctggagctcttctttaaactcatgtgcatgcacatacatgatgagtcaacatcagtagctcaagaatggaggaactctgatttaagatggttagcatcaaatctatctatggataaaaaataacagctttagaaattagagaatagcatataaatggtataaactatgataatgaaagcatgttaatgaaaatgattaatatgtgacaaggtaatattggaagaggtatcagttaatttccctaactacatagcatggggttaatagctactacctaatgttgaaatagacagatgattctaacctcctaaagtttttccattttttacctcaactttggagtgcccttgtagaaaagaaaacatgttttgggtttaagaaacgtttacctgaatttcagtttttagttcaaattttctttagtcaaattaaaggaaaagaaaatataacatttaaatattaaaatgcatatataatttgatttcatttttttcaaaattaaggcttatgtatgtatacatctctctgaccatttttctaccttggtaaacatttagctatgtttggaatgatgtttacttggtggtagagatggctgttttttttctgataaatggaatttggatgacttaaagtgaaactttctgaaacttctctttattacttgaagtttttatataggacatatatcatctcaatgaaagaatagtcattcttttaaaaaattacagccttaccaccatctcttctttagaatttttttccattagctactaaagaaagtctttggcaaatacattataaattttggaattgaagtacaaaataaaagagatcataggaacagtatcttctccaatattttaatctaaaaactaattttgtctagaagaatatatttcaagaatgcatatgttacaaacaggcaccacctgggattcccagataaagatatttcttaagttatatagtccataatctcacaggttatacaattaggaagtatacagtagttaattaaagctgtaaatagaagccaagattcccttcaacaaaacagaatgacataaattacaatttttgtgtaaacctattaccactgctgcatcaattttataagggatctatgtaagtctactgtggttataaatttaagaaaatcacttgtacacctgtgaagcactaaagcatgcatggtgaagaatggtaggaaaagaaatactttttctagtgaaatgattagtgcacaatagtgatcgacttctacaatgaaccaaaatacaaactaatgttgattctttgctttaaggggaaaaaaggttattttttacactcccccttttgtctctgtccttcatcacttgtttttagagacaaattctctggagtgtttataaaacagcagtcctgggaaaccctgatttagtgggtttttagaccttggggctctggggtaccttttcacaccccaaatggcacactgggaaggctagatatcagagatcaatctacatccttgtgagagtgggcctgtatcttttctgtattcaccagtaatgactttaaaattcatgcaaatcagaagtgcacatttggaaaaaaacttccaggatattacatcagagtaactgtcaacctctttaaaggaaaattttgattatactgagctgctttacctgcctattaccttccttcaaattaattattcctcagatttaactgtatggtattaatacttttaatacttttgtatcaagaaaaggaagtaatctgtactcatagccatcaacaagtataactgtgcttttaggagtactgtgtttgccgaggtcatggtatagttcagtataaagtgttttaatgtgactttttgcacagcacgtgaatggactttgaaatagcattgcatgtctgagaattctgtctctttaaattgtctgctttgcttattggaaatgataacaatgattgtttgaagttattattaatttttttagttttaacaaatcctaataaaggaaaacatatctattaaaaactgaaataactactcactgaaataaacagcaaacattatagatatacaactttaattttgaatggtagagaattttattaaatgaagagaggcaacttaatagagtattaaggacagacaccagatgcatttgacagatctgaatttgagtcaggttcttacacccattagcatttttgactttagtcttttcacctaacttctctgagccttaatttctccatgtagaaaatgaaagatgatgtctttcctatctcatttaggattgctgtaatataataatatgtataacagtattgcttaaagaatattacctagtggccattgcagtgcataagaactggtaagatgccttacctggaaaatataagggaaaagtgttggtttttttaaaatcatgaaaagataagattgaaaatggcgtgtctttgctgctaattaatgattgctttatgttcatggagctgtaacatttttcccacctgcagaacatattatagtaagctctagttatattttctaggatcgcttttaataaaactttaacaaacactcgtgaattccaacaaaaatcttgatcattttacagaagtgtatatccaaaaccaccgtgaagctggaaatacatcaaagacgtgattacatttgtccaagttaagaggacaaccaatgagggcacaatggacagggttctttaggtatgttgggtataaattgtgataatttttatcttcgtagggttcctgaagacaagcaagtaggttttatgttttctaagatgaaaaagaacaatgatgctttttgaaataaagctttggagaaagtctgcagaataacaaaggttttcatcattctaaaatcataaaggcaaatatttataatttcctcacaattgtgagctataacaatttatattatatcaaataatttttaaatgaaaaatcaacctaaagggaaaaggggagaagatactatagagaggactgacctgtaggtgggcatctaggagatctggcaccgaggtggtggcatttctattttctctgggtttcagttctctacccatgaaatgaatgggttggactagatgatccctttcagctctgaaattccgtgaccttgtgacattcttcatactctgtgacataggaagtgcatcacacactgtagggttttccccttctgtcagtacagtgcactgcacagtggataagaatgtagactccagagccagagagagttgtgtttgacttgtatctacggagcttgtgatttttggcaagttaccataatttctttaagtttctgtttcctcatatattaaacctaaagataatgcctatagagttcttgaaatgacagaggaggtaatgttggtcaaaaccatggatgggtactcctggggctccatagtgggtttcaagggcaggtgtttatgaagccaggttctggggcctgatgatctgggactgaattccacctctgccacatgcaayctgtaggtccttgggcaaattacttcctcaagttctgcttccattttctcttctgtatgtatggttgatgataatacctacctcctagggttattatgaggattaaattagttcatacatataaagtgcttagaaaagtacctggtacatgtaagcactctatatatttgctatcgtcatcattatcatcatcattattaaagttrcacatagcctagggtgaaattctactaaaaattttagggaaaaaatactcatttatattatcaccaacatgtacatgttatggaatagaatgaaagtttccataaatattgacagtaaagttttaagtttaactccagaaagacaatgcagcactgtaaagcactttctggcttcctaattgcactctatgggtaaatttctgtttttttcactagcaattgtgtattctactgaatttgtaaccttctgaatagtttattattaaaaacagaacaggctagcttttttttttttttttttgagacagacttttgctctgccccaggctggagtgcagtggcacgatcttggctcactgcaacctccgtctgctgggttcaagcaattctcctgcctcagcctcccgagtagctgggactacagtcacataccaccacacccggctaatttatttatttattttttgtatttttagtagagacggggtttcaccgtgttagccaggatggtcttgaccccttgacttcgtgatccgtctgccttggcctcccaaagtgctgggattacaggcgtgagccaccgcgcctggcctatattgacatagttgacaaataatcttaatttcagtttaataatatgagattttatagatttatattgtagattctctattatattatagttgtctaagattcatggtaaatgtgtttttgaaaatgtcaattcaattgttaggtttagaagaaataatgttaaccataaaggagtataatttgacaaatatttaattagtatctacaaatatgtcaaactctgctgagaactgggcatacaaatatggatatgctcaaatcctttctgtggaggagttcagcatttggggtatggcaaacattgttggttggctgagtcgaaagctcttgctaacactcttctttcttgcmtggctatacaaaagcattggaaaattcctagcagctactgatatgtgagcagaaacttgctggaagtgatagtggtggtggcggtggtaaagatgcttctgttttcttattaaaagaggatgattgtagctagtgctccccccactcttcttcttgccttgagcacagatctaatacctacaggatagcagccatctggggactatgaggtgataagccaaaaataattggagagatattaggcatcattaagtcagcaatccaacattaggtgacactacttcctgactttttattttcaaaggtaaatgataaacccttttatattttaaaacatattttaaaacaattttaaaacattgttggattttctgttactgtatccaaagattattctaactaatgtgggaaggaggtatatttgcctacatacaattatgagacatgttagttgctataactataataataacttttctaaagaacaatatgtatttataaatgatatgtgtaatcttctgctttagtgcatatgcgtgtgtgtttatttttcttgtaatgccatagtactagttagagtatgataaataattctccaaaagcaagagtcacaatcttgaaggttctaaagagccctgactcagaaggaagagatatatagtaatggaaggacaagtttgaatccctaaagcctccaggacaggtagctgaagaagaatctatactagaatgacagggttcttgcttagatccaagtttcagaaccagagaatgccagagatgaagaggagtgaagaaggaagaagagacagtaygtacaaaccataacatagaaagtctctgatgcaaaaggatwtgtttttagccactcactccagatggagaggtgtgacctgggaaaargaaataagagatttggtgacagaggaatggagtaaaaaagtctagcaagagaaacaagagactgcaaactgctcctgttttttctctcaatctacaaccatcaaatagaaaggagactaaagagataataacacaacaaagagctgtataaaaaaatcacaagagaaatttcccaaaaaacattggaagattaggataaaaattacccattcgctcagggaaattatactagatatgatacggacaagcaaacaaacaaacaaacaaaaagcctgaaaaaatatctatgagaatcaaagtagaggttcaatgaaaaacagatgaaagaggttatgtatatcaggagagaaatgggagagaaacacgaaagctttcatagacaaaaatattagaagcaataacaacaagtggaataaatgtgactgaaaaccaagttagaaatatggagaaaagctttgaaaaaaatcccataawatttagttcaaatgcacaaaaacacaacatttattatgggaagatgaaagatgtggaaaagaaaaaaaagggatccaatataaatataatttgtattcttgaatattaaaatagtagaagataaattcctgaaataaagacttacatatgattttaatggcattctgtatcacggtaaggttaataaatattaaaaataatgaatacatgtatgtgtttattcagcatgaatatcaagtcacatggaagagagaaaaatgaggttagttttcccacaggtttattaaataccaaaatcctatagaattatgtgtaaaaattctgagtacaagaaagtatataccaaggttttatacccacccaagttatcttttaaatataaattcaaatgcacaaacattttcaagcccataagaagttacacaagatagtataaaccctcattaaggaaaattaaaacaagaaaacactgaaaaacaataaggtaaacaaagacttaaaaagattcttatgcactggggccttctgtcttattttgctgttttgaatcctgaggctaccacttgtgaatatgcctgagctagcctactggaggatgaaagactacatggagcagagatgtgctatcctagctggggcttctaaatccaacaagcttgtaagagccagacaaatgaatggggctatcctagaccatcaatccccttcaaaactggcagatgacttcagagatgagccagrccagccccgatgagaattgccttgctaactcacacaattatgaacaaatacattattgttcttataagtaaaaaaaaattgaatagccaccctgtaaaaacaaaacaaaacaaacaaaaaagctgtagtgaatttcagcctactaagaggtgaatcaagacaaacaattcaggtatggagggattccaactaaaaaactgaatataaatctttaatcaatgtaaattcagaacgaaaattaaaaaccatgagcactatggttattgaataaaatagaaactatgaatgaacaatgaaaaatataatatcaaattgatggaagttaggataaaacattaatacgttcatttcttcagcttttatagcaagtaatggtcccaactttttaaagcataagtttttcctgaactcatcaatattttattacacaatacattttggagtgttaagaaacatttatctctactgcaggataaagatgggcattaaaaaaaaacaagaaaaaagaaacatctcattttttagtaaattcattaatttcatttaaagttcttatactgtgattaattcaagtatagctatatttaatatggtacatatatttaatatagtgtgggtagcttgagtccattttaacaaaactgatcttcagttcctatccacattacctgttggcctttcttcctctgtagcttcctttgtatatatttttatcaaaatatctgaaataatggctattttgaggtgaatggtttttatgttatgtgtaacttttgagttacttgacaattttttgaactttttttttaaaaatactatttttattaatatattcagtatggaatagaacctttctactatacttatttgtaataaattatggattttaaaatggtgggwaatgttgagtggtctttgaaggctgtaacatttacagggaaacactggcaagggtttcagaaaaaagcctttaccttatgttttcaggttttcccttttactggatatcattttaagattttagattccaagtttgacctaattaaagtttcagtggcagttgaactgcctacagtgtgaaagtcctgcttgtcaaatattttatctcttattttagaaatgaaaaaaatcatgataagtatacatttaagggctattttatgttaaaaaaaaaaagtcagattgaagccaataaaaagttggtcaagggtaatttaaaaatcaagaaattattttaaagttagctactttaatttcaatatccaaatagtgggagaggaaaaagagccaatttgttaattccttggaaatacatggtgagtcacagtctaatttcagttcaatgtgttgatgctaaacaggaactgacacccaagaatttgaaggtaaaatctggtttaggagtcacagaggcataattgacaatgctcttgaacctacagtgaagaaccaataagcaatacataatttttaagactgtaagctgagtgtggtggctcacgcctgtaatcccagcactttgggaggctgagcagggtggatcatttgaggtcaggagttcaagaacagcctggccaacatggtgaaaccccatctgtactaaaaacacaaaaaaattagctggacgtggtggcacatgactgtaatcccagctacttgggaggcagaggtaggaggatgccttgaacccgggaagtagaggtgtcagtgagctgagattttgccactgcactccagcctgggcaacagagcgagactccatctcaaaagaaaaaaaaaatttaagactgtaattttgaggaaataaagagaacaaatrtatcaaacagaatttgaacattcaaagatatttattttaaatatttcaccattaaaatgtttacatcttatagtgtgctgatggcatcataattactcaagttttaaatgaatttaaatttttattacataatttgtaaactttataatacataattctgaatctcttaaataattgagacttctactttagcaggtagaggttgaagttataagagaatagaaaacatctgggggatttgtcccaggaaaaagctaagtttttggaaatagaagttgaataaactacaaagcaaatgaagataaaattactcttttcaagatgtagagtagtatatacatagcacagaaagagggagaaagagaaggggtggagggggatagattctagcttcgacttttgcaaagtttattagcaatttggtaagacagatactttaagaggcttaagcatacctctttatcacaccacttaatagttaagtggtgtgatgtagagaagagagtacagctttggaatcaggcagaagtaaacttaaatcctgactctgccacttcctgtctctgtgactttgtggcttcactttatgcaactcagcttccctgcaagaaacaggcacaggagttcttaccttgcaagatagttgcaaagttgtttgtaaagtacctggcactgtactgttcaacaggtggtagataattactgtaataatggaataatgagataagatgctgaataatttcaaaataaataatcaaaaaaatcatggagtaggttgggtgcgatggctcacgcttgtaatcccagcattttgggaggccaaggcaggcrggtcacctgagaacaggagtttgagaccagcctagccaacatggtgataccctgcctctactaaaaatagaaaaattagccaggcatagtggcatgcacctgtaatcccagttactcgggaggctgaggcaggagaatcacttgaacctgggaggcggaggttgcagtgagtcaaaatcataccattgcactccagcttgggcaacagctcaagactccgtctcaaaaaaaaaaaaaaaaaaaaaaaaaaaaaaaaaagatggagtaaaataaacaaaagcattacttttgcttttgcttgttacatttagagattaattgcgatttgagaccacatacctttttttccgattcatcagatatattcacctttgcctcctcttcccttatctattcctttcttcagcaataacactgggaagtcactagtctacaaagctccctcccatataaaacctatggcctatgtgatcacaggcacaatgaacaggtgaagaaagaaataattttgaattaggaaatacaatgaaggaaatgaactaggaattgagatagagaatgtctgcttgggggaagtgatttagataaagtgtatttagatcaggtgttttctcccttcaattatgcctcttccacattgatgaggaggttggtaaagatgtgaaaattagtaaggggcagagttttaattaaaggtcatcattttctattgaacagcaccattgtctggctttggaaatcattttctttaaatggaataaataaaagcagtaaaatgtcaagaaaccactttttaatttattatccaggtaaaaaagcatttctctccattggaaaaaaaataatccataggaaaaggagcttgtaggaaaaacaccaatcccacattgtgtactatttcctgtttttgtgattatctctatgaaactaccttgagggtttggcgagtaaatagtaacaaattcagtcttactaattttgtccttttctttgggggtaatacagcctaacaacaaaatctgttcttaaaatactgcgttctactagagttatttcccttttggctggaggaagtggtggctttgtcagactgaacatacatagttgtatatgtttaaacaaagcatcagaaacaagaaacttgcagagttccccaaaccaggaaatattttataaagataatgaatagcaaataattgacatgatataagttaaaaaggcatttatcagtgagtatactagtcttttgaaagcagtatttgttagactaaggatttcaactacttgccaatgccatcagttatcttgacttattgtaggattagttctgtagtcctctattagaacggatcaaggttacaggcaataatgatggtttccactgaaaaaaaaagccacaaatatcttgtgtttcaaaatttctgtgatcagcattttttgagggaagaagcattatgggaagaaaaagctaacagagatgaagtatcagacaccatgccatggggctgtccttacatgtgtcatcattttaacagggaagcaagatacatttctctccttttctcatcctcatcattaccatttaattttttgattcacatgaatattgataggtggcttgtggcttttgtccatgttttgactttctttaaagacaggaagaaattttataaagagtcagacttttaaagcaaaaatctttctctgaaacttttttgtagaaatcaaaattcaggccttcttctcaattcaatgaccctgttaattaagtatttgtcactactcaaatacatggctgatacacagccatggctccacagccagatcttggcaggtggctttttttttttaacatcaaaatgcaggtaagttatttatgttaggtgagaaaactggtttgattcaatgtccacaaatattacctccactcaatatttgtaattgttgcttcagaatataagtcctttgagtacagaaattccagacctgatatagaacttactcatgcaataagaaacatgtgcaaggtatagtctcacagtttattctcttccgttttatgctgcactttggctgatgcattgcaaatgtatgttaaaatcaaccaccctctgctagagacaacacatgaatctattaacaaaattaacctctcaatttgtattgatttctccagttaactggccagaatctaactagtctctagaggaataggacctgggcagtcaaattctgcatgaagacagggacacccaaatatttgccactagttttatgttaataagactcacttgaaaaagtaatatgaaataggtttcatggttaagtaagttttgcaattgcgtgagttaaatgtagataaaatatttctttacttcaggacttataagagccttcagtatatgaatagattaggagaatcctaaggattgggaatatagtatgcaaagtttcccaaaagtattcgatcttggaacctctccgcactctgatttttttgagcaatatcccctaagactgaaatacttggaacatactatgggaaatattggtgtagggcttgaagactttgtacagtatgtgaagctctttttatgccaggaatagttcaagattactcagtattagggttaaagcagaagacaccaaagaaaggagattggccaaaatggtcaggaagtcatggacattaatttcgtttattccccaatattattagtcataagcataggcactgtgcctgaataattggggcagtctgattcagcaggcatcctggtarggaatgaagtcactgtggcgggatgcatagattatttcaatggaaaggggcattgtaattatgtttgagtgttgtagctaaaagactgcatatgtttgttagtggcctatgaacataaccatggcattataaatagtatcataattaccgtgaaagcaatactgcatctgatkaatgtattttattcggcagccacaagtcttacgaagagtatattttaggtaatgaaaacttgagccttggtatgtttagaataataatgatactaagtttttatcctttcctagtctagtttattaaaaaattgttttttatttatatgaagacattcataatcaaatacatgctaaataaaacctaattgtgtttatttaacccagcaattatatatgaaatatggccagtgactctggaattaaaaaaaaaattctgcttggtaacttagtactatattagcctgatttttggaaacaagttttataaacaagtaggcatcctgaaatacatggcccagtacccagctagccattagagccattaaacacagctctgagataatttacctgtgttcattgtgtcaaaggagtaatttagactgtcataaataaacattttcaaaggaattttttttctttttgttttctgctcctcaaccataaataccagttaaattaaagtagctcttatctatggcttggatttagattcaaccttgtagaaagcattacttttcctatcattaaaaattaaaacatttctcacttttacagaaagcctttcaatatgtatagaatgtaaacaatgatcctagatgacttgcactgctctgagaawtagtagttatttgaagttatttgtccactgagggctttggcaaaggcgagggcagtttgatatataagtagaatattatagataagaaataattacttattgttttgaaaaagcttcccattcgactctgtttaagagaatatgaggaaaattcaaaaaggggaaattagtgaattgaatccatttcaagtcagagagcttagagatcattgaatccaacgatctcatttttttaggtgaagaaactgagctcctaaaagttaataaagcttgagtatggtcagtcaaccagacggtgacctcctcggaacctaggtcttcggactctaagactcatacccatttctgcactctctgcttcctcaatgtctatttcccagccatggtgaagccctgactgaaagagaaatgcctggttgtagcaaatgtgttttaggaatgagcaagctccttggtaatgatgacaaggctaaacagaaagaaaaggaagagatacagtcagtagaaactggtgggtttcttttcctatagcacccttttttattacatgctttgagatagtgtgagtgtgccttttgtgtccttgatgtgtgcctgacaagatgtatgtaaatcacagttttgtaaattgcattatgaatacaattaggatccactaaagttgtcttgtggtaactttctttataaaattattctttttgagtattaaagactaaatttatctgttggtaattctacatagtaatgatatattataaggttttttaaaataattagaaagttttacttcaagctggtgaaaaattctatattcctctaaattttccacctgtctgtgccccccattcccatttccccatccttctgtcccccacccctgtcttcagctcctacttcacctttttggttttaggtaaatttccatgagtacctagcattctagaagtgaactcacagcccagattttatgattttattattagtttatttaatttttttytctttttttttcttttttttttttttagacagagtctcactctgtcgtcaggctggagtgcagtggctccatctcggctcactgcaacctccgagtccctggttcaagcgattctcctgcctcaccctcccgagtagctgggattacaggcacacaccaccacccctagctaatttttgtatttttagtagagacagggtttcatcatgttggccaggatggtctcgatctcctgacctcatgatccacccacctcggcctcccaaagtgctgggattacaggcatgagccactgcacctggcctatttaatttttatcgtcctttcttggactattccttcctattttctctctctactttcacattttattttttaaactcaacagaagagtttgaaagctgctgagtcagcccttggtcactttccagcctgttgttcatgagtaattgactttggctagacataccaaaattaaattctcagattgccttagcttttacagaattgcactggcattcttctctactcttcataatgcgctccccatagaattttattgtaattgtcaggtgtggggtgagggaggacttgtatttatactaattgactttacatcaagatttcttctattgaattcatatatctaattcagtttaattgaatgtaaagactcctgtaataggaggcagcagatctgactcctgtttcctgggtaaattatataagttcatggtttctttatagatacagaggttggaggaggtgattggtgtaatttttagcttgttgtaattttgtgattactgaactggccttaagcccaattaagtggaagaccttgtgtaagtaggtgttgtctctcatagaactaactaggtagcagtcaacatcatcacaataagtagatcggtttcatttctcctgcatttaaccttcttgtgccaattcgccatcaactttcgtcatcagctgtcttgtctattgggtcagcaagagtaagggcagccttttcttacctcaatcactcaccaattatttatgtaagaggagtttagaaatctattccaaatggttttacttctgcagcacttagtaatttatctaaagattcttgtaaatgtttctcttgagctcatatagcaatcttaaaagctgtcttcaggaaaccagatctagtcatctggaaggccctatatttttacaatagagccttccagagttgttagaaatatggagaaaatgctatcatgatcatttccatgtatactaaagyttcagtagttttaattgtgaaaaacagctatcccataaattgaagtgttagtaagacaaatggatgcattgtattaaagctgacagagcagtgactgggaaaatctagtcactgatctaaagccaacacaacaaatcagatgaccttcaatgacttttaattacaatttctgaatacattgctgttattaggaaaacattttaggaaaataagactagaattagtatacaaatcagaaaaattgatggtcaagtaatctgtcagtgatataaaattcaactaagataaattgataaaatacagtaaaattgccaattgttttttgcttaaagacttatgaaatgtacattattcatttctactttctatctaagttaaggcctatttcatcccaaactaaccctgatctagtttatgtttccggaagcaccatttataggttggcatttaataggatttcttttgtgacctaaaagggatgcatgctgtctgatcacctctatagttagaaaagagagacaatagtgattgaagctagaagaatggattttatggcataatcatgttctgatccatacaagatgacaacagcccagttttctgtgtaatacaaattgatgatcttaatttaattattagatgcttacctatccttgattatatatttttttcaggaatcccaagttttttcttgaaaatgttaggcagaaggcccatgataatttcagattccagtgtcgatttagcaatgcctatttttaattaattgatttacatttttattcagtcacaggtcttttaactgataccttttaatgcataaaatcatgtttaaattcttgaaataactgaagtcttaatgaaatatttgagtgcaaaccrtcaattgaaaatgataaataaaagtagtacaaatatctttaattttgaaatatgagggttttctgtgtttctatrgtgttccaattttattaacttttgccctgtcttccgttttctttataactaaaatagtaataaatacatttctaatttaattgtcttatatgcacagaagttctgagtgatactgaatttttggtgttgattgagatttgctttatgtatatgttcagttttaaagcttattatrtatttaagtgaatgtgtgttctctaattgtagggtccatggttttacatatagccattggaacaaacttcttagttgcrttatttgtatctcctacaatccactaatgccttctgctgcctgatgtatcagttataagaaaagtgcattgaaatctcccattattgttgatctgtgacaattgctctttctaatctcaattttactttgtatattctggacaatgttattwctcacatatgagtttggaattactatattttttgctgattccttctttattgttccrtagaaacttctttatttccaatgtgccttttttgcctctctacaagtgtctcactttcttctgttcattgtcattcttcatctttttattttcaacttttctgtgtcattgtattttatttgtgtgtcttgcaaaaagcataaaaatataatttgcaatatctgtcctttacttgcaaatttagtccctttgtatttattgggttattgatatattttgatttatgtctacattttattttgtgctatgcttttacattaactatgcttcttgtgctttaaaaaatattgttctatcttctattttgaattttattcctgcaactagtactaaaacaacagtgtatgctaagtaaacatagagtaaggaggcacttatttctgcttatagaaaaagaattgtagcactggagtatatgggaaggtagatgagacataaatctggtgagatatgcaaaggctgtgctaaaaygccgtgttaggaatttggtttgcatcttatttatgtaggggaatggcatcagccatctcattttagaaatataattacaattgttgtagaagaatgagctggaatgggggagaaatgaggggatgaaactgagcctggtgggcagggaggccagttagaaaaatcactgcaataatccaagtgatgaatgatgaagcagtggtagtgaacttgaagaggaacaaatagatttgcaatatattcaggaggaagagtcaataggtcttaatcaccaattaggagtgtggggatggagtggaatggatgactgtaggcttctggcttgggtgattttgtggatagttgagccactaattaagaagagaataggaaatagcaacaaatttgaggacttcctctgcctggggaacaattctcttatagattgttatgacggaataaggtataagattatttaatgaggtatttagatgacaaacttgcttgggaagaaatgtgatagaacagagagatggtgtcctaataatgaggggaagaacatccagaaccctgaatttaggaaaacagtgtataggagtatttagttacatgaatacatattaagagatttactaaatagcagggatctaaaagttttaccagagcttatgaacagacaagaatttggtttaaactgttctagatatgcctttgaaatgttattgttttatcagttgttagattaaatcatgcttaaagtgctagttttaaaatgaaatctgattaaaacaatttaacacaggtaaattaatttttacaaacaagaaagaatttgtggtcatttggtaataagtatttcctgctcagattgtatcagtcacattcatttttataagagattgtatcagtcacattcatttttataagacctctgcctatgaataggatatgtgagtcacaactatggaaaattaggcctctgaaatgctgaaataatacaaagggttgttttgccaaaygcttgacactaagcaaagacgaaaaagctgtttgatgtgcagatcatcttctgctcttattcttgccatcacatctaaaagttttgggaactgtttgactctctgttagtattaatataaacagatctataactgctatccaggcagctaaatgtctgtcttattcttgattatcttttgcatttaatccaagataaaatattaaacctcttgatttaatgtcacaaaccagtagtactcacaaagctgaattacagactgtcaacaggtggataattgctgaacatttacagatgttagttcacatggaattgtttagaattactgtgtttaacagtgtaattgtagagcaaaatttcaaatgctactttagataatatttttgcacatacccttagaaattttttttccaataagttgagcaagcagaaaactgcataggcgctaattaactcaaataaacacataagtgattgacacaaacatgctttttttttttttttttttttttgtagagacggagtctcactctctcacccaggctgaatgcagtggtgcgatcttgacccactgcaacctctacctgctgggttcaagcaattctcctgcctcagcctcctgagtagctgggactacaggcacgcgccaccacgcccggctagtttcttgtgtattttagtagaaacagggtttcaccatattgcccagcctggtctcaaactcctgagcccaggcaatctgcccgtctcggcctcccaaagtgctaggattacaggcgtgagccattgcacccagcccaaacatgcattattaaacaagcttatctttgagatatattaatggcactcttgctctttttactttgttgcacagctactaagttagatagataattgctttgattcaagatgcgttaaaatttttaatgcatttgttaacatctctaattatataatatcagtctccttgaaaccattaaacttcatttatcaacagagctttgagacctacttgtgcaatgaagtagcttaggcaatagagagtaagatgaaccacagttcagtcctaagtagttttcagtttagtaggataatattacaaaatatgtaaataagtaggtaaaataaagcgtactaaaataatttacaagtgattgtgtaggatataatagtaaggtaatgtgaaaataatttatgtttataggatacaataatgtaataaaccactgaatacaatgtctaatgcaatatcagtactccataaatattagttcttattagatttatgaaacaaagatggaagtgtataatttcctctgtggatttcaggaaggtttgtagaggcagtaatgcttgtattagaccttaagaatgagtagaaattcatcaggttaaaggcaagtaggggagaagatttgaagatcttttaagcagaaggagcagtgtaagcaaagctacaaattagtgagactgagtctgagtcttagttgtctggcatggataggtagcagatgaggaaagaacctgaacttaataaaaaaatatagagatgtagacaagagccagggaataatgttaaggatttgtaatttatcctgcaagaatattggtaacctttgaaaggtattaaacaggtaggtatgggtaactttatctgcttcgtgttttaaaaagatcacttggtgaatgtttggagaatggattaaaagaggtacatctagaagcagggggtcctgctagctsactgctaccatgggccatgtaagagatgatgaggacttgaaccaaggctatggcagtgggtatgaagaaaaggaaaaagatgagatcctgtgtaattcccaggacttggtaaccaatttgatatgagaagtaacagagaggaaaaagtgtcttcagtgacacccaaggttctgtcatagaggcctgggtggatggtggttctattcacggagagagaaatacaaaaggaggagagtatggaaatcatgggttatgtttgagattatggartgtgcattatttctgtgacattcaagcaatgacacctcagaggaattggaaacatgggtctgttgctcaastgacacatcttgggctagagatctagatttaggagtatttagcatatacttggaatgagaaggcatgaactctgggaaataccaggacagaagtagcaggaagatagaccttgtggagagttccatcttggcagtgtgttgtggtattagctgagcccatgttttccacttgttgcatttggrtttcctagttttacatttcatattgtaacatttggcagattttaaataacttgtacaatgtatrgaaattctcaaaggactgatgttttgtaaaacttcttcacaataattattagatatacaaagccctgcagctgtattctataaatagtattgaatgtagtgaaatagtcatcaagctattccttatcttaatcataacttgaaatgttgaaaattctgtttggtggtaagtcatgattttgtcagcaattttcacagtgtcagatctgcccttgttgagagtaaagaattgaaataatgaactttaggtatccttggtacttaatgctatttttgtatcatttgctattgtaatattacttcaactgcttttttcctactttagaagttcagcatgatgcaaaactaggaattgcagatatttggtaattgagggatgaaataggaatgttcttgtgcttttaaagagactcacactgagcttcattccatttattaagtgagctaatttgttccacactgtacctaatgtagaagcaaatttcgaagttattagctaaaggtgtgattagcaaaggccaggcaaacccatttttaactacgttaaatgtccgtataaagcttggagagcattttcctttcttccttctttcttttcatcttttccttttaaccactggagtacctgggtagttgctcctttacattacttactggtttttatacgagggaccttctataagaatatagtgatggcaactcacttactacatgaatgctacttatttctaggagcttaacttggttaagatagtttgacctggcatgattaatatttacaaatggaaaattaaatcttttacttcagtttttattcagtctgttcaccaagttacattgtcctgctatatctggcagtgtacttggtgctatcagaagacaaaaagttaaaacatttgcccaaagagcttagtctaaatgttgggagaaacaagacaaaaatttgtctaagaataaatcggataagaagaaattataaagcttagacgaaggacataaaagaagacctaaccaaatttgcaaaacaaaatatatttattagaataacaaaggtcataaatattttaattttctccacataatccgaaatacaggctcaatgaaagatggaggttttatctgtttttttttttttttcatttatgtatcattagtgcaagagcatagtaggtactcaataaacatttgttgaagaatgttatctgaaagttcactcaaaaatcacattataaaatttggatggaaccagacaagttaattctaaaatttatagattcatagttggaaggaaaagggtccaaaatggtgttgaagaagcctaatgagatgataaggcttgtcctgccagaatgcaatagattgttatttccaaagatgatcacaacactattttccttcccaggtactttttagcaaagtgacattgccactcccccatcaagaggtgcagtctactttaccttcttttaatcaacttgtaggaatagaataaggcagaggtggctttgagtgatgtctgaggctagactttaagacatctgcaatttctgcctttgctttttgtaatatttcttcttggatcccacctatcatgctttccaaagctcaaatagccacatagagatacccacatggagaaaaacaaaggctttagttgaaaaccccagctgagctcccatttgtcagctagcactgtggtagtcaaccatgcgaatgaggctattttggacctcatgatygtccagtgcctgggctgataccatgggaaacggaattttgtggctgcccacaaaatcatggaaaataatgattttttagaaaacctccactgttttgttttgcagcaataaataactgaaacaccaatccaaaaaacttataaagctataacaattaaaacagtataataatagtaccgggatacaaaaatggtcaaattgaagaggatacaaagcctcaaagcagtcctcactcataaaagccttgttgtatcactaaaaaggcattaaaattgagaagaaggaagaactagtggattaattaataaatgagaagtatccataaggaaaaattaaaattagattcttgcttcacattatgaaaaaatacaaacaacagattgattaaagacttaaatgtgatcaacaaaatgttaaaactgtgataagaacatttaagaaaatagttctataaccctgggataaaacattttcatccaaggcattaagtgttaaatgaaaagactgatacatttattcattagaatttaaatttctgttgccattaaaaaaaaagtaaaggacaagccacaaactggaagaacatatttgtaatgcataaaactagaactgacaaagaattttttattcagataatactaagaactcctaggaacaagaagaaggagaaagaggagtggaggaggaggaggaggaagaataataggaaaaggagaaggagggagaagctcaaagaaacaacaaataggcaaaggatataaacagttgatttacagaagtgcaaaaccaaaggacaaataaacatgtaaaaagatgtttagcttcaccagtgattagggaaataaaaattaaatcaataataaaattgcatctcacagccattagatgataaaaattaaagcatgacaatacatatgtctgggaggtagagaaactgraactttcattcactgctggctggaatgtaaattgatattagttctttggagagcaatttggcaacatctgataaggctgaggaagtccatatcctaattgttgacgttcacaaagagacatacaaggatgtttgctgcagagtgactggatcaaatcaaccctgggatttatacggtgaaagaagacccaagacagaacactgaaaggggaggtatgaaggttaatggccaacaggagtggtgaatagatggccttcttttctagaatgagatttctttggtataaaataatcataactgattaaatgaaagtatttgatattattctggcatatatacagaagagactagaaaactagaaaatatcmtacatgtgatatactttatgaagtttaaacagcacagagttctggcaaatgttactaatgatgaataaaatattttgttttctggtgcatgcctctaatcccagctactcaggaggctgaggcgggagaatcacttgaacccaggaggcgaaggttgcagtgagccaagatcacgccattgcactccagcctgggcaacaagagcgaaactccatctcaaaaactaaataaataaataaatttgttttcactgagtctacaaaatgttttatttgttagtgtactttataatgtttaaatatacccttttaaattacttcaaaaatcaaaataaatagagataaaacatgatggtgttacctgtgatttagtgttgatataattttctgagtaggctatttatgttgataaaatatcctttaattttaaaaaggattatcttaaatattatttcagaaaagcaaactaattcctggacattggcacttagaaatatatgtcttgataagtaatgtgcagatcatttaaataacttccctcaaattatactaatttgaaatatgaaaatttagaaaacctggcatagtgacatttttacttccctgaatgtttgaaaagttggaaaaactccaaagtgctgctcatttacaaaacccctatgttgtgtgcttttagaacatctgttcttcaaggtcagaggttattttctgaaggttcttctgcagcgtgtcttgtaagacttgtaccactagcaaatacatttccatcattagcagatatttgtttcacyaaaatgttcaatacatgccatcatgattactcaaaaactgttaaatgttcataggaataatgatgctttgtttgcctcaccattcaaaacaaattaactagagttctacttggtctactgaaattgacatgctaaagatgcccatgatactagtgaaattttacttccttgaataggatatctgtattggtaaaggacagattttggttacataattcaatttatgaacattatcaagtagtgagacataaaattccagattatctacatgaatctcaacaggttcaatgttaactttgctataaacatccattatccacatggtgtagagaaaaggacactkatctggtccacactggctcctaacttgctgagtcatcttgagcaacatttgacctctttatttctcagttaccttgaatgctaaatgtgggtattagactagaactagatgatttctagttttttccataattctctaggcatccatgtacaaaaaaatctaaataggttccgtctgcaaacatccctggaataatatggtgattagaaattccatatgcaaaatatgttcaataatgggtgggttgaacctctgtgcatctttcttatttaaatggaaacaaggatgtggttaattcagcatagaggagaagaactgtggtagcttcaaaggatagtactacagtttcagagtcccttcacctggccacagcactacagtgttgagtggctgctgtggatattgggagacaatgggacacattggccccacctcattacttttgccatggaagagaacctgacttggttcatgaagcagattcaactgagcaagagaaggaatctcataacagcttaatgwtgtctactgacaagcttgagtataaactcttaaagaaaatgaagacttctccaacccatctcatagtgagatgagcttctcatctgttttatgcaaggattattattgcatttctcttcgtataatatatatgtgcctgaaaatgtgtgtataaactaagatattgaggtggctatcttaattttttaatgaagttcaacaaatatttcttgaacactaaatgccaggaactgtggtaagtcctattgccgctaaataatcatagagtaacttctgttctttgagatctactctagtggataataaaagcactcaagtctgtttcctggatgagctcagaccagcagccaagtatgataatcctctgtgccatgaaaatgaattttctgaggaaattcactcaaaaacccatctagaggtaaattcttttaaaatttaaataagtagtcttattatrtaaagactgttacgttaggtaagctattcactcatatatagaaaaagttctttcagtatgtatatatatacacatctctttacccactccttttgtttgttagctaacatggatatttgagttcatacatgtatcaggctaatcccacatgaccaaacatatataacaatcaaaccatagtgtggcatctgcagcactcattttattccacaatgaaataaaaatgaattcagctattaaagtagtctaattctgttatacctacaaatataatcaagaagcaagattttggaacaatatttttcaataaattttcctctgccacaatgcttgtttctgtggacttttagggaataagttgacatatattaaatatgtgagaactttatgctgtattctaaaataacagttgattaattaaagagttaaatattgacccctaggagggccctctgctacagtcaattggagaaagaagaggaataagggcttggcattaccttcaaaaagattttactccaagtcggattcttcatttcttgctgctagacaagagccatcaaagtaaaacagatacaatttccaggaaatacaggaaataaaaaaacactttttcttgctatgagaggtaacgagactgataaaagagaggtagaaaagggattttttttttttaagtgagaggaaacatcgaggaccaaagcccaggaagcacccggatgtgtaaggaaatgaagaggaagatgatccttcagtgagtagtggagcaaataggggaacccggtgtatttaagtgtgtgtgtgtagggtggagagaaacagggaggagggcagagtttcaggaaagaggtttataatgatctattgattatattattattaggaaatgagaataagtaggaaaaaaattgcacctgtctcctttcttcttagctgtggtctcattttagttcctagtattsagaggtgacctaatcagactgcagaatgttctgaaaggttttaaacatgaactgttggttttggcaatcagaagcactgacataacatagtgtatcaaacaaaaatatcagcttcttcacaatactatataaaataatgcatgcaggtctaaaaatagatttaaattcagaataaaattgtcaaagtgactgccaaataaaaacacacaatacacagaagttggagcttttccactcagtaagaatgactgagtttgtggaatgtcagtaaaagatgtatactttaactttagatgagtatttgtgtaatagctagaaaatcattgtattggcttaaatgttgctttgatgaatttctaccaaaatcataatctctgttaaattagtaaattccaaatgagctaaattcaaacaaacagaaaacttgaatataatcctgtgaatataatcctacctcaatgatcctgtgaggtagtattattttggggatcatttttaaatcaatgaagatacttgagtttgaagattaggaaacctgatccaagtttatgatgccagcaagttacaaaggaattggaaatttgagcttagtttctgtcttcaaagcctgtgttccttcatgatactatacagtctctgccatcctaaagaataataaattattgacaaaaagactaaattatattaaataaagttttgatactaaagcatatgattatattctaattccttataatttggtaacccacatttgttatgatagaaatgtttttaaaagaccatttgaaaaattgaaaacctgattttttaaaaccctctgcataaaaaggagttcctttaattcattgtaaactaacttaaattgtaaagccactgattaaatcttaaatctggatcaaaatccatctttgcaaaatttatccaaatttagttatcatgagctaaattcacagaaatgaagtagttcataatttttattttgccagcatcttaccttatgtttatattctatgtttaaagtgtaatggtaagtctttgaatggaaaaatggtgttccaaagttaactatacaaagcttaaggacaagacatttcctcaatgattcttgggaatgagacagtagtaactggatgaattttcatggcaatgaggtaaataacaactggatgagcctctctttttcagagttaactggaaaataaattaaacaaacaaataacaaagtctttctgggcatctcggattgctaagaccccaagcctcagcattttttgactcctttctgattcttcagccctacattctatcatcaagaaatcatttcacctctaccttcaaatataagtccacagactatgatcacttcttccatctctcatctgaatcaatgtgatactcttataactgtctctctaattctgccttgctcccctgttacaatgtcaatcaggtcatgtcatgtgccactttgtggccaccygtttcattcagagaaaaagttaagtccttacaacatattctgcttccctctcccttagtcctgccctgtgtccgtgtttcaaaacctacgcacgtggctctagacaactttgcctgcttgctgtcctctaaaatgctaaaaggacttcacgtcgggacttttgcacttgctattctttctctccagaaaatcttgtatatctgcttggtttcttcttcttgcttctttcagatcttggctcatgtatcagcttattagtgaggcccattctgacgatgtgaccttgactccttattcaaatataaacttcatgaagacagtgatttttggctatttggtgcacttctgtattcacagtgtctagtgtaatcccatagtaggtgttcaataaacatctgttaaattaatagattaattgatggagaaatgattgactatcatatgtgttatttaactgccatgttaactgcagataggtagtatgatctctgttttgctagatatgataaatcaacctgattagcctgatagccatggagttgtaaaagttgacttacaaggtatagttgactatagttgattcattctaaaattcttgtcaggtaaaatgaggtatcattttgtatcattctcctataaactacagagtatttcctcatgaatgattagttttttcaatgtattgtttttaatcacagaggtcttgctactttattttattttagtttagttyagyragatggagtcttgctctgtcgctgaggctggagtgcagtggtgaaatcttggcttattgcaacctctgcctactgggttcaagcgattctcctgtctcagcctccagagtagctgggactataggcatgtgccaccatgcctggctaatttttgtatttttagtagagatggggtttcaccatgttgcccaggctgtctggaactcgtggcctcaagtgaactgcctgcctcggcctctcaaagccttgggattacaggtacgagccaccatgcccagcagtcttgctattttaattaatctggcaagtaattatatctaaagtatacaggcactggtttaatctctgggacatactgattaaccagacaggcaaatctggaatttatagttagttaaacagatgcacaaactaaaaagaaaatatcaaaattgtaagtacaatgcaaataattaaaagaaggaatgtgaggccaggcatggtggctcacgcctrtaatcccagcacttttggaggccaaggccagaggatcatgaggtcaggagatcgagaccatcctggccaacatggtgaaaccctgtctctactaaaaatacaaaaattagctgggtgtggtggcgagcacctgtaatcccagttacttgggaggctgaggcatgagaatcgcttgaacccaggaggtgaagattgcagtgacctgagatcatggtactgcacyccagcatggtgatagagtgagactctgtctcaaaaaacaaacaaacaaacaaataaacaaacagaaagaatgtggtaggaagtgactaggggcaatgggattgggttcttgatgatcatttccacctgcccttcctggtctctttgcccttctccattctgctttccactccagaagaccaaactttatggactctgtcgttggtctgccttacttctggcctctggttgtgtttgaccaatgggaaccatctgcagaagatttgagaactaggggaggaggagggctgggtatactttcccctggatcctccctgccagctccccactgattggcagtgtttttctttacctaaggccaggttcctgttgggcacccttcccctatattttcatgttctgagctgtaggaactgtttcttcctttattctctcacccttggtaaccactcctccctggctcttgtagtacagaattctgcattatatgtgctatcatattgttaaactttataacaataaataatcactatattactataaatcacccctttactaaataaactatatgagtacctgatttgttttttactcacccatgactgataaaggtggtaggaaatacctttgtggtgaagtattagataatgttagtcttgcagaaggcagccataaggaaaatatctaggaaggaacattctagacaacggaaaaatctgagacaaagaaacaaaggcagggatgagctctgtatgtttgtagaactgaaatattttggctcaacagtagtgaagaagagagaggattgtaggaaatgagggtgggatctaggcaggtgcctaccttgaattaatgttcttattgtacttaaacaaaaaaaaagcaccaaaacagagcaaaaaatgtgtgtcagtaaaaggcagtattttgtggggcatgtctttacctaattctgtttatttgtgagttttgtgaaagtgaaaggaaaattaccaaaaataaattatttaaattttcgttttcctttctttgtagcacattttcttaagtcatttaagtgtgactttagtcatcaagtacatacaagaaaaaaagcataaaggaatgaaaattaagagggtaaaacttctgcaggctatatttactatttacyctaataatattaaaaggaatcatgaacgcattgagaagtattttgaagatcaagtttatgtagcagtttattttttaatctatcctcatggctttgttgtgtttgtgagacaaaatgacttcctaagaaacacagattttatttccttagtgttacttctagtaattactctttctctcatatttacatttggtcaattttatctgcttcctctatgcaagaaaaaattaacttcttagacttttaaccttccttcttgttcccccatcactctaatttgttgtattcacatactaagaataatgtttggtattctcttagtttccctttagccagtttatcaactatcttctggatttctggttctcaatcctgacaataaatgaaatcatattctgaaagaacgtcatcattcgttgaaatattttcatttctggtaaatacattgtcttgacttaaaaagtgttttttttggtagcggatgactcctagaatagtacctggcatgtgttaggtgctcaataactatttactgatggaatgaacacaggctctagtgtaaacagatgagacttcataatgtcacttaccacatggcactcaggagatatttagcctacctaagcctcgattatcatcaactataaaattgagataataatagtatctaccatttaccgttgttctaagaattaaatgacatagtgcatgcaaaggacktagcatagagcctatcacctagcaagtgctaaaacattagctattatttttaacattaattatttttcaaccctagaatggtacatttttaacaggtagtacattttaacagcaaaattttagcagaatgtatttatcccccactttgcattttttcctaaaaactgtatcatgggataatttattttgctgtggagaaagactaaactatctatgcctccctccacctgaggtcatttctgaagctgttggcattgggccaggggttgagtggcagaataatctccttatcaattttgttatgtttgatgttgtacaaaataaatagctcaataaaaactscagtttagatgttaccatggttgggaagaaaatggcagtggctacctattaagaaccacaatcacaaatgcagtccttctgtattttatatccttggttaggtgggtttcttgttcttttccttgtttgctccatctggggatgcctgggcacccgtacaaaactcactagtgcctaaacacagacacattagttggggctgcccctgcttcagataccagggagagatttgttggcataatgcaccagggtcttatgccagctcctgattctttgctgatgctgagatgaggaacatggctgggagggggctaggatggaatgaaatctgtggcagccaaagcctccatttgtctttctgccgagtgtgctgagctgtagacactgcagtgttttcaaaaataataataaaaaaatttgctcattagtttttaagtcctgctgactttgtgaaatcaatatagcacattgtaattgatttatgaaatcaaaaaacccctgcttgaccaggaagttcggcagtcgctgctctcagcaacctgcccttctgctcattagtgcatttcctttagtgctgcctgagccgagggcgccttcagagctggaaggctcaagccctctgcagacagtctgcttaagatgtagcttgcattgtgtccctggggtcttatgcttctccccttyttcctaccaggtcagctgaaggacttcagcttctctcttagggtccctaatgttctcataatatcttactggaaaggcaagactccattcatacctgtattttgacattttaatctatttgctacttttcttttctctcaccttttattcttccttgtcttattacttagcttatcttttgccatctgaccttatctattcattgatctcttttattctattttatataacctcacaaggtkaacaatttttttctatttcaattgtctttgtctaatttcagtacctactgttttattcttaagataatattttatacctcttcctgccaaagcctgctataattatgtttgtatgccacctttcaaaaattgaagtaactgctatacaccaaacattgtcctgggtgctttacatcaaattatcttctcaagaagtgtgtaaggaatgcattatccttggttagaggtgaaaaaactgagatttagagaagttagtaacttgcctgagtcaccccactactgaggggcaaggctggtatttgaaactaattctgtttgactccaaagcctgtgtttcttttttccagtacaaaatgattattccarttggcctctgttttacattaaatgcttaactagcaaaatctagctcttggctgcccttaaaggggctcattctctttagtgccattcttccaaataactctgctgttcaaactgccagaatgcaaatgtatttattttaagatcttggtctatgctagcatattggatggcttatcctttttcgtggaattctcrtctatctaatgttatgtgtatggagccccttgcytcatcattaaaggtgagggaagtgttctcatattgtcaaaagtcaccaagagcaatctcataacctagaaaaatcgacagacagctgagccaaataggcagcctttgggagcttcctgtggatttcattttctctttgttcttttgatgcaactttgggagcaagtaagtgggaaaattatagaacactgcagcagcaggaagatgatgcaatgtgctcgatgtcctcacttcttaagtcgttgaaggaacctgtagtttctccatacaggtactgtatgtttcaggtaagtgctatgccatgttcataatgcatgagtttgcaatgagttaataggttccatccatttgatgtcttgcataatattgcagtagcattgggcattactgccattcaatatgtgcaatattgtactaaaaattaaccacagatgccatattaaaacagctgcagatttagatttagctacagaaggaagaaaatgtgctatggaagttggccagaagtgcaatggagatatgctgtaaatgaggaggaggagaaagatactgaggttgaagtgccaaaaaaaataaatggaaatggaaatggggatgggtaagtcatatggtcagtggcaattcaaagggactcaaaatccagaagagtgcagaatgcagggtgacttatgcctgagtgagctgatgaagttttaaagcaggaggtctaatcagaacaatatttagagatatagatgaaggtgtaaagaaaacagctataaatgtaatcattcatttttaggatgcttractgtagtcaggatattgatttaggaataaactactagaaaaactggatgtggctgggcgcggtggctcacgcctgtaatcccagcactttgggaggccaaggtaggtggatcacatgaggttaggagttcgagaccagcctgaccaacatggagaaatccctctctagtaaaaatacaaaattagccaggcatggtggagcatgcctgtaatccagctactagggaggctgaggcaagagaatcacttgaacccgggaggtggaggttggggtgagccgaaatcacaccatcgcactccagcctgggcaacaagagtgaaactctgtctcaaaaataaataaataaaaaggaaagaaaaagaaaaactgtggatgcttgaagtgatcaatgtgtgagaagaaagttctggtgtacagggagtcatagcaattccagaccattacaaaattcaagattatcttgaacactcttgtacatgaaggttgtcctctgacaatggacccttgtgagattgacgattcccattttggagaaaagtgttggagggttcagttggcacaattttgtactgaaaactgaagtgacaaaattttatttcaacagaattgcgggcttgcaagaatctcattaactgtagggccatctgccacgttgctactcatttggctcatttaatcacaggtgggtaggaaggtctcaatagtttyggttccyrttcaattctgatttttgcttgggaaacagaaggaaggtctcaatagttttggttcctgttcaattctgatttttgcttgggaaacagaaaaggccagtgacagctgtggcagtgccagggttctcttttctctgtgtgagccagaagatggcttccctatatagtttgctgctaacagagcaagcagacagtaagcatttcctcgccctagtgtttggctgctgaaagaattatctttgttgacttgtggtatacttggcttaggagaagagacaaggaacacagtggtctctaaattagtaattgacttcatcaggggaggaaagactggttattgactgccctaggtcagttaaagcacctgacatttacctataacttgtgtctgccttcctggctcagaaatgaaatagaaacaaatttgattagtaaccaggaaatacagttggtgctttacaagttattaggtacattctaggcctctaaacattttagggaaaaaagtgtctccagtgccaatgcataaccttgttttccttcctcttcttttgaacacaaaagaataaaaacttgatggaaccccctggtgttccaacggtacttgaggaaagtaaagcaaagcagaacacaacaaaatacaaaaacaggctttttctattttgttttactttgtttttcagtctagtgtttcaaatccaggaaatgtcagttctttcaaaggaccttttctccatagaataaaattttgggaaattttgaaaaagctgtagttctattatgatagtgataaagtagattatagctaacatttattgggcactcaatgtgtgcacaacagtactctgtatctcacctatataatcctattcatccccacaaacatctatgttctaagttctgtttatrctccccattttactgatgtggcaattgagggatagaatggttaacaaattcttccaggtcgcatggccagaagtatggcagagtcattatcaaagcccccaagttagtgcctgagtctgcaccctgggccgaaattttccagcttctgtgatacagaattttatgccagaaactcttacattactaaatttttcattctttcttttaatataaatatacataaaaatgaggaaaacttccataggtgtgttctaatactgtgagcaaattaaaactcaattgaatactattttcacaaatacatgtatgcttatctcactttaggatgaaccaattctaaaagtcctacttaagaaatagttatgaccaggcatggtggctcatgcctgtaatcccagcactttgggaggccgaggcaggcagatcgctagaggtcaggagtctgagaccagcctggccaacatggtgaaacactgtctctactaaaaacaaaaattaaattagccaggtgtggtggtgggtgcctgtaatcccagctactcaggaggctgaggcaggagaatctcttgagcccaggaggtagaggttgcagcaagccaagattgcaccattgcactccagcctgggtggcagagcaagactgtctcaaaaaaaaaaaaaaaaaaaaaaaaggaaataagtatgtgaggagtggctatttaacaagggacttgtcgctagtcaagatttagtaatggcttccttcaaataataggctttgtgaaatttacataaaatacagttaataataattcaggctaagcaataatttaggaccacatttgttgcatatgtcaggccttgctttcatgctactttttatttaattaaataaaaatcctttataaaataatgtgacaggtttagtaaatgtatttattcactggaactttatgaattgctaatttttatttgctatttatagtttctttcagctctgtttttttctctctttttaaaaactgtggtaagaacacttaacataagatctactcccttaaaaatattaagtacaccatactatatatatatatatatatttttttttttttttttttttttttttgagatggagtctcactctatcatccaggctggagtgcagtggtgtgatctagactcactgcaacctccgcctcccaggttaaagtgattctcctgcctcagcctcctgaatagctgggattacaggcgcccaccaccacgcccagctagttttttgtatttttagtagagacagggttttgccatgttggccaggctggtctcgaactcctgacctcaagtaatccacctgccttggcctcccaaaatgctgggattacaggtgtgagccagtgcacttggcccacaatacaatattgttaactctaggcactatgttgtgcagcagatctctagaacttattcatcttgcataactgaaattttatrcctattgaatagcaactccccattctcttaattatctaggatcatattttcaggaacgtcatcgcatgtgtgtgtgtgtgtgtgtgtgtgtatatatatatagtgtgtgcaaatttatttcactcatgatgttatactaaagtatggatttctatatacaaccttgattattccacacttaggaataaaagtttgactaagtgtcatttttcctaaaatatgttttggttccataagtattaaacaaggatacttacatttataaactattttgtattgtttccaaatgaaagcacaagtgatccagacatataggaggctataaagcatgacatatctttagtgacaattggaagtacagaattatggacaaaaactatccacccaactcagaaaagagaatcctgtttcctttactttgctatggcaaaaagttgactcctttatctaacaatagtagatagctatctgaagatttatttaacctttaaaacatacaaggcccagcttacatctacaaatttagagcacatttggaagctctttagataggaatgctgaagtacctctggctttctattttacacgtgacagtgaagcatagaaaattgttccttctgtgagctcttaacagaggccactcttgtagtttctaaagttttattgctaagcttaggctgagggtcatatcatatgatctttatacattttttttttttttgagacagagtttcactctatcgccaggctggagtgcagtggcgtgatcttggctcactgcaacctctgcttcccaggttcaarcaatcctcctgcctcagcctcctgagtagctgggactacaggtaccagccaccacacccagctaattttttgtttttagtagagacggggtttcaccatgttggccagtatggtctcaatctcttgacttcgtgatccacctgcctcggcctcccaaagtgctaggattacaggtgtaagccaccgtgcccggccaacctttatatattctacccattataggtcctttaaacaaatcttgccatttcaagccttaatctattttcccattgatttatattaggtcattattttagacaatggaactatcaaccattggctaattctcctggaagcatttgtagatataaaattacattgattttcacctgaaaggcccaataaactcgcccatactagaaatttaaattttggttcatttcagtaaccaaatgataagcacatcaaagtagttatttggaaagcaatcactgtctttagacaaaaacaagagcaaaaacaaaaacgtgggtatctcctaagaggcctgtgacttgttatacattttaccaataaaataatcatttacrtgaaatttaaagacttactctagatgaaatgaataatgagaaaacagcactaagttcagagaataaaattgtattgacgaagaaagtaaatagatcagtgtggcagaaaagtcatgaaaataagattggaaaagtaagtttgattagtattgaaaagggccaaaaatgccaaacttgggaatatgaccatttttctttagggaagtcactgtagatttttaggaagagatgatgtcattacagttatattatatgaagacatctttcaacactttgtagggtaggctagtaatgaggctattggagtaatctatagaaaaagagatgaaggcaagaatagaagtggtggtgagaaaaatggaaaggtcatgtgggttccagagtcgagaggatgtttgacatgtttttctttgtctgaaatgttcttctctactttttctgccttaccagttccttaatttcaggtctcagctgaaatatcccttttacaggggtatcgtccctgattccctatattagtgctgccattccatttctatgttctccaacactgtttctcacctgcactattagaaatacttataattatttcatgagttactttaaattatttttaaagtccttctcacaagaacatatgttttacaaaggcaggaacaatgtttgtttcattaatacaaatctactagcacctaacagtaagtattcaacaaaattttgtggactaactgacctattattgggccttttatacagggaaattaaagagggcagttggtagaaaagaatcaactctggtttttaactgcagtagcatgttaagcagttattggtctataatttatgctttagaataaatgacttttatatattttcctataaggaggtattgatatactgattgaagaagaccaagatttttggtcagatagaaaatgacaagtcttaatggagtttaaaataccaaaatatcatgtgttaacttagaaaaacagacagaaaggagtgctaaatagaggaaacagccaagaataaagagcagaaatactgtgtctgctctgcagataggacgaacttagcttgatggagaaccagataaacttgtggatgaaccagctcaatgccaccactaatcctgaaaagttatacacaaaccactaagccaagtgctctgtacatgacaatcatagactcatagaattggatagtgcaagataagtcaaagacagaccgcttcccaattcttgatctgatttgcaatatccagccaaatagttgcgaagcttttcctgaaatcctcaggaaagggaaacctttccaacttatttttacttacaccagtagctgatgattcagaagccaatctgaacagggaacatttaatcaaatcataactaagtcaagtacatccttacctacaatgcttaggcatctgctttaatactttgcaaaagacagcagcatgcatgttgtgcatactactcacagatagtacttattactattaattatatgtgaatacctttattagaaaatatgagagctgtatattttctaagtgttccctcttatcaaataaatcagttattgagctagctatcaattgcagaatcacatgataatttgcttagattgaagcaggctttttgaaatgatgaaatgccgattttaaatgggactaaagaatgacccttttggtcagctacaaaatggcgagtcttaatggagtctaaaataccagattactcatctcctcttcatcaagagctacctttgattccaggcctattgtttcagaattgcatctgtggattttagacctattcttgactcagagcttgtgctgacctggactggaatacttttttctccttaaaaaaaatgtattattaagaatgcttagaattcaatatgaagaaaaaacaactcaactaaatatagatgaaagtcttcaacagacacttcagaaaaaaaaaaacaaatggttggtaagcacatgaaaagatgtgcaatgtcattagtcattagggaaattaaaaataaaaccacaatgagaatataacttcctgctcattaaaatgacaaaacaaaaacaaaaagtcacatattaagtgttgtattagtagatgatatgaaccaatgaaactcttatacattactgatgggaatgtgaaatggaataaccactttgaagaacagtttagaagattctttaaaaaggtaagcattcacttacactacgaaccagtaattacaattctaaatatttacccaggagaaataaaaacatatgctggcgaatgacttgtatataaatgtttacagcagcttaattcacaatagtcaaaaactggaggcaacctaaatgtccatcaacaccaacaggtgaatgcgtaaagtgtgctgtataggaatacacaggggagtattactcagcaattaaaatgaatgaactgctaagaagcacttttttagattactcctttcttcttaaggaataacttattctccagcctatgtcaccagaagctgtgaatcagaagtaggcctaaacttgtaatgagcaaaagaaagcaagaaacaaaaacctacattgaatgatttcattcgtatcaagctcgaaattaggcaaaattaatctgtggtgatagagacagatcagtggctatctggtagggcataagaagactgactacagagagactcagggcaacttttttggtgatagaaattttcttatatcttgatttgtgtggtggttacactggtgtatacagttggtaaaacctattaaaccgtatactttatgcattttgttttatgaaaattatatttcaataaagttgattaaaaataaataaggctggacgcggtggttcacgcctgtaatcccagcactttgggaggccgagggggataaatcttgaggtcaggagttcaagaccagcctggccaacatggtgaaaccccatctcagtaaaaatacaaaaaattagctgggcatggtggtgggtgcctgtaatcccagctactgggaaggctgaagcaggagaatcactkgaacctgggagatggaggttgcagtgagccgagatcgcaccactgtactccagctggggtgacagtgagactccgtcttgaaacaaaataagtaatttaatagtctaacaaaattatttgagagtgtatttaatttagcactttaaaaaataaattatatattgctaattataaatgagaatgttactaaaacaaacttagaagggcatacttaaaagtcttctatatagaattgcttggttaccaaaagtttagttactatgaaattaatgcttctaagcttacagatactttattgttcaatttagttcagattgttcttgtcatttgttaatacaaattattgagaattcattgtaatattgatgttagcgtcatatcaaaaatgtggaaagtcctagtacaatgaatattatgaaattttcttctaattgtcaattttctttttcaaaactcatacattatagtctttactcaatactgttttatttcaattggaaactgacatttttgatatttataagagatttaaaattatttttcataaatatgtagattacaagactatgaaatcaatttgaacaattagaaaaagaactgttcatttgatcttagccaaaaggctgagaagcaataaaaaragaaccatttttaaccctcctcaagtgtattactattatagcatattttgtaaacatgatgtaaaactgcttgtggttgacttagtttttaatactgacatttctgaaatgttatttctctctactgtatttatttatcctactttttaatytatgaaacttgtcaacatggtgaaaccccatctctactaaaaatacagacaattagccaggcgtggtggcaggcgcctgtaattccagctactcagaaggctgaggcacaagaatcacttgaacccaggaggtggaggttgcagtgagccgagattgcaccattgcactccagcctgggtgacagagccagactccatttcataaaaaaaaaaaaaaaaaaaaaaaaaatctatttgacagaacctttaaattgtatctatataaagcttttaatattatgggtttgcttatgttcatgtcttacttagaaaaagcactttatgaaataaatttttatcaactgaagtaataaaacaatctggatgggcctgttaatgacaaagttaactattctccgagagcaaatggaccaaaaataccatttatgcagaagtaagaggaaaataatgatttttacgttaataaaatgtattctgcaaggcacagtggtgcgtgccttaggtccagctactcaggaggctgaggcaggaggactgcttgagcccaktagtttgaggcaagcctgggcaacatagacctcatttcatctctaaaaaaatgtattctttgatgctatatatagtataataaattttgagctgattatgtcatgtgggtaaaggagttgaactctgaagccgaataatgaaggagggagaaaactttagcctgtgagagaaagaaatctttgttcattccagtgaaactggaaaaccacaataaattgactatatgttgttaatttgagaaggcgatattctatcataaggagtaggtgtgctatggcaacactaaacaaagcttaaaagctcagtggagtgtagagttcaagatattataaagactgttaaagaccatagattcaaggacaatgaggaaaattttcaagagtcatgggggttaattaaagaaaatttaattttcatttcctgaaacaaatattacagaatggaatatactgaagtacattagcatgtttaaaaaaaaaagaatatgctctgaccttgttgaaaaaaaatgattttggctcagaaatgagaaatattaaagagaagaacctattgttaatttataataatagtagagatgacagggtctcttgtaattaaaataaattatgtttatggtatattttctctttgttgggcactattgccaggaattgcctgcaaattcagtgaggtgggagtggtttatacccttacctgttcttaccaacacagttataatgatgacatttgtcatttattgagtgtttactctaagtgggcactctactaggtgcattacataaagtaatcctcatagtaaaggagtgaattacactcctggttttataggcttaaagaagatgaaaactggcacaaagccatacaaattataaagagtacaattgggatttaagcacagtcttatgcttattctaacactgtttatgtatgtatgtatgtattttttttttgagacggagtctctctctgttgcccaggcttagagtgcagtggcacgatctcggctcactgcaacctccgcctcccgggttcaagcgattcttctgcctcagcctcctgagtagctggaattacaggctcacacaaccatgcccagctaatttttgtatttttagtagagacggggtttcactatgttggtcaggctggtcttgaactcctgaccttgtgatctgcctgcctcggtctcccaaagtgctgggattacaggcgtgagccaccacacccagcctttttttaacttcactatcctgcctcattgctgcccagtgtaattaaagtccaaatagatacattttcattttttttcctttaagatgattcaaaggggaaaaagagcaaataatgcaaatactcatagaaaggcaaataaacttgcatgaaaagaagaaaggaaagaaaacaactgaaatcctggcacaattaatagataacttctttctatttcacttggttgagggaattttcttgcttgaacattgagaattcttgagatctgtattatcttgaaaaacagaaggactaccaagaggaaataatacacagaggatggtgttaccatgtatatactgtctcttttttggtataattcaaatatcacttgggcaatcatttgttatcttttgaaatagttctgcctggagataaggaaagatttttggctttctaagatatcattttggggctatgtgaaaatagtgtcattatgtagatgcagattttctggttatatttcatggatatttgaggtcacagtcatctctaaatttctataccttcctctttgaaatgtattttcttggcattattagaatttatgtaaaaataagtaggtgataaaaatttccctaatagaagaattgtatcccccccccacccaagaatatagaccttttgtggagtatttctggctaccagttacctcactgaactcaaatgtaatattaccatgactgtctgggaaggaaagaataattgttacatatctgctgtatatcgagaagaagctgactgtgtatgcaggtaatatatggatgacttcctaagagatagtgctgtaaaaccaaagtgaaaatacaacagagtaactgtaaagaaatcccaatagccatccttatgactgacagactataaacttttgtggatgcttgaatctaataccttcttaccacaactgaccttgctctagtttagagcttctaactttcatgtaatcaaagtgtctgtatttttgtgtgggtttaaagatgtggctgtccatgagtggccctgggattttttacaagttacagtgattttgcagttgttgagataggtgccacgcattaaacctatggaactcgccttgactccaagtcaattctagccttatagtactttgtaataatgatgtgggagaaatctctgaggtaggtcagtactgttactctcatgttcatgtagtaatcctgaggttcataaactttcatgctgtttcactaagatgtttctgataggagttacagatactctccatgttgtggaaatatagagggtctctagggtcaggaagccttatgaatgttgtgagaggcagcttttctcctcaaatgtgaggcagctcacacaaaagaartacaaatagttaataaacaaacaaaaaattcaatctcaccagcaatcaagtttgaagtatatcagctttgacctatcaaattgtaaaagagatcttaaaatttctagtttgaagtatcatggaataaaaattttcataactactgggagcagttataatacaaattatcatgaaaacagtgtggtgttatggatcaaaaatgctaaatctgtccttttgatgcagcaatttggcatataaaaatgtatcccgaggaaataatccaagatacaattaaagttttatggataaagctgcttaaaattttctccccaactttttgatattatacattattcaaatgtgcatcaatagcataataattcaattattgcacattcattttatggaacgatatgaggccattaaaactcatgattttgaagaagttttaatgacatggaaatgttcacaatgtaatgataagttataaaaataagacataaaattgatatacagtatcatttcacatttgtaaatataaatgcctgtgcatagatgtatgaatgtttgctggtggttttatctgtctattaatattatgttacattttcttattaatatttgatttttaaaaatattctgcaatgagtatatttgcttttgcagtcagaaaataaagcaatggatgttattttaaaagaaatagctcataaagtaaatatatatatttacatataatattwgtttatttatttatttattttgagatggagtctcattctgttgcccaggctggagtgcagtggtgtgttctcagctcactggaacctccgcttcctgggttcaagcaattctcctgcctcagcgcccccagcagctaggattacaggcacatgccaccacacccagctaatttttgtakttttggtagagacagggtttcaccatgttggccaggctcgtcttaaactcctgacctcaagtaatctgcccaccttggcctcccaaagtgctgggattacaggtgtgagccaccatgcccggccaaaaatatgtatttaaatttaacctattaaaaatgtaactttaagactcaatatggtgctgtatacccagtttcatagccacttatttattcttcttttaatgaatatgtattgagtgtcttttctctgttaggtgctgttttaggcactgaggagacaacctttttgtttgcagaaactcctgaatccaatcgcttctaaccacgtttttttagatatgaactttcttcatatccagtttcttcattttgtctttcctaaatgtggttctaaaattgtattttctctagtttaaattcatcttgtctcttttttttaatttctttcccttaatgtcaaactaatatgtatgtatatcttttttcgatgtgttttatatatatatataatatttatttagatatatactctaaaatagtgtctgatattccttacttgccatactgtagaatcaaactgcctcttggtattgttttggaaactgtttttaaaaattaaaactataccaaaatccacagccagcaacatactcttatttgatgatggtagagatggtattttgctcttgagtaattctatctaataaattctgtggattttgttggcaagttttttctagaaacagattgggtttttcaggctcagcagtcatggggcaaagaactacttccaagtggtaacttcatgctcagagtataaatttcttttcttttagtatagacttagacttttatataaagaggacaaatccaattcagtagctgttaaaaaacccattcatcaaaaagcattcctaaatgtttgaaacacactgaatcatagattttattrctattcagtagtacaatgacttcctcccttctaagaacctattaactactcattgttgtagaattgaacctttcgagggggtatattctttcttaacaggatttggtgaaatataatgataatttaaatctactaaacagattatttttctcactggcactcttatctttatgtttcacacctcagaattttcttaagacttcatttttagaacgttcatttttaaaaattcttaataaatgttagaaaatgtgtcagtttttatttgatctgggaaaattattttaatggactgttttacatagtcccgcctcatatggttgtatcatttgcatactgcttaaaggtatagagggtgcagatgcaagtagtggttgaaatcttgtattgctgagggaaagatgtcattttccaatgcagttaaccagatgggaccattattgattaattaattgtaattcatatgcatgctatgtgtatatatatatgcatgtgtgtatatatgtatatacacatatgtagatatatgtatatctacatatatctatctatctatctatatatatatatgtctatatccatatctatatctatctatacctatatctatatctatccactagcagatgacctgggcttatataagacaatgttttaattgttaacaaatagaaggtcatggtttatgtcaaggctaatgtatgcgtgtatgtgcttgtacacataagaaaaatctcacgtttccagaaaaatagtctattttttgctataaccattgtttcattagcagaaccatcaacgttcctaatggagtgttaataatcacctgcttatagtggtaccaggttctatgttatacttaatatttctttttgcgctatgaacttatattttaagaaaattgcaatagcatatatcaaatgtaagataggccatgatatccaaatacaaaaaatttctcttctaattctcccatttagttgaatttgaaacagggaatgaattcaggaaagtatgggaaaagctactaaacatgtcttaaataagctatagttctatgttgggtaacacagagatatggagatgtgagagcacactgattcatgttgtttttttccatatttattttcttcttacagatttagaaccctgctaagttctaaatatggtttgcctatcagtgatcaccccaaaacttgtggtttttattcttatgttaatgtttgtagaagaacatcttattttggttaaatgtagccactgcttccccctcgccgtaaattaggtgtatgatctattaaatttttaacactaaaactgacctacagttggctatgttaaaaagcttctttgaatctgatagctcatttttagctatttctttgaataatctgaaaggtatatcctgaaaaaaaaatatattacatagccgagttaacccagctgcatattaattctttaaaatgataaatatatgacatttggttattttaaaaagtaatgacatcaaataaattaatttttcatttcattatacaaagtcttttaggattagttagatgatgctaaaattctgtacatcaaaaatgagaataagacttttttacttaaaagattaatttaattgtctacacataatttaaaaggaacttatttttcctaaattctgaccaaaaatagggaaaattgttttcgtttattaatgctgatggttaaaatatgtaacatttattgaggtcttctgtcagaagcttcactatttttcaaaatggcactataaaataataactattgttatcccaattttacaaattaggaaactgaggtacaggcctctcaagtaatatgtcaaagtgaaggaagcaaaagactcaaatcttaagtcctgactacagttctatacactgcctttatggtactgagctatattaatttcaggcccctctccagacttatatagtgcttgcaaagcaaacaacaggctttggaattgccaaggaggatggatttctctcaaaattgttttataatgatgggaaggcacatttcatgaaatcattattttcacttaacatagaaaaaaaatctgcatgctgaaagtactgttctaccctcctatatcaagtatcctttgaaacatatgcggcctttgactgagcaaagaaataaaagaagatggaaggaagagagaaaaattcagggaaaggctttgctacagttttgctttgggacaatcagtaaccgttttctctacgtggaagttcgttagacattttgggaactgtcttgccctcctgggaaatatttagtttggtttaattacaaaaaaaaaaaaacagcttttttttttttcttttctttcttttttgagacggagtcttgctctgtcgccaggctggagtgcagtggtgcgatctcggctcactgcaacctctgcctccccagttcaagcgattcccctgcctcagcctcctgagtagctgggactataggcacctgccaccacacccggstaatttttgtatttttagtagagacagggtttcaccatgttggccaagatcgtctggatctcttgacctcatgatccacctgccttagcctcccaaagtgttgagattacaggcatgagccaccatgccgagccaaaaaacaaacaaacaaaaaaaccccaaaaaaacccagctttttaaacacaacctggaggagactagtacctaaatccagggcattgtctgccttccaccgtggctcccagctgtctttttggcatgggacaaagaacagggcttgacccacagttggccctcacagagtggaagccagcagaataaaggcaggaagttttaggaaggaaatatttgcttgtttgctttaattcaagagtggaacgtggcaatcttattgcagaattcatcttattttattgctttttaatagctttaaattttctattattccaaaatgtaacttttgtgtaaaatgtttctaaacacaggttttttacattagtcagggtttaattttgagttgtgacttgaacttgacttttctgtgagcgatgaagctcagtccttgcaaagctggatgggtttgcagtctgcctctcatctgctttatctcctcccttttccctcctacttccatgctgccttatcagttttagggagggatcatgaaattctgtaagagaagaaaaccaagtgcaggctgtaggtataattggtgactcagtcctgtgatggtcatcaaaggtgtcagttcctccgaagtgaatccaccatcacctgacagatacatttattgtttaaatgtcatgatgaaagtkcccaagagccccactggtctaaagtgaggtttctcccaggctgagcacattccttaggaaataggaatcctggtccctaatttatgaatatttrcaattgttatcatctgatgaacattttatctattttcttgccttctcccaagacagtacttttgtgccagtttaaaaatgtatgtaattttaaagtatgagagaaacaaggtagagtgatttatgaaaaagcacactgcttctaagtgtatctcccccaccaatgtaaacatctagattgaaatgcggaaaaaaaaaaaaaagacctgctcttcaatgtagaatcctcatactttaaatgtctaaggaaagagaagaatgttgtgctgaatcccaaagcagtgtgacaaagtttttcctacgatgttactgtggacagaaattgatgtctggctgggtgcggtggctcacacctgtaatcccagcactttgggaggctgaggcaggcagatcacgaggtcagaagatcgagaccatcctggccaacatggtgaaaacccatcactactgaaaaaaaaatacgaaaattagctgggcatggtggtgcatgcctgtaaacccagccactcgggaggctgagacaggagaattgcttgcttgaaccagggagttggaggttkcagtgaaccgagattgcgccactgcactccagcctggcaacagagcaagactccatcttaaaaaaaaaaaaaaaattgatgtctatgcactgataaaacaacaaatccttgagaatggggcaacaccactttctagcccaaattctgcttggctttgtcaccttccatttcagatgataatgtctcaccctgctctttctcatgaatagagtcttggtctccttctattttggaacctgttttcgacatgccctctataccttaccctgaaaagggatctaaatatcatttttgtgggaactgtcagggttagggtgaacccagtaaacctctctacccaaactaccactgcaggtgatcagttcatctgatcacagtctttccaatcctgttcttatatttgaccatttttaagtacactattatttgctcacatctacttggaaagtaatcgttgtcaagaggaatgatgaaaggatcatctttttcaagtgcccaggaactttgtgcatataatttcatttaagatgcattaatcatataatcacattttccatactacaagcaaataactgaggcttatagaggtaaataatttcccagtgctacacagctcacaagttgcagaggtggagttcaaagctaaaagtctgtttgtgtcaaagtgcttgctcttccatggcataatgaagcatctccttgtggatgcactgtcccatgtggttgtgagccactagttagtttttacagtatttctatagcaaatactgtaagtactagctttgttttatttcaagcatcacatttaaaataattttggttaatttacagagtatgatatagttttggcaagtagaagtatgtgtgagtcttactgcaatggataaatgtgctagacttcctggaagataagattccaaagaaccccttcattcattcattcagtcaacaactacttattgaattcttgccttatgccaggcactggggagagatctgtgaacataccaggcaaaaatctcagcctttatggggtgcattgttgggcaagacagataaacaaatgaataaaataagtactatattatatggtgataattgctttggagaacagtaaaataaggagaaacaattctaaaagccattttaagtagggggtatcatgaaggccttattgaagggacatttgaataaagacttagaggaggtgggccaggcacggtggctcacgcctgtaatcccagcactttgggaggctggggcaggcagatcacgagatcaggagatcgagaacatcctggccaacatggtgaaatcccatctctactaaaaatagaaaaaaaattatctgggtgtggtggcacgtgcctgtaatcccagctactcagtaggctgaggcaggagaatcgcttgaacccgggagatggagattgcagtgagcagagatcacaccactgcactccagcctagcgacagagtgagactctgtctcaaaaaaaaaacaaaaacaaaaacaaaaaacaaaacaaaaaaaaacttagaggagttgaggaggcagacatttggggcaagagtattataggcagaaggagktgtaagtacggagaccatgaggaagttctcttcctgtaataagccaaagagaggctagtgggtgataaggtcagtgagaaaatgtatattgtatgaaattctgttaggccttgaggcattgtaattactttgcctttcatgatgaggaaatgggggatgtcactagagggttttgaacaggaaagtgactgctatgagttatgttttaaatgatcactctagcccacattttgagatgaggtgaaggtggaagccttacttcaataaaccaagacaggaataacggtggcttaaaccagagtagtggcaatatggttagtaaaatgagagacttaagttacatttacagcgtggagtcttctaatcatagaatttagtgatgagttggaagtggctttgagagagaaggaaaaacatcaagaatgacttcaaacatttggcctccatatgccattaactggactggagaatattagaggaggaataggtttagtggggagggagtggaggtgaagatcaggatagtcactttgcatgtattaagtttgaaatgtctattaagcctttgaaatgtcctcaaggagtaatagacatttcaaacttaatatatgcaaatattgtatagataataggatatacaaatctagaattcaggggagagatcaaggctatggatataaatctggagtcatcttgatttgtctatatcagtagtattgatgaaatcactaaaggagtaaatttacacacaaaagagaaggtccaagggctaacctgggacaccccaacattaagaggttggtaagatgaaatggaaaagagaacttcwcaagagagtcccagtgaggttggaagaaaatcaccagtgagtggcatgcttgaatgtaatgaagatggtaggttaagaaggagaatgtgatcaactgtgtcaaatagtgctgacagttcaagtaagaggaggatggagaactgactttagactgagcaatgtggagtttattgatggccttaaggrgagcagttttggtagaattgtggagcaaaattttggagtgagtaagagagagaatgagatgaactggagatcagagactatacaaaacaatagaaatcaccaatattgtcataatagactacaggtattatagctagctttaaagataatgtttatgttcgtaactttttttgaaatgatggcagtttctagacttgctagaagaccttgctattgaacattttatgaattagcatatctattactgtatcactaatttgtgtttttaatattgtgataactatgtcaagttaattgaagttatttatagtcctatatttttatttatgcatttaaaaacattgttctcagaaaggatcccttgtgattaactagtagtccttagcaaaaaaacttaagaaccattcccattttagggtcactctcaagatttctacagakcctttccttctcctatgctttatcaacactgtcactattcctaaccctaccatccccccttttctaagggcagtcacaaagtggaattaaaactaaagttgctatccaccatagatcctatgccattctgttctgttctgtatttcccccttaaaattttaatttggaatattatgctatgaagagatgcttgcaaatttaaatgaaccttccaatatctttcagaatgtcaaagatggaatatgttcacaatatttgattcaattaacaaatgtcttctgtttttctctcttttctcttgtagtcatttgtgaataattaacttgtattttcatgctacatattatctgagaaaagatcattgtaattagtaattagttctctactctaaaactttttgaagttcttaactacttctgttttgctgtagggtttcaaatgaggcaaattgaaaaattcaatcagacttagctggtattttccatacaacatctggtttgacagctagatgtgtagtcaagcttataaatcaaaatgaagctgagttggaagtgatatagaaatgcaaaaatgctccatgatttttgtaggagatttgtgatcattttttatgttaatgtaattaaactaaaaatgaacttctgtattttaaattctacacattttcattgtgaaaatggttttattataatcactttatgaaaaataaagttatctgcagagagagaaggcagagagcttgaggaaagaggagagaaagaaatatttttagggagtctgctagcaaagaaaaaaaaatttcaaatagctatgagggtcaacatgggaaacttacatacctggcttgaagagacttctgaaaggaaacaattataaactcagtacagactagccttgtagcaggatctgttgtttgaggtgttgccaactcatgcttagaaacttagacataggagtatagatgtggagggagtcttgagattggagaccttgccaaatggctttggtagaagaagatggggctaagaaagagaaaagaaagatagcagtttgtgtcagcaaagtttcttactcctgagtttctggtcggatagagagaaaattaaagctaggaaaagaaagaaaggtgtgctaagaaattaggacgagcttaagaaattagagattgcaatgagggacaagtaagttcagttgcactgagagtagaatgggggcattggcacaaataaggttgtggaatgttagacctgaaagtagttgtagaaatcatctactttcaccagttcattttccagatttcccagagaggttaattctctttcccaagctcatggaaataaccaggggcagagcccttagaactcaggggactgaattctgaacccttgcatatttttgttctcttggcccaattgccgcagaagtggaaagaatgataatcctgactcctcttcataaaataaatgatttaaagaaacatctcattatttttactgggcatgaggattgaaacaggaataaaaatagaaatcctgtcttggtttctagctcaaagagttccctgatcatcaatccaggcattccctgagaatgctaccattatcactgaagatttgggaacatgaaattctatagagaggaagaggttttgaagagaataaaagattgtcaaaaagttgaatctgctgcattaggacactaagccaacttctgctgtaagcttttgccgtgagtctgagggtgtaaaatagcagcagactgaagatagtaattataacttttttcaacatctaccctgtggataccagcgcttggcaggacctgtgcaatrgggatgtgtataattaagagagaagggtctgtagaaaggctgtggggaggagataattcatttacactctctctccctatgtctgaatagaagcgtaactacttggacaagttaaatgatatctgacctataaagggaactttcatgaacctcccatttatcacgtatcttgaaagtgcattttaaatctcaaaccttagctctccccattttaattcctttccttcttctttgagcagtcatatttggaggatctcaaaatgcaagagtgtgagaatcaaaattaggatagtttgccccaggagtagtaggatagtgagtgttcctttgtcaaatttggctctggtgctggaattttaacatgtgttattggctctggggattatgttctggttccggctgagttaaagcttgctttgcttttgttttctgtaagtatttaataaaatggcaggattcgcttacttacttattgaattcttttgcctgggaaacatgcaaattctgaacccagctgcacatttgtgacaaagagatagctaataatctgagctatatgctatttttttttaaaaaaaagctttttatttttctacaaaggcagaactatagtacacaaagttaagccttttagagactgagtttaaatctgctttctattaatagctttcaagagtttttctaaataaccttcaggcacaggcattttttttttttttttttttttttttgcaagaaagcaggtggaggraaaaaagacctgtggtttgttaaccaataaatgctaagttgctaaatcttcctgtttcaaataaatcagttgggccaattagaatatttattttcttcctttctcttttattcaatattcacaaatgatactagagatggaataaactcctgagattatctggctcagattcttaatgttctggaagctggtactgaaggccagcaaggatgaatgatcaaaattgcatagtttgtgtgttcaataactgcttttggcccctctagttctatgtacccttcctctgtaccctgctccaggccacagaggctcacctttatgaaatgcttcagagggccctctcactgcttctggttgcatttggccatatgtagggttcatatgcgtaagtccaggtggcagaaggagagagaaaggagaactctaatttctctggctcccttcaggcctagcttagtagtggctgcaatgctggtgaccatctcctgtaagcacacttttcagcagttctagcaaattttccccttgtcttctgccttaggatggtgatgccatcctgctgatgctgtccccatgtttcaccatccttgccagctccccctaagtcggcctacatttttgcaaaggtttgctggattaactttcttgagtcactccttttgagtgtatcatctgtttcctgacagaatccagactggcacagctctggtaagcaccagtgctgggactgggacccaggactctttaccctattctaatgtccttcccactatgcccaagagtacaagaaaactttgtaatcttccttcaggatcaaacatatatatatgcatatatatatatgcatatatatatatgcatatatatatatgcatatatatatatgcatatatatacacacacatattctggatatatttcttctaaagtattttttacttgtctctcatttctactgtggaataaatgtattctttcaatttaataaatgagcaaatagtaaatttaggaaaaaatgataataaaagattacatctcacttcttttgatttacttggtgaagccagactgtgggagatatctttgataaagttggtcctattgaccaagaaagaaaacattatactaaagacttcacataacctgtttattctctatttcccatcaggagatggtttgtcaggaaatgtgtgatagatacatgtcatgaattcaatttagacagagctaggtagcattatggctgtttgtccacttttcccttttgaattatcttctacattccatggttttattaccactagttttctttccccaaagcaaagccattaggcattctttttgctgtgcacttactacataatttccccaaaaagcttctaaactctttttgtcccgtaggaggatgaggcccttgccagatctcctaagggttaggattaaacggaatattggttactgttgagcctgtcactgcatcagttttctggctcctcttagagtgtgatttgccaaattcagttgaaatcagttaagcaaccactttggaaaaatacagatgcttttaaacacagtcagaatactgagatttactctgcaggaaaacagagcaacaggtaaaaataataagaggaattaatttcactctgaaatgacagcattrtgccttttgactattgactttttgcagagaacatttcactggagggaactgacaactcttactagctgcctgcaaagcttgcctcctccttgctaaggagtagaaataatgtaattattgtttattgcctggatgacaataacttgcaaagattctcagcccaagctctgcaagccagttaactctggatatcagttggttttacagggtcaatacattaacaagatagcaagcaatgcctactcattaaggctcaatttactcccacttcccttgggaagaatcccctctgctcccaaaactcttaccagtggttttcaaaccttactaagcttgagaatcatttgctgggtctggcttattgaaacgcatcctagatttgcacragacagccactggcctatccatcacctttgtgttaattagaaaaagaggaactctttgggcagatgcagcccccacatgtaggaaatatgaaggctaacaagcaaaaaggttcttcttccttgggtggtcaggtacctttgcaaaatgcacaagaacaaaaccaaatgccatagctctagggtcttaatatttttgtcagcttctgcagaattcccttaaaggctctgcaagttagatttgagcacccctttctggcagagcactactccatgaccagaatgactaaattttgcctaagcaaatttccaaatgccatgttgtagcgtcactagagaaagataccccccagtcagatcttggtgatgaaggtgagacacaatgggctccaagaatttgaaatccctcatctgtgaaggcagaaatactaggagaatgggtaatgtttataccatcaatgaagaaactcttgtaacctagggttttcaaattacagaagaggaagaacaatggaggctgatctccagtttgtgacagtctagataggtggcctcagtcttgctcttataaattctaattcccagaagtcatgcagtcgtgtgtctatccatatatccattcatccaacatttattgagtgtctactctgtgccagctgttatgagaggcaatgaggaaaactggaattaatgtaggctttggagccaaacagataagtgcctgaattctgtctccctcgacttcttagatgcatactgtcatgcaagatgattaattttactgaattggcattgtcatttggaatgtattttatcacctacatcatagggtgattgtgagaataagatattatacatttctatagtgcctactgggcttggtacatagtgagtaatcagtaattgatagatattattcagagtcatgatacaatgataccacaaaataatcgktatctttttcttcctattctctattgatgatctatgtatataacatccattttcctgtcttatattgtacctgagtcagaataaaatggatcttttcagggaaacaatactcagagtaagattagaaaataccaaaggcacctaggaaaagtttctgacttttcagaggttagaggaagtcttcctwctattttgttgtttaccatgtattatatgataagaaatttggaaagactttgataatgctatatatgttaatgtgctccaatgttttccaaagcatgtttacgtctagtatcttggtacttttcctaattgagatctgagcttattacttccrttttatatatgagaaaactgcacaaaattacattacaagccaatgacagtgtttaggccagaatccacagctccaggtctagtccagtaatttctctacttgtagcccaaggcctataataatcagccttttgtgggaaagacttgaacaattcagcaattaaaaaagaaaaagtagcagtcgattccgccaaggaagggtatacctgggctgtgacagtttctcaggaaatcacttaacattttgaggcctgctagcacattggattttaatccaaatttatctaaaaataattttcaatggactttaaacctcattttccttctgttaacaatttgacataattttaactgaagctaagtttatgtattcatattcatccatggggcatgaccagtgcctacagtttgccctaagaggtcagcattaatattgtaatccattgcgggaccgtgtagtgcacaacatgctctcctgtacatagtagccttgcctttgcctgaatgttgtcacattattttcgctattttaagcgtttttatttctcctctgcagtcactgaggagccctgcaaaaggagctcaagaagcagcaaccttgatttttaaattagtttaactagacacagaacaaatttaagataagtttcaaatatatggtttacaacatgattcacatttgtctgtcaaatactatatggttacattcaatttataaaagcagatactgaaatgtattaagaaaaatctatatatttcaaatttcatactagaaactttattttaaataaatattttatgtttagaagaggctggatttactgactagtagaggcataaattttatttttgaccagcattttaagttaggaattatgatgtacatatccagaatggaagtaacagctagtatttgcgagcacttactatgcaccagctttgttctaattattttgtatttcaaaacttctgtgatagtcttaacaaccttttgagatagattttattattatcctgattttatagcagaggaaatgaaggttcagaatgggtgggttatttttccaaggtcacatagctcttctggttgagatttgaactgaccagtgtctctagaacctggcctacaaagccttgggctaatttttaaaaaaataaaacttatatcatctaatattatcttaggaggacagtgtcagcatgtcataaaacatatcagaagcacaatctggatgatatctattttaagtttcaaagataaaattattatgtagaaaatagatgaaattctctaagcaatatttattatttttataaggtaatgtatctttgaagtttatagctatcttagaaaaaaacaaaacccatgagtcataactaactatggtgtgccagtaagactgtttcaagcaaagagtctttctggaagaacatgatggtatgacttattctttgttgggaaagtacagaaaaaaaatgtaatgtaatcatcaccatttgatcaaaatatggaaaatcttaaaataaacctccttgattcatgtattcattttcaactctctcatttcagacaaccggcagtgagcatttactagggaagatttttgtctttaataacttgaattattggtgggtgcacattcaaagacaattaatgatttccttcttcataagaattacttttctgtgatatcagaagtgatatgctggattgatttgtgtgttgcttacacaaaagtcagaaagatcttgagggaactaagttatgagcccatcagcgaggctcaactgggtcaggtttatgattaagataaccgaggtcagacctgaatagaaacttccacttggttttgctggttggtttctctgtacactagagttgtttctcagtaggctctgttttcttcagtggaaggtaaagaacatagtgggaatcatattaatagctccaggtttttgaaaactacttggaggtcttctgtggaagtatttcaaaggataccttgcattctgaacggctgtaacactactgtgctggcttttgactcttaggttagctaaccagggaagaacctgtttttgtatcaggcttatcttaaaattgttgaaattatataataaattacaagcagggctaattttcaaaatatttaacaactagtaggacataagcactaaccaagcagaagagtccctggctgtaaataatgggtacattgataataattgcaagtcagattataaaggaaaatggattttcagagagatcctcaatttacctgactatgacaatgtcaacttagaattaattgatttaccttctataatggcccattattgcttaagtagtacatcatcatgatgcacatgcatgtgtgcgtgcmtccacacacacacacataaatacacacacaattaatttttccattaggtatgatatcctaatgtcatcaaatgaaaaacaagacggcataccctgaatcgtctccaaggcccttcgtagcttaaaaaatttactttctggctgctacagatgygttgcttatgtcttttgtctctgaagatttgattttacctcctgatgagctgttgaaaggtagtagctcttagattgagtataaaagtgacatctgtctcttttcaaagcctcagaacttttgtatgcatctgggaagctytgtcccctgcatagtttcaattacaatgagtattcttttcattttggatcttagcaaagacttttgccactgtgtggctgtgtgacagctgctgtacacccctccagtggtggttgaygtgatttctgcacctgtcttatgcttaaaaatattggggggagaaaatggacccagcatgctggaaaatattgacttgtttcccatattaggcttagctgctgaatgtcacggatctggaatgagaggaaagccagccaatttgtcaaggtcactagctccctctctgaaaagtgctctgtttatctaaagagttctgagacagggtcttatgtccattaaagatgaaggttcactgttattttagggctggacttggagatgggctttctgaaaaatgtaaacaacttaatcaggccaggtgagatgagcctatctctgtatgcatcccctacctccactttctgtcctctagatcccttcccagtgtagtattaaatgtttcacatgctaaaataaatattctgaacaaacagcaggtcaagtaatccagtttcctttttgggaaaaaaataaatcacattcaggattaatggagaggaacaaaagccaatagtrtggttaagaatttggattcaggagcaagaaagacttgggttcaaattccatttcatgccctatctctgtgatcttcaatatattacttaaaatttctatgcccagtttccctatccggaatatgagtaaacagtacctatctcatagatttgtcgtaagaattaaatacgttaagggacacattattgcaatgcctcaaacatagtaagccatttaaaagatatggtgttgggctgggcatggtggcttatgcctgtaatcccagcactctgggaggcagaggcggatggatcatctgaggtcaggagtttgagaccagcctggccaacatggtgaaaccccatctctactaaaaatacaaaaattggccaggggtggtggtgcatgcctataatcccagctactcaggaggctgaggcaggagaatcgcttgaacccaggaggcagaggttgcagtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtcttgtatttaaataagcataccatctattcagaggaaatctagcattcaaagggagtttctgcacagtgacaagagaggtgctgaatccgacagatcagaattcaaattctgtctcatgtgattacacctcaatttctttacctataaaatgggttaagaccaaactccctgcactgtgcraagcctctaaaatctctctctatgcccctcacacagtgtggcccttatatgaactcatgcttttttgtttttgtaaggattaaatagttgcagctgaataaatgttttgcatgtagctacaaaggttgcttataattcaggagtaattttatacttcataggatgatgcttttatatttctaatggttcttttgctgtatggagccattcacataactgaaaatggtaaacatttattaaaaatatataaaatatattaaatgcaatgttttatgatatgaactaaatctcaaatatcatacatattttgacaaagatagggaaataaggatcttttgtttaatatactagagtctcagtgagactctcacaagtgtgacattcatgtattcacatatgattctttaaacagacatttattaaacatatagtatatctcaaaacctgccttaagcatgtttaggatacaaaaaaaatgtaagattttttcctccctgtaaaatttccctgaaaggaagataattatagatataagtaaatatamttcaagttagaaaattttaatggctatagaagtaaaataataataatatmcaattagagttgaatggggaagaaaaatgcttttggttgtatcagaaaatagtttatgtaagagttaaatttggttataaaatataatttgtcaaaaagcaatgttccaggcagaagaaataatttgagcaaattagagatagaccctgaaggagacgttcaaagagtggtaaatcatggttttgttggagcatattggtattaagagtaattgcatagagaaacagaaagactaggttgagcccagattgtgttaagtcatggggagatgttagaactttctgagctgtgaagtgacaagttttctatttaatgtctggctttaggcccgtgattctgaaccactcagaaatctagagcttttccatttcatagttacagtatccattcctctctgcacacattgttagaatcacaaaacatgtgagaaagctatccttttaggtgtgcattgggaacacaagccctgtgaaattggaggctgctgcctgtgtctagcaagtctgctggtatttgccaagcataagaaaatggactttaattttcacatactataagcatttgaaacatacgtagtggtactccaatcatgtttaatcctatactcactgcagactggatgttttcaacctaacaggtcctaattttcatattggccatagtgacttttttttttttttattttgagatggagttttgctcttgttgcccaggatggagtccaatggcgcgatcttggctcactgcaacctccgcctcctgggttcaagcaattctcctgcctcagcctcccaagtagctgggattacaggcatatgccaacacgccaggctaattttgtatttttttagtagagacggggtttctccatgttggtcaggctggtctccaactcccgacctcaggtgatccacctgcctcggcctcccaaagtgctgggattacaggcatgagcccacagcacctggtctggccatagtgatttttaaaggggatgtttatcataatatttccacaactgatagtttctcagtaaatttattattgatttggcaaaatatatatttgaataaatactaatcatagaaatttgcctgcattctttcatattgctgaatggctccattgaatactttaggaatgttatcaatgcagattataaatttttgctaatgtttgacaataaatttgttatatttgtttgcaagattacatgctttttccagagtctcctaatcaaatagctttaacagcaaagaaaaaaataacacaattataatttatctgatctggaattatgtctttgttctcaaaattaatacaaagcctaattaagagacccacacttgacaccttctcctccctctcttttactgaaaagaacatttcactgaagtattatattggactgctttatgttatgatttatggattcacattgagtttctgggattttttttacttcattttaataggatcataggaatgaagggagcaaataacagattgttatcatttaatatgttcaatttcatcagttggtgtgattgcatatgtggtttaccagtccaggatagaacaccccatgtccttgtggtattcttcctgtagatataaattttataatgaaaatgagccatgctatatcttatggttaagctccataaatcaatgactcttagataaataacacattaataaaatcttcccgagtagatctttaattgagagcattgaaaataagaatcggtcagttgtcacaaagtgtcacataacacatgtagtaacaggtctgctctcttaaaaacgcatctccatgttgttacgcaagtgcatttgtcttttatcctatccttgatctagatatttcctagacattctccccattctgtccattttgcttgttggaaaatatctttggtcaatgcattcagaaaagctttattaaaactttctttgtacatggtactatgttatacgatgcctcaactaccaggtttttcagtctgtctgatcacagttcaccaagtgggcataatttgagaatttcgagaagagccctctccctaaaatatacagtgatgcactacaataacaatgttgtggccaatgagggactacatrtatgatggtgatcccacaagttatgatattgtgtttttatcctaccttttctatgtttagatatgcgtagctacacaaataccattgtgttacaaatgcctacagcattctatacagtaacttgctatacaagtaagttcctagcctaacagcaatagcctataccatatagcctaggtgtgtagtagactgtcatctaggtttatgtaagtacactctgtgatgttcgcacaatgacaaaattgcctaatgatgcatttctcagaacctattcctgtcgctaagcgccacatgactgcattttcctctcttggccagcctaacttagtgtcagtgattaaaattttttctttaagaaatagtatattttattgagttaatctgtattttccctaaatttatcaagattaaaaaaagaaaaaaatatttgaaaacagaatgaaagaaaaagtatgtgaaaccaagggtgagaaaggtagggaaaaaatacaaattatgaagtcctagaaacttattagtctctggaaatttattagtgtttgtctctgatgcttttttatattttcagcaggggagagggagacagagtgagagagggtgggggaaacaaagagggcaggctcagttgcttaaataacaacacattttaaaataaagttatgtagaagaagcagaaccattcccctttccccatggaccctcataaagaaaataccttgtgatatagtgaaatggtaatttcaataatgttctaatagtaaaaccagcattgagtgtgatagctctgtttcttagtgtcctttaatatagtgggacctcagaacaactcaagaaatgcatctgtacaagataccccattagagagtaatcagagagtaattggtcctctaagttacaacactgtcctggggccataccttggaaagataaagatttaggcatgaacaccttggtgtaaagtagtttatgcaagttttttctaatacaatcattagagtagggctggctttctaagttgaaggccagagacagaaagaaggctgccctggagagattaagtaaaagtcagggatttggggctgaaaacaagggcaacttaaaaagatgattacctcagtgtccttcttggagctggttgtgtacatgaatagattttaaaaatgcaaaatattctaagattaagatttaccagcgccaagaaaagagactgtaggaaaattttcattagcaattcctgagtcattcatgctgtggaatacatgaaaaaagaagtttatcaagaacttccaagtacatacgtagatccatcatttgaataagagggggattaattctatgtgtgtgcctgggtgtggtggggagagaaaatggggagggacagagatgagaaatatgtagttctacaactacactcaagaatatagatgaatcttgtaaaacatgatgtcaaatgagaaataagtgagactcaaaagtacatgctttatgattgcgtttatgtaaagtaccaaaacagataaagctaccctatgctgttacaggtaacagtagtggttaccttgggtatgggaatagtgattggaagaactagagggggctttgaaacactgctgatgtgttctgtttcttgatctgtgtgcagagaacttgtgtgtgctcagttattcatcaagctgtacattgaccatatgtgcacttttctctatgtatattatatgccaacaaaaaaagtttttgtttaaactatacaaatgtctctcacatattaaaatattgctaacttaattatgctgctgctatcctttctcaactttccagcatgcaggtcaaaatgtgatcactatttccaaagaataagataattatcattggattccaattctctccctctctattttctcacagaattaattatccaacagagtgcaggcacacctcattttattgtactgcattttattgcactttgcagatattatgatttttacaaactgaagttttgtggcaaccctgtttcaagcaagtctatgagctctgtttttcaacagcatgtgctcatttcatgtctctgtgttacattttgttaattattgccacatctttaaacattttcatgattattatatctattatggtgatctgtgatccatgatctttgatgttactactgtaattgttttggggtccttcaaactacaaccatagaatctgacaaacttaatcaataaatatgtcctgaccgcttcactgaccagccattctctatttccctcccttactgtgggcctccctattccctgagacacatcaaagttgaaatttcacccattaataaccctacagtggtctctaagtgttcaagtaaaagagagtcacatttatctcacttgaaatcaaaagataaaaatgataaagcttaatgaggaaggcatgttgaaagctgaaataggttgaaagctaggcctcttttgccaaatagctagccaagttgttagtgcaaaggaaaagttcttgaagaaaatgaaaagtgctactccagtgaacacatgaatgataagaaaccaaaacagacttattgctgatatggagaaaattttagtggtctggagagaagatcaaaccatccacaacattccctttaagtcaaagcctaatccagagtaaagccctagatcctttcaattctacaaaggctgaaagaagggaggaagctgcagaaggaaaggttgaaggtagaagaggttggttcatgaggtttacagaaagaagccatcttcataacataaaagtgcaaagtaaaacagcacaacgcttgaagtggaagtgatgatgtaaaagctgcaacaagttattcagaagatctagctaagataattgatgaaggtggttacactatacaacagaactttaacttacactaaataatcttctagtggaaaaagatgccatctaggacccccatagctagagaggagaagtcaatgcctggcctcaaagctccaaaggacaagctgagtctcttgttagaggctagtgcagctgctgactttaagttgaagccagtgctcatttaccattctgaaaatcctggggcccttaagaatgatgctaaatcaactctgcctgtgctgtgtaagtggaacagcaaagcctgtatgatagcacatgtgtttatagcatggtttactggacattttaagcctcctgttgagtcctagtgctaaaaaaagattcctttcaaagtattactgctcactgataatgcatctggtcacccaagagctctgatggacatatacatggagattaatgttgttttcatgcctgctaacaaagcatccattctgcagcctatgaatcagggaataattttgactttcaaagagtattatttaagaaataccttttataagtctcttgctgtcttggatgataattcctttgatggatctgggcaaagtaaattggaaaccttttataagtctcatgctgccttggataataattcctttgatggatctgggcaaagtaaattgaaaacctttaaggtaagagtcaccattctaaatgttgctaagaacattcgtgattcatgagaggaagtcaaaacatcaacattaataggagttaggaagaagttgattccaaccctcatggatgactttgagaggttcaagacttcagtggaggaagtaactgaagatgtggtggaaatagcggggaactagaattagagatggagtgtgaagatggaatggaattgctgcaacctcatgatcaaacttgaatggatgaggagttgctgcttatggatgaacagagaaagttgtctcttgagataaaatcttctcctggtgaagatgttgtgaatattgttgaaataataacaaatratttagaatatttcataaacttataaacttatttgatgaagcagtggcagagtttgagaggattgacttcaattttgaaagaagttctactgtgaataaaatgctatcaatcaacaccatatgctatagagaaatctttcatgaaagagtcaaccaatgcagcagacatccttgttatcttattttcagaaattgccacagtcacctcaacttttagcaaccaccaccctgatctgtctgcagccatcaacatcaaggaaagaccctacaccagcaaaaagattgtgattctctaaaggatcagatgatcatgagcactttttagcaataaagtatttttaaattataagcacattgtttctttgacatagtgctactgcacacttaatagactacagtacagcataaacatagcttttatattcactaggaaaccaaaaaatttgtgtgactcattttattgcgatatgcactttatggtggggttctggaaccaaacctgaaatatctctgaggtatgcctgtatttgttttcccctgctgtacaaaagtacaaaactatgtttaagtagcatgtttaattcttgatgccattattaccacataacatctttatatttttatacaaaacacctcgccgtgagagtttcttaaggctgtgcttagtgttaactggaagccaatgctaatactgaaaaaaaaaaaagggtgggggaattggatttgggatcaggatgtagataggcttcccagaatttcaggaaaaaaattcagaacaggaaagagcatcttgaagatataccataaaaagatggtctttttgagtggtatagtcagtttctaatttaagagtaatttctctctcagatgtgttaaagtgtaaaaaaaaatctaataagatttaacacttcaaagtcattaactaactaattaactaatgaatccacacaacagctctatgaggtttatgctaaatatctatcatttcacagatcttgtgtcatttagaaactcttctagcttttctcgtctctgctcttttcaaagtctttaaaaagaacgaattattttcatgtctccagtgaaggacatgtatcaaatttgtctcttgagaaaatccaatgctttgtgaagtaaatttccaaagccagtcaattaactcagtgcttttcctattaatgtgactccaaatttctgatatcccttgccctgagaagctattttgtttgccctgggaagaaagaaaagtcaacctatgtgcctgcacattataggtgctcattaagtgcccattggaattcttcctttgtaactctttgattaatttgcttttgcttaatttagccatcatttcacagactctactggaatttttaaaaacataaatattgatattgtgttttcttcctttaaatgcctaaattatttcacactagaaatgtaatagttactaagttctcagaccattttggtttactgtaataacaatagcatgttctcttgagtgctgagtatgggaaggtgtgatatgtccatgtttggggtagagaaaggaaagagagagtgagaaagtgaggaaggagaaaaaagggaaagagagagacacatgcacacacacgcagacacacacacacacatacacacacacagagagagagagagagagagagagagagacattatggcaatgttttaaagagagatttgtaggataatggaactaatttctcaagtaatgtttataaaatggaaatgatgttgaattactagaagaaacacaatactaacaacagaatttttctgttgtgttgctgaacaacattgttacagaagaatacttaatagagcaagtccattaaaggatattaataacgggcttgcaaattgctggtagatccttttcaggtttgatttaataatgattggtaagcgtcaaggacatttaatcattttttatatattgcagacttggcaatttatgtgtttaatgtgagaatttccacttcaccacttgaatcaacttgctgcattgtgaaaatatctagcaaacgacaggagaaaactaacttttactgacacctgctgtgcctgcaaacatatgttatctcaatttatcctcaaaattgtgctgggacatgaagtattgttcccattttacagatgaggaaactgataccatgccgtgctaccaggctaaccaaaactgcascccaggtttatttaacttcaggtctagtggattcgaagtctacgatctccctcctacaccatgaaatcaaagtaagtcttccacgaacagacttaatttgaaaacctttaaaactctgccggcccatctatcttaaagtggtttttttaggtcatcctctgtatatgctgatgtactgatataataaaaacttggatataagaacctcttttgtcattttttgcttttgtcttctaagatgtcatttgtgtgctccctctttcagccacactcagctcacgcggcttgaattctggctggcacgggcagtgcggtcaaggctgcagctgttagcatcccctcctcccatgctcatcatgagttctgcaaatgagccctgcagactgatatcgtgttctgcagtttatttgacaaatagcttttatggcctttgattttttttcaratcacttataaattctagcaacagacaggttgtttgtcagattcaaattccatacagttgaaaggaaagaggtgaagattcctgcgttcaaagtggactctaaccttaagatttatttgtaaattttacttaaaattaccttgagaggaacctaagatattctcctggcagtgcctagttgcaaattatttctatccttatgtcataaatcttgataataagtcttttaaaatgcactcgagaaatgtattttgtgtttatagtgctggattttagtgagtcaaattgtgttcaggcagtatgtttgcctcttcatgttctgtgtgacactggagtaaaatggagacttcagtcattcagctgcaggctctaagaaagtctgttgtaactgtgcattttaattaaccgactcagctgaggaaatattgtctctctactgtggtgwagctgtctgccttgtaaagtacctccctggataaacagaggacttttatttcttaaactgcctttcccccatcgtctttaagagtatgttgggctttcttttttttattaaattacaggtggagaaggtttaattaactctaaaatgattcttcagcaaactcagttgcatttttttacaacactttgagctacgatatagttactgcaggctgcatactgttattggagcatacagaaacatttagaaacctaaatctgttttgtcatattaccagagatggcatctgcacttgggtacagttgaaatacaaactgaagatcagataagtttttttttttgtttaaaccagtcagtgggctactgtgaactgagctaacaaaatgggaataatttagccattgattactttgtacaacacactgctggatcttaaaactgagttgaatgtgaggagatagtcatagttcaaggagttatatgcaaatttgacctctggaaatataatttgtgggtttcatatttaaagctgctgaatacattttgtcagaaacctcttgcttctatgattaattatagattagttaaccactggacttcttttattcagtcatcatgagacactctatgcaaaatatacatatattttttaagagacatgatcttgctctgttgctcaggctggagtgcagtggtgcaatcgttgctcactgtatcctccctgggcttaagcagtcctcccacttcagcttccaagcatgtgccatcacacccaggtaattttttttcattttttgtagagatgaggccttgctatgtttccagactggtcttgagagctcaagtgatcctccttgcctcggcctcccaaagtgctgggcctataggcatgagccacctaccacacccagcctatgtggaatttttgaatctaaagtagattaatgcaaatttcagaacaacgttttccatcttttcaaactatgcgctctggagcccaagattctctacctaagttggaccaagcagattccagtactgaaagcaaaaacaaacacaaaacctaactacttattttactgttcctctttaaaaagaatgaaaacaaagaagaattaaaaaaaaaattaagtaaccactgggtttatcttaagcaagatgcgtataggggtaaaaaatgatgcagtgaccacagtgaaaccatgaagtggataacaaagagagaacttgaggattgcagttcttggaagattgttacaagtacaatgaaattagtttggaatttcaaatagaaggtaaaaaaaatggactgcaaggttctcaaaagtccttataactacaagtttttataactaaagtgaagttttatttcaatttgtttatcacgtatgttccaaaaaagaatccactctgtgaatgacaaagtttactgtggtccagaggctgacagatacttcacatgaaaagggatatggatggtctgtaagtctgccctaccttacaaattgtaattaaaatgcaacttaaaatatattagggaagaggtcatttttatttctaaaattaaactataatttacaaaattatagttcttcatttataggcccaaacaaaagagttgaatacaaatagaatttttccctccttttacattaaattattagatggtgtcattttaattattgctttcatgagagataaaactattagtattttccttttaactcagtytgaaggcatatatccaagttgtatggattgacttaaaagttggatagaaagaaaaattgaaagaaattttaagtggagatgagaaagagaaaaagaaatgtagtgcaaaggaataaaggaatgaacagaagggaggaaaggagagactcagaaaagggaagatgcttcagttctgtatgatctaacatgccttctgcatgatcagcttttaggaggtaaaaaagatgagcattactacttgtcagcttctgagtgttggaggcctccagtagagtagttactttggaaacgcgtaaaatcagaggccaagacctagtttctgtcatagcgtagggtgttcccttggtgtgggtaagagaggagaggcctcagaatgcatctaaagctgaatccttgcagaactggggctgagataaggagacatccaagctaaagagcaaaggacctttctcaggaggatgtggacggggagagatcacaaatgtatggcttttaaacaaacgttgactacctagcctctacaaaaatgaaggtgtattcgcagctagacttaaatattatttctttgtctcaattttttgtagctcttattccctttaacatatccctccaaatgttcatagctttggtaactatcacaggaaaaaatgattggtagattattcacaacacacaagcaatttaaatcagaacatgatcctttaaaactgtattttcctaagaatacgattaacctttggacaatatgggtttgagctgcatgagtctactcacacgtggattatcttccgactctgccaccctgagacagcaagaccgatcgcttctctatctcctcctcagcctactcaacatgaagatgccaagaatgaagacctttaggattatccatttcgcttaatgaataataaatatattttcttttccttatgattttcttaataatattttcatttttctagcttactttattataaaatacagaataagatacatatataaaatatgggttgactctttatattatcagtaaggcttctggtcaacaatatgctattagtagttctgggggagtaaaatattatatggatttttgactgtatgggagggtttgttctcttgaccctcacattgtttagtggtcagctataatttttgaagcccgttaaatggtaaatgagaagagtgtacatagtgaaaaagtgtatattaaattaaaactaaaaaaagtttttatgactacacaaagaaatataaggttgatacaattaagtttccatagagttgaaatgtttactgtagattgtttgcaataataacttcataataatgaccagaaaatcaattcaacaacatctatcatgcataaaagactgtatcagccaccattggaagaagaaggaaaagaagagattatccatttcctcaaatcgtgatacaaaccccttaataactctaacataaggtagactgtgatgcagtctctgggagagggggaaaaaaaacagaaaagagggaaggaaaagattaataagacatctggagtgagcagaatttgatctattctggaaaagctcagaaattgactggaggacttgggagggaggaagggcawttctcacaaaggaaattgcttgatcaaaagcacagagattgggaagcatgggctactttgagaacctgccagtggtagagcatgggaaagggtagggcaataaaggtggttgtagctgggctttgttgggaggctgaggacattggttttatgtactaccatcactcttcagtattaactacgtgcccagatgcccttgagcttatggaaatttagattctatttccggaaagtccaccaggagtctgttattcaaaataaaaataggtagtgtaatatgactttcaaagcgcattrtggtactgagatttttagcagttggaactaatgaagggaaggagaaagtattatgtgccaacctttgtattaaatgattttatctacatcatctcattgaatcttcataggatctttatgagtattagattatatatgaaatgtaccaggaaaaatatttaacaaatgctgattctttgccttcttgcaacaatcccatgataactacattgttttacacatttttattaggatgacgatgttgagactcaaggtttcacagttactaaaatcccagaaacagaattcaaactggatccatagtccaagttctttctggtatacaaagttgtctctccatgaaaaaaatttaaggagaaagactttgtataatggcgattcactgaaaaaaaaattctcaaatatagtttattgaatgaaacatggattatttaccctgccttggctcctttggaaaggcccaaactcatgtttgagaaaaatactgaggaatctatagaggatgatttcagagtgctttacaaaggtctttgcctaagaagaactttccccaaccctgctggctatgcctgctcttaatatataactttcttacctttagctgaagactttcatctctatttaaaggtgagtgcccttggaagggacagtaatcctgctctcactctgggagcagatatttgataacgcataagaaaccaagaaagctctgggcaccactggatggaggaatttcaatatggatactacttccaaatagagaaaatacatggaaatgggatgctgagaagacacaaggcagacatctcagagttgactagattgcgctgtagagttcaatctagtccatctgtccgatgactccaaccatgaaactgaccctgtgactttctgacaggatcaacatttgattgggaattctagaaaaacaggcaaggcagtgcactcaaagaattaagatctgcaggcagaaaacaacagagaaacaaaacagaacaaccaaaaaacaaacaaacaaaaaaacaccaggaaaacctattagaaataggaaaatagaaggaatgtcagcttaaatttaagaatgtgatggcaaacttagaggagggtaaattagctttcaagaaagtgaattacaggatctccatcatttgggattttttttttaacattaagaaacgtataatgtgagcttttggctattttgaaatctactttgactttctcttttcgtctatatctagcttaatgctcttgcattttagtgtaaactaataaagactccacacatctgtgtgtgttagaccataaaagtgaccagagtaaagcccataaaaatatatgtagatttttacattttattacttagtcctccctgtaaaagtccaaaagactaaacacttactgctttttaatgaatgacatgagataggctggagtgggtgccacaggctggaaggaacactatactggcagattagactttaactagcagagggatgttctaatggtaaatcatcggaaattatttcctaaagggatctggagatgcatgatttggctttgagaagccttttgtgggtggggtataaattattttagagcagtcctataaagaagtgaaaatgtataggattaatgagtgaaacttacaggaagacagactcaatataaagggctctgttcttatattttaaggaaaactatctgagtttacgaaacgcataaaacactttttatcaaatcattagataatatatacaaattcctggtacataataaggactcaattataccaaaatatcttcacattataggaaaaatattcacctaataggaaaatatatatatatttttttaggcatgtacaacatacgtaccttggtggaaatacaaatacgtatgtaatatgtcctctgccatattagaaagatctttaaatattccattttaatcataattcagtgatgttacctaaccctctattggtgccagtaaacaaaccaagtatttatacctttcacattaaaattttgaatacattaggcaaaatccctttcataaattgacaagtacatgccaacactaatctcaaagcgctgaattttaaacttcttggagagttttcactatggtaaacttcctagagttttcaccgttataactattttcactgttgtaccttagagaggtttcactgttgtaatcttgtcacacatttatcagaattttaaaagctactctactttttcaatatcaacatgatgcattctacaagtttcctttaaagctcttgtgagattctggttgactgcatcaaatattaatgagggaaacttataggaagacagtcaatatgagggctctgttggtaagcatattctttcttttagaaagtacatagatcaatattaatgacaaggagcacttttttagctacatgagggccacccagttgaagctatgaacaccactcaaggtagcatagcctcatgatactgtagcttcactgtctgatgacattttcattctgctcccacttcattaataagctttagcaccaagaatgctgactaaggatttacatttaattgaagtcattgcctccttactgacaaaatgtattttccaccctgcatagatgtaattgatgtgatgaaatgtcaacaaaaattgcctttgctaaatgtagtatttgccttactattttatatgccaggccaaaaaaactatattttacccttgagaagacaaaattctgattgttggaaagagtgtttctgattggtgaaatatagttgagtacccctatacataaagtcctatactttgttttctaggaattagctaattaaggaggaaaacagtaagctttaatactttgtaagactgtaattcaactatatatcctgttttttcaattgcaaatcataatatactgtagaggtgttttatagattgtagaggaaagagaagtgtcagccagctttaaatttgttttatgtcctaatatttaatgcaagtgtgtaacttttcttttggagataatgctgctcttttgagccaaatgactgaattgtgttggtttataaaggaagacattttttggtgatataggaattacagactctttcaaataaggagaacaatttaagagtgagagaaaggataaatgagaatcctgattgggagaagtgagagcccttaaaaataaaaagaaaacatggagaattgttaataaagttattaattatcattacaacatttgctggaaakgataagatagaagctgtttttcttttttttcaataaaatggattattattgcttatagaagttctgttgttagaaagtataattgtaaaatacattgtacttgcttggtcttatatcatgtcccagatattcctgttctctctgtgttcctggaattttcctcacgtgttcaggatccctaactcaagagcgtccattcatgaccctatgaagttaaaatgtcagaaaactcacaactgcttccccacctgaaaaaccatcatcctctctctgatctttagatatgccataggaactcagctgtcaaagaggaacagtctgtgtcttcttaaatgacaaacattttgaaaatacacctgctacttcatattggtaagagcagctacatccagcggaggaagccttttgtcattctttgatgaattaatgatgtaattttgcataagcaatgacatataaaaggaagtccctgtacatttatacccctttttatccagtgatttttcaataattataattgataaagtcaatagtaatttctatactaagaggagatcttgggcacagtcttccactggagtggccaggggagaaacatcagagcagatatcatgtgactgatacctggaatgcgtgctaatcctacagtaacatgttatatgcaattactttttgctcaataatgatgtcatgttgccatataaacattatattgatccagtgtaaagtcaacaaggattgaacacaatgatactagaaagggagtggacaggtaaacgtcctgattgaaagcccttgctatagttgcctgatctgaaatacaagtagaattttcaatgtgtttgataattatttgttttagtgttcgctggtcggtgtctttatgtctgttgtacattgtgataatcagtataaaaatcatagacttagataacatgaggtggaagaagctgtgcctatgtgaaaacagaaagtcaaagacgatgttctagacttctaatgatgtaaaatgggcttggggttctgtaacatggaggttactgatttctttttggctcatgccaaacatagaacaacaaaccccactcagtatctcactaagggctttttgaaaagaagaggtagttgccattttagagtttacaaagtacttttcacatttcgtcctcccaattaccatgagcagtcaatagtacacatctgtgttacatatgagaaacttcaaattcagaaaagccaggaaatgtacctgtgatgacttgattagcaagtgtcaaaggaacttgaatttaggtcttaatttctaaggcccrtattctaccatgcctggctgtgatatttccctcaaatgcaaaagaatcataaattattgttatttagattttattggtagtattaagtatccaaaatcatcaccaacttttggaggctaaaagaatttgggtccaattctgtaggctattatgattaggaaagcagtgactttcacctatgtattattattatttctttaattcatttttaattagagctatttgatacaaactatttaacatccatccattttatttctcttaaaacttgtgtcattcaaatttacctatatattctgttgtgctcattgtttcccccaactgcctctgatttttagtgtaggtagctaggagaatacaacaatagcaaaactccgtgggttagctacagatctggattctaatgagaatccagagcaaaaaggaatagatgaagcaacacagattctgaattttttatttctcatggctcgattcttacttgccatgtctggaactcactttatctcaggcttcatgacctgatgcttgtttctgatgcagtctaatccacactttaaataaacgatttgagttctcattttggtaaatgtcaagggaagaagagatatttcatgcacctacagcatcctaaaacctcttgccaaatccatgaatctgactctgcattatccttccccagaaggagagcataatttcattatccatgaatcatcacctcttagactgtaacatcattgtcagagagcctaatagaaccagtgttcagctggctgaaaagggggagggagggagaaagcgctgaggcaaagcacaggtcactggcacaatcagcaaactggagagttctaaagccggaaggggaggcccccctcctttgacacctttgacatatccctgaccagtaaatgactgatgctgactcttttgatataatattaaaatttgtttttcctacctaaattacatgtatcttgctgatgaaaaatattaacccctttaataaaaatatcaaaatgcttagccagcatcgatgagtataagcactctaaaatatttcttatctattcttattgcgttattactcgcttttcatcttggacacttatttctagccttcagtaccaattctatggcctctgttccagcattactataaaagtcaaaatgaaaagtataacattcaaaaattacattataattatatttcccaaggaaatgaattaaataaaattcaaatctgatttactagtcaaaaaacatgttgtaaaccacgtttacataaggattcaggataaaaagctaaaatgtgtgaatagctgtggttagtctaaccagacactagaggtcactgctgctccatagaaagacaatttactgcctgtctacttaggtagttcactcaccaaatcaagtaaaaaattgtttaaattctttgaaaagatgtaatgtcaacrtccttggaaaatacaaactcatttcaatgcaatatatcttgcataagtattgcttacaagactgtggcactgggactatttaactacatgctgtggtagcactrtgtgtactggggttaataaaaatggaaaaaaactcacatgaagtttagagactaaatcccatttcttctctgttttggtaaagcaaagtattctgtgttctgttgtatagttcaacaggtcaggctttttttttttttttttttttaactgttgtcacctttgagggaagtccaatattttatgtaaatacgtactagaaaaataaatatcaatcacatttctctaatctgcatgaacttgaaatacttatacaaatagatttatgatatgtagtccagaaagtaccatgggatggaggtgaggcaacaacttttgagcaggagactggcagttggcgttttaaaatttacagtggtaaactagttattaaatctacaaraattatatatctgtgctcagaagatactgagaattacagaagattcattctcaaagagtgaggagaaagaaagaacttttttcccataatttcatgtcccaaatcaaaatgagttttaccacctaagggattttattttcgttcttatctattattatgtttattagtaaagttaggcattaaaaagtgacagctttcaaaatattggtgattcatttagtgttatatcatattttatattccaagtagctttgaattttaggaatgcttttcaatacagcaagcatattttatatatactagtagcaccatggcattgagaatttgcaataattcaaaaatataagtattccttgcctaaatatatttggtatccatcacaagtaaggcagaaggttaagtgaaaaagaatagaaatggggttcttcactttaagactgcatttcattaatacaaacatctttagtacagataaaaatgaggctagccaaagaaaatttctttttaagatggaatatgtatttactgatgctttatgaaaaatgtaaagttacaacttcagtaaaaaaatcacaataagctcagtcatccagtaagctgtgaggaagtatctgcattattaatccattggaaatatgtgactttttgtcatgaatacatgtatattcaacaattattcatgggtaaacattgtaactaagatgtttttctgaagtggcatctattgtaagatttaatcaatatcaaagtaccttgagaaatccactttaactatttctttttctttattgcttataaaagtatgattttaatratctggcatccttaaaattttattttatggtgacttgcctagatttttcctctcagcatatgaaaaacccccaaacaataaaaaaaaattagtaaaaatagccattcactttttctttgttgctgcagtgattctgttttcagagaagagggacatggttaaagatgtaggggttggcaagccaaattaaatgaaacagcctcaatgttgcagttcctgatatttgcttctataatagaactgttcattttggaggatgaaggagaatacagactaaatatatctttctaaaaaccttaattgactgtggttcaagttactcaaatatggaagctatgatattcgtgctgcagtcaataaactttcaccaatgacataaaaacatgcatgcagcttgcagattgccaacagggtctgtacagaactgtactgatggatgagttcacaatacagatgaacgcagggacattgtaatgtcagcaatagaaaagcaacagagaactgtcatagtgttggtcttttttcctctaagattcgttttrtacatttattaaggtgttatcaaagtcgtccttttcaatgaggctgtgggtggaaggcacgtcttggaatgtgttctctttacacatctgaatgaagtgtctgtcattaggggactggtgtgtgcaggacatgtaatggaacacaacagggcagcctgacaaattctgaacagaacaggacagagctaaggattctactaactacattagggtcttcgaaaaaactggaaagagaaattctggtaagctctcaaccacatgcctgtagcaagctgctytcccattcgcgaaccttatctgaaaactccctaactaatgtgaggtgtggtggagaaatctggcttctcaatgctgtttcatttatttatttatgaaacatacaggctagaagaaattggcagtgaaacctctagtctgattttacagagatgggtttcagagacaaggctgagtcgaaaactttacatttttgtcatctcctcacattttgcagttgtctgcttgcagtattttaacccttcatcactttgtccctgtgcttgccttactgtaattcagacacctctggaaactgctcagggtgctgctttaacctagcaccatcttttgatagtttcctgcaattttcttttctaagtcaggcattggtttaaaggctctgcctgtctgtaaaatgttcccataactgagtcatctccaagaatcagctcaagctccgagcacctggaatcattcacctctttccttgatttgccagtgaggtgcaaaccttctataactgtagatttggtcccaccaggaggctaacagcgaatgtgggggattacttatgaaagaagttttatcttaaaacaaatgcgacattaatggaatcagtaaagggtcttatacaataggtattatattaaaccggagttcaagcttcacrttgattgtggtatttaaatttcaatgggttgattatgtatgagaggaaaatgaccagtattatgaatgcactaaaacggacaaggaaggatcttgccagcaaagtgagagggagagggaaggggagggggggcatcgcgttcccttgatagtcaccagagttcaataaagcaccacttatttcccagcttttaagagctctttttatcacaatggttcatacctcacactccctggagcccgatttgttataggtgcagggtcccgtcccattcagcagcatctcgctggtctccgtgttggtgggtttataatctacataaaattcctgggtgctgggagtcatttgctttagggactgtcttttctttttcctgtgccttcgcatgagggagcgctgctgcagctgcttcatgctcgcagggtaccgcttccatgacacgtagataaccagcaggatgacgagcacggacaggaaaagcgccacgctgcccgcgatgattttatggaaagagatgtgctcggcgtcagcatcggtctctgggccgggctctgtggctcccaccgtcgggggcaaagggggtttgctctcatgcttcggcctggggagcttgggcttaaacgtcggctttgggagagccctggccagatcaaacctctctgtagtacttttgccacagatgctgtagttcttcactgcatcgatcacatttactccttgcagctctttgggactggcacagataattgtattctcccttagacctttaaaacttttcagccagtttacaagggagcaaatatttctgctgcattcccatatattcccagcaagactgatgtcattgagggatatccaagaatccaaaatctcttgaccaataaatgtgagcttgttggaatccaggttgaggcgctgcagattcgggacacactggaaaacactgggtccactgaaagcttcgatctcattgcctgataaatcaagcctttgtaaggagctccaggtccaggacatggtctgtcctatgacactgattttattccactgcaagtaaaggttctgaaggctgaccaaccttggaaaaagggccaggttgagcttggaaaattgattgtgctccaggtgaagttctttgagtctgatcatgccagcaaagacattcctggctaaacttcggatccggttatatcccaggtccaaaagttccaggttgcggcagtcttggaatattcgcacagggatggttctcarggagttagaccgtaaatgtaaactcagcagcttccgcaagccccgaaactgttcagatcccagagaatgcagctgattataggacagatccaagttccgtaaatttgtcacaggtctgaaggtattgttaagaaaataggagattctattggaactaagaatcagctctttgagtctgcgtattccattaaaagcattttcgtcaatattgctgatatggttatggtcaaggtatagccaggtgagctggttgagccctttaaattgattatacttaagtttttgaaggctgttatagcgaagggacaaacctaagcaaccagcagatatacttgagggtatctcctgtaatttctgagattcacaatataccattttgccttcacacctacagcccttagggcatcctcgttcggcagaagaaagcattgtcagtaagacagtgggggctataaccagtgctacagctgatccgctcagtagcctaattacattgaaacctggaaataaaaacaacttagaaaagttatccccccaaaaaagaattaatccttaatcaagcaaaaataggcatatatttttcatttttaaaaatttaaatctaaataacacttaacatcacatattatctctttgtaattaaagagaattgtctttagkgttttgtttttttaaatagttaaacamggaaacatgccactaagcaaataaattcatagtcttagagcagagcaaggtaatctctaaaataattaaggcagaattattacacacactagaggttttttgttttttgtttttaagaaggaaagaagaaaaatgacaaaacatacccatcctttgtattgttcaaaggtcgtccttaggtcttttgctttggcttaggggccagttgcatgacagcccctgtcagctgcactgtagtgagtcagggctcgctgacacccaggaagaaaaattggaccccttgggagatggaccgattttggaacattattctttgccagccacgcagaacactccaagaacaaataaatcccaacaccgcattcgcagcaaaacatcaaaatcttcctaggtaataggatcttcatggatattacgtttttgcatctttacagttttttggggggtggggagggggcggttaaaaaaaaaactggatcctacaatttcttcttatcgaaaaacatgatgtattcttccaggcaatttggggctacctgagctgccacatctgtattccatascccagcagttcccgtgatgagcacccagttcagccacagagctgcgttggagcccagaaggcaggagagccccgtaccgcgcacacgctcagctcacttctgcagactgtcattctgaaagctgctcggactgttgctttggtttcagtgaatgcartcttatgtaaagctgcccccagtggtgaagaacattatgggcatgtgcagaaatgtctctcttttatcttgcaaatgagcaggctctctgctggaaaatgaatgrttcttttgggtggctcagtaggaactgaatggtcaccgtgatcaataactagcaacattttctgtgatttccaagtcttgttttacaatttggcaacgtctttattgtctgtgtccacttaattgctaaacatgtgctgcccagagtttttctggagcttgacattaagttcacagaccgaacgtcaatttttcttaacctcaacgcaggctttaaactgaaatttataaaatgaattattgagcttttcacagagaagcattaactgcctgcccatttgacctcttggagtcacagtgattatattatgcaaggtgtctcaggatgttagaacacaaacattttggaatagaggggatgactgatgacaagtgaattaatgtgtccaatagcctttccggttttctcacagacgatataattgattttatggctatagtttcgtttgttgttttggttgttgtaattctcttttaattagaagggaaataaaccatttttagtgttaggatacgaatcaagagatcatttggttcatactttattgatgttgctgctatttattacactaataatatttatggagcactttctaagtgctttaaatgggctacgttgttttctctttaaacaatagtatgatgtgggtcctattataacctctcttttaaagatgaggaaacagacttggggaggtaactttctcaaggtcatacagcaagcgagtgctagagctgagcttcagaagcgagtcattcttatgccgaaccactaaccactagatgatcctgttcaacaacattgttatcttcatttaaaaaagaagtcagtgaaaatgaagccgattaaaggattggggcaaggaagctgtgattagcaaattcttgcttgttctattagaattgcctaaatttcttttggtctgaggttcctaaagaagtataaaaactaaggcagcgtagtttagtgattaacagcatagattttggcacctagattccaactcctggctacaatttaccagctatgtaaccttaagcrcgttacttaccttccctatgcctcagttttctcatctgcaaaacgggcataaaaacaaaaactcacttcatgttttgagaattaagtcattttaatatctgtatgttacttagaacagtgtgttgcatgcaataagcctgtgtaagatatttgaataatattaactttatttgtacttgctaggattacgtactgaatattgactatactgaccttcattaactcacaaagaacaactttagtgagcatttttaaatattgtacatggtggatttctgagatttactcagtcttgccttctttgatgagataacttcctttatgttcatcatctgaactttatctttaaaataaatcttctggttctgtggaycatractaataatgttcgattcttttcatctccaaagtagaacataataacatctgccatgtagaggcattttatttaaaaataatggtattcttgaaaaagtttgccttgttgttttttgttaggtgaactgtctgtggaaaaccgtggagagctttcacattctccaaggatgagatgtttgataaaggctagtaatgacaatcaaaaggggtcctacagatatagtacaatggatattaccaattccttgggcagtatgttcttaatagggcagtgctttcccccagagttacctaagctgtgaatgcacatgaaacatccagtgagtttcttaaaaagatagactgcccaatccctcccccaggattctcattctagggggatggaagagtgtgtgcttttcaatagtctctgatgaaataagtttaagaaactcactgtgaaggaatgattaaaaataatattttctcctagtaggaagagagggtttgcacacttataatactgagatgtaagttccacaaggacaaagacaatgttttgtctacttcatttttcctaatatctacaacagcacttggcacattgcagacatgcaataaatagctattgaaaaaaatatgtttttatatcagtcacaagtacaatggatatagtataactgattatgtaatgttcaacatttgtacatgggattgagtcctgaaaatttcctcagtcagtgagactggaaacaattttggagaaagtattcttaaaggaggtatatacaaagacaaaaactagaaagtgagaaaacttagttgatcagaaagtgatctttacttttcacagatatcttgtcttcatagttaaactacaaatttcatgagaacagtaaatatgcttttgactattctcctttgcacagcacagaagggtaatactgaacccttatcatttaatatcccaaatgggcttgacaacttgtatctctcaaaaacagactaatgagaattatattgataacttctctctcacacctctgttgcttgaaaggctctgagttttcccctcactctcccacgtagtcattgagacatctgttttgcccaagagctgcagagagccactccaggaggctggaggacccattaactttgtgcttcttgctcatcatactttacttcccattgacagaagaacagaggaacccactgagaatgtgggctctcactttgcttttcctgggataaatcttcttgaattatttacggtgaatattattctctgctgtgttacacacattgctcttagttttcagacatttttcttttatcttggttcctgatcttatcttactgcatagttctgactttacacctaccctttggatcttatgattaatatttatttagtcttaatactaacaactgagggtataaaatattagartgagtaaataagacctagtattggctagcacaatggggtgactatagtcaataatgaattaattgtgcatttaaaaataactaaaagtataattggattgttttttatacaaagcgtaaatgcttaagggcatggataccacacttacccttatgtgattattacacattgcatgcctatatcaaaacatctcatgtaccccataaacatgcacacttactatgtacccacaaaaataaaaaataaaataaaaataaaacaaaactatatgacaggaatgatgtgctacaacaaaaattgctttggtagcaatgtattgattgacaaggaaaaatgttcataatgaaataatattaaggaaaaaaatactgaccatcaatctctttctcaacagtaatcagtagccactcttggactgagtcagcctccaggaactgtgtatggcccctactttggcacgaccccttaagtcggcatcacaaccaggtctgatctggttcargataataaattgtttgaagagggaagattatccatgaggctagttgagaaatccaaaacaaaataatgtgattctaagccacactgaatacttgaggctgcrgaagttactgcaaagacatagagtagtccctcaagagaaaaagaaaagactgtgttctaaaagattttagtaatttgcctgtatactttttaaaagttttttctccttttacttgtcgactatagcgagctgattatttctgatttgcctttcagcagaagcaaaattatattgcattatgtatttagaaactagcaacttcttttgcacttaatatcgcatacagaacaaaccgtaaactacctgacgagttaaatatccccaatgcatccagggccttaatgatttatacaattataaaaatagtgtcatgtatctaaagactttttattttattgtgcttataggacttcaaatagctaaacatattttgtttarattgggtaaataaatcaaatctcagtttggcaatactgccaaattttagtccaatatgaaactgagttgccagatataaacttagaaattcataactgaaagagaatggactgatatcttaacagttgttgacttcagatattttatttattttacaaatatttaatttgaataaccattgtgtgctaaacactgttccagacactgggaatacatctgtgtgcaaaataaaggcctgtacccttgtgaagattacattctaaagggataagacagacaattaaaaataaacatatacagtatattagtaggtcatatgtactatgaaaaaaaagaaaaatataaggaagattgggagtgcaaggtatgaggtgggctgagttttaaataggatggttagggccattaagaaactggcctgagcaaaccttgaaggatatgagcttgtgagacttaaatgtatatatggggagtggccagtgcaaaggcctaatgtggaagcagatcatgtgttccatgaacaacaaggaggccaatgagtctagaatggagagaccaagtgatagaataattggagatggaggtcatggagggctttggatgacattctaagaatactggctttattatggagaaaacggggagctaactggagatttttgtgcagagttagtatgtgatcaaataacctattaaaaggatcactgctgtggatcggatgttctcatttaccgtccccaaaagccatatattgaaaccccaattcccaatgtgatggtatttggagatagagcatttgtgaggtaattaggtcatggtattggagccctcatgacagatcagtgggattataaggataaaaagagacagaaatgagagagcttgcttcttctctctctctgctacaagagaaggcagctattaagaagccagaaatcaggctgtctttgacatcaggtcttctgttaccttcattttggacttcccagccattagaactgtgagaaataaatgcttactgtttaaaccacccaggatatagtatttttgtttatagaagcacagactgactgagatgatcactcttagcaggggacacagtaacgaggccaccatatcaatccaggagatagatgatggtgtttgggccagggtgttagcagtggaagtggtgagcattggttagattcgggatatatttacaataaaatcaacagaacttttctaaggaaatagaagtggaggtatgaaataaagagggaaagtaaagatggttcatttttattggctaagcaaccctagggatggtgaagccataactgttttcgtgggtcacattttgtgagcaagaccaagagtttaacacatttggattaaatctggatttggctcttgctttccttcatttttatgagactttagttcttgaaaatatttcttaatcttaagcctcaaagcaccatgatgtatttttaaatattttaaaggtagtttttgaacagaaagttatgaaatgatttgcaaaattagcccccaaacaatagcaaatggatttccattcaaatgaactagacagaggcaacatytttgcatatggccttggagggcagtagagccaaaagatttgatgaaaatctaaatgcgagattgcataaagactaggtaaggaaacatttggactcaacacatgtactgtttattgcatatgtcagttgacatttggaatttggaactgattctgtgcaaacttctttgggtctcagtttgctcatctgcaaaatgggacttataaaacctgacttataaacttttaaggatttttacttaggaaccattttcatgatttatgagtaagtacattgtacaatatttataaagtgttacagatakttctgcaatcagagtatctatgacaaaattaattttcccttgattctgtataggttctgtggccatgagcatatattaagggttatcaagggtcatgaacatgaccaaggacatgccagaatttactaatattataggaaacattcctcagtatttcttttctactaattttaataccacaaccatttattatacagaatacaccattgatattctgtgtattcgcttataaagtactttcaccaatagacgcatttgatttagcttttgtaaagagtttaatgtttgtgacccaacaatatatcagggttgtcagaatgccaatatagagtttcctacagctgtgaaaataattttcttcatttctagttagaatactcatatgcatgtctacttttgtaattatatccagatcttcatcagagcattaacacttccctgaaatatccttgatttccatctgcttgctttaagggctccattaaaaaccctgtctggtcacatatggttatgagtgaatatctctgacttagataaatgaataaagaatattccaggtctgaccattaaaatggtctctcagtgtctttctgggaaaagacaaatttaatgaatgagacattgcaaggttatccaacatgtctccctcccattcacctgaagatacatttatgcagcagcgtcaatccatattctcaggttttattgcattcctcactgtcacttcctgcaaaggtagtcctaaggtaaatatgggaatacagaaatctagccaacactataaacttcagtggcagacttatgaaggctgaaaagactatatgacttcaaggaaatacttttttttcttcctttcagtaggaaaggtaaagcatacgcaaaagttgagaggctagtataataaatatcaactccaaaaattattactattttgctaattttatttcgtcgatactcacacctcttcccacataagtgcaatatttttttctttctggagtattttaaaagcaaatcttcaacatatgtcttttttttttttttttttttaagacagagtctcgctctgtcacccaggctggagttcagtggcacgatcccggctcacagcaacctctgcctcccgggttgaagtgattcttgggcctcagcctcccaggtagctgggactacaggtgcctgccaccacgcccggctaattttttgtatttttagtagagacagggtttcaccgtgttagccaggatggtctcaatctcctgaccttgtgatctgcccgcctcagcctcccaaagtgctgggattacaggcatgagccaccgcacccagccaacatatgtctttataacctctctctctctctctatttatctatctacacacatgcacatttcaggatgcattcctaacagccttttaatttaaccatctagcattattatacctaataaaattaacaagttcttcaagtaggtttgttcgtatcaagatcttagaaaaagcccacacattgcatttgtttttgatgtatttgaagtctctttcattttgtaatgccattgatgtgttggatgccacgtcatttggactttagctttttccatgttctgcatttggtggttttcccattgtaggctttaacttgcacatagtcagttttcatggcatatatgtttaacaagagtctattcattaatttgagcagaatatccagccccaaagtggatatttkgggcatctattcattcttggtagcagtttaagatttgaagaacttttgagtaatacaggacttagagcttagagtaaagttgtacttctactttgtggtatttatgccrtcagagaattcaggaatgcgctaaatggcaagtttgagaactttattggttaacattcatatcaccaggatttctgttcttcacatcccatcacaattgcctttttacccttagcaacagcaattatttgttgttggtacttgctaaataaatctgctaatttttgtattgccattgaagtgttcatctaactgaggcacaaaaaattcttattaataggatagcaatcaaaattcatttgtagtcacttaagctgagagaaatcagttttctagcttttctttcagaacaaattccatcaagaaacatgtggcaccagagtcacattgtaaaacgtctagttttatatatattcctaaatttcctgtattttctcacagtggagaaaagacttttagagggactataaaaacctcttaaccaaatttataccttaatatttgatgttttactttgcatctatgactgtgctttgaatgtaaagtcagtcagtgttctttaaatggtatcataacattttgctatatccacttcacatgtattctgaggtgacaagagtttttgaagaaaatttcatattgtatttttaaagcactgtatataatagtttcaactggatacactggtgtgttttaaaattcgacttcctggcaattatatcagcgttaggaattaaattccccagtcaccaggaggagaaagataatagacaatcttgattttgataaagaaacagctatgccataggttggttttatttttgtttctgaaacaatgtctgatttaaaaacgtttttattttagggcccagatctgaaagatattaaacttctgacaaatgagaatccctgcatagtttgcaatgaagtagcagagaacaggagtctgtgggtccttatattactctaaaatatatcagcctatatgtcaaaccagaggatccttccttatactgttagtacttggtagctgtagctgtggccattcccagttgaacagttcccttaagaatgttggggaatgcttaggatactcttgcaactaacagcagagcccccatgtgscaatattgtaactcgagcaaaaatttacttagtcccgggtagcaaatgccacagatccttaataaaaataaaattaacttgtttattcaatgagtatttattaaactcttacactgttcttcgtgctggggatacagtagwgaataagacaaagtgccttccactggaggacttcttgcattcttgttgatgagatggtaaaaaataaaaatagctacacactgcaatgtcaactagtaataagtgctgtgaagaagactaacaaggatgagggcaatgaccatttgatactgtggccagaaaaatccctttctgagttgttgacgttggagagcaagtagggagcaactcacataatcctgtcaccttagatgtaatctccttttgggttttcattggccaccattaaaaaggaaaagaaaattgtttttttatatactccacacttctgacaccagggtgtggagtttttccataccaaccaattctccaactctctggacatcaactgagtgtcctgcaattcaatttccccccagcacctccttacctcttccttactgattttctttcatttccactttgtctccaggtgcctgtggtgacccagttctttttggacatttttccacttatcaacaaatgaatcctatggtattagctgataatggcttatagtattagctttctcaggattcttgaaatttaataggtgagtctgagaaatggaaagtattaaggaagcacagagaactgcattttatgcacatactgtagcttaaaaagcaaataggagaaaaggcctgtattaaaaacattcatccttgctcttccctctcaatttcttaccaattactctttttaggtgcaatcattttattttagctactgtttaattcttataatatttttgaattttgttgatattttaatttcttgctattttaactgaggattcagtatcatttactctccctgcttcccatgttaatatgttattattacagtattaaataaataggcgatatgactcacaatcactgtgtaaacaaagacactgatgaattaagtggtgtactagactgtgttgccattctcattcagcgttttgcttttcttgcagtttaaggattgttcctattttctttctctctctacctcttttacatttgcttttttgtctgtatctagggcttgttgtttgtcccaacatttaaaaatatatgtcaaggactgggcacagtagttcaaacctgtaatcccagcccactttgggaggccaaggtgagcagatcaccaggtcaagagattgagaccatcctggccaacatggtgaaatcccatctctactaaaaatacaacaattatctgggcgtggtggcaggcgcctgtagtcccagctactcaggatgctgaggcaggagaatcgcttgaactcgggaggcagaggttgcagtgagctaagattgcaccacggcactccagcctggctacagagcgaggctccatctaaaaaaaaaaaaaaatgtatatatgtatatatgtgtgtgtgtgtatatatatatattatatatatatatatgtcaaatgccgaagctttccaaacactcaggcatttcagataatcctatttgcctgcagcactccatttcttggctccaatatccaaytctagctatgtacctagtacttcaccattttccagaacaggatccctatttcctggattccatgtatttattttcttagtttaccactcattttgttgaagcaccttccactaatagatttttaggaaagggtgcatgtgaaataaaaatttcatgtctaagttttttagtccagtattactgattgatagattgctgtaatataattctgggtggtaaataattttccctcagaatctttgagacattgaattactgtcttcccataccactgtcactgtagagaatcagacaatattctgattcttatttctttgtgtatgatctatttttttcctctgtatgatactttcttccctcctggtattcggaaattgtttacagatatactttggttcgtgcttttttttttttttcgttagtttttgggcagtcagtgagctttttaaatatggagacgtgtccttcagttctatacaaatgtattgtatgtttcaaaaaatgatctctccacatttttctttgttctctttctctgaaacttctattggacaaattttggatttcctggattgatcctttggtttttctttcctattttccatctctttatctctttccatcctacagagtaatgtctatgctttatgatccaatcttttatttatttattacaaattttggccagatgtcagaagattatggcacaatcaaatccagcaatgataccactgggtcaagcaatataaataaaattaagtttttgtaaataaagaaacattcatgtgcattcttttatgcattgtctatggttgtcttcaagctacaatggcagagttgagagatggcaaatcctgcaacttagaatatttactacgtggccttttacagaaacagtttgctgatcccccaactcccatcctaatttaggtgatcatattggttagctccatgagctctttttaagttgtctttttgccccttcttcatrgcatactgttactctcatggatgtgccattttttctcactgtgaggatattatttgcagtttttttttttttttggtggtatactgcttgctgcggtgccactacttcttctgaggtaatttagccagttcgtgttggcccatttcatgttggaggcgtttctctacggttaagattcttctgtgttcattcatattaatgagtgaatcactaaaaactgatagaaagtaccctgccggagggcagatcatgaggtcaggagatcgagaccatcctgggtaacatggtgaaaccctgtctctactaaaaatacaaaaaattctccggccgtggtagcaggtgcctgtartcccagctactggggaggctgaggcaggagaatggcgtcaacctgggaggcagagtttgcagtgagccgagatcgtgccactgcactccagcctgggggacagagtgagactctgtctcaaaaaaaaaaaaaaaaaagaaggcaccctgccagtgggcaaggttttggtggtggattttgtgttagcaagattagacagagagcttgcttcaggtacatgtatttagactccactccccacacacccagagaagactgccaaccgctcctacatggaagatgtacacctgctaccagtgttctgggggcaaggcagggaaagggtgctgggtgccccaagttcaacatgtacattctcattttagtcttaggttgtcagtcccaagtctcactgctatgcctagtatacttcagtgtagcttttcaggtttgaatttgccagaaaataaactcttttctgttagagggatggggtagtcttttgattgcttggggtaaagaccgaaatctggcagttgatctcgctctatgaagatcagtccccatcttttttgtgacccctacttctggtgcttctcatgacttttatggcgcgacataaggtcccccttcagtaagcacttagactgtagctgccttgactctaccatgtattctgttctccaaaaatttgtagaaattgttcattcattcctcttttctctatcctcatttgtattcatttgtcattgcttgagttttgacgtgaaagagacaataaaagcatgcgatcaatctgccgtgtttcagatatggatttctcatgacagatttcaggcatggcagatgatactggaaggatgccgtatgaattaagactgtagcccaaggttgaaaatgggagctgaagatctttgtaaaagtgagatgctgtcctcctttgttatccatatcctccaatstattttgcactagtgtcattttaaggtctcttactatgtactcatttcttttttctttttctttttttttttttttttttttttttttgagacggagtctcgctctttcgcccaggccggactgcagtggcgcgatctcggctcactgcaagctccgcctcccgggttcacgccattctcctgcctcagcctcccgagtagctgggactacaggcgcctgccacagcgcccggctaattttttgtatttttagtagagacggggtttcaccgtgttaaccaagatggtctcgatctcctgacctcgtgatccgcccgcctcggcctcccaaagtgctgggattacaggcatgagccaccgcgcccggcctatgtacgcatttcttaatacaacttttaaattggaagaagcttggatatattgtatttacttgtggcttccttggctgtatagttcgttaagggtgtctgccattatttcatttactctactgtgggagtgattaaaatgttcccccgtgtgttcatttatttatgaattttgaatcatcactttgatgaggtttctcccacatcctccttttagcctagaccaacctgctaatatcagcaagcccagcagcctccaaaaatgctaggaaaaaatattttttactaccgttcttgggggttatatcttactatagatattgagggaatgtatttggtggaaataggatgactcttcctggtgttgtgttcatgcacactaaatttgctttggcatcttatactttgtatttattataactttgcaaacttaaatgttttcaatatcttacaggtgtttaattttcctgagcccaatgtttcttctaaaaaaaagaacttttaatttttaatgaaatagaatagaattttatgtaaacttttaaaagaaacaaactataccctattggtatctgtattcattttcctacttttttgtatcaagattttgtttttaattattatcatttatgctttggaatactttgctattttcaaatttgtatttgttattttatagtaaaaaactagaaaacctgaatttgatacatatgtgtatggttctggtggtggtgtggtgtgtgagggtgagtgtgtgtttacaactctaggaagtagaggtttacaagtaaatttaaacttcaaataggcaaccacttatgtataatccaaatctgtaatcttctgatgatgcagtatgggcctgtatgcaaaatctggtaatagtaatgtaaaatttcttctcttcattggctatatttgaggccagactttttctatttagttaaagtcatgaaaatatttttgatttagtgtattcaattttcaatcattgtgttttccttttgaaatactctaggcttctgcctagagaaaccaaaacagttaaacatgtcattatatgttcaggccattagtcctgattcttaggctttatatattttctgtgggtagttctaaacgacttgagaggttttacataatttcaagtggcttacaagctttgcaagttaaacttggaaaatattgtagtaataccaagtagtagtgacataaaggcttaagagactcacgtaattgggattttgagattattttgtccaattcacattttacagatttaaaaatgtagaccagagagatgaagtaactggttcaattaatatacgacacagatacaagactttgagtagagcctagatcctttgagattagtctatttcttataatcattctgtcttctttgaagtcaaatcaatgtttttgtacaatgtgaaaaacagtagttgacactttatataacttttttcctaacctcatatagatttaactagaccactaggacttaaaatctgttttgttaaatagaaaggaaacaaacaagtcttcaattattctctaagtttgttttctttgcattataatagtgatatatatttattataaaacatgaaccatgatctcgccatccaaaagtaatccttactaatattgggaactatacaaattttttattaacttgaatttaatgcatggcattctttgccatgggcaaaacaattcttttaagttcctcctactgttggaaatgtatagaacggtctttattaatgttgaattatacagactttcccttaagtaactgaaacgtgcataattggctctgaaaaggaaagaaattactaatattctagcacacataatctatcttccacatggctagcataatattttaagtagaaagttattccccttcaagtaacaaggtaaacaaaagaattattgcttccttcttgtttgaaatttggttaggcctcagtggaatggctcaaagggcaacttcagaatggtcttactactttcccaatatactatctaaaattgcttacgttgctgtcttctttaaatcccatgaatagctcactgtgacctctggttaaatagcgactcattgtcatgacgcacaaggttgtcattttgtttatatttttgttaaaggcaaacaattggttttcaagaagagcggaaaccaaactggagaggcatccatagcttcatttcagtgctctgccactttgcttttctccacgtcacctgtcttgtgttcacctctgttctgcctcacagctctagcttattcatggtttttgctcgccatggagttggctttacatgttatcttcaatgcctacatgctaccttgtgactgtcttagttgtactgaaaatcagttcattcttttgatagttttctgtttaaaattctagagaataaaattctgattttttttccatgccatcttataggttgctatctggcttatgagttggctattctaggwaaaggtgatcaccctaagtttccagcagaagtgatggttaagggtagtgataaagttggtagagtcatattgtataagacttggcagatgctttaagcgaggccatgaaggacaaagaattcaacttgatacaaagattatttaccatctggcttaaatctacccttttgtcattacttgcacttactaaccaagatgctatgcatacctgcaatacagccacactgtaagtatttattatttattattccccgaacaagccattttctagctgactttaaatcactgtttatgctactctctcttattggaatagtcttcctttagtttttatctggtgaaatcttctataagatgtatctaaaacattataatcttcataaacattttctagggattttggtgacttcctcataagcacttttataaaccatttatatatgccatataaatgcatagtattaaattgtttatttgcccttttccccatagaatattctttaaattcagggattgtggtgtttcattcatctctgaattctacttttaacagataatggatactcaatatatgtgtgttgaaaagaaaacattaagatgatgcagaagtagctactcctaatggctatatcattatcataattatggttctctgggaatacctgtagttgattcacaaatctgttacccaagatgtgataagtgcaagcggaaagtatgtactaagcatgaaactcactcaaaatttgggccaattaaccagagtactggtgtatttttcaccatttggtctctatttgactaacaagtgttgcagatggatttttattgctctcttatttgcttccaatctgagtaattggttggaggaaatttcctgttctgaaggaaatttcatttgtgtccgaaggtagtgatttatttatttatttatttattttgagatggagttttggtcttgttgcccaggctggagtgtaatggtgcaatcttggctyaccacaacctccacctctgggttcaagcaattctcctgcatcaacctcctgagtagatgggattacaggcatgtgccaccatgccctgctaatttttgtatttttagtagagatggggtttctctgtgttggctggtctcgaactcccagcctcaggtgatccatctgccttggcctcctaaattgcagggaatacaggaatgagccaccgcgcccggctggtagtgatcttgtatttactcctgatttggggtgtttgtcaacatgtacaggggcaatttggggacaattccttatttggagctgtttactcttcctgtttcttacctctagtattatcgcaagtggctcctagcttaagtgggctttcaatgaggaccttactggaaatacctgtagcctaaataaataaataaaaacttgccaacaataccgtgtcaagaaggctggctttaaaatccagcttgaagaagcctcatttaaatgactgtttgtaatctggtcctcatatgtctaccatgtgctacttcccattctaggtgctgaagaattaagagaaaagatacatttccacacttgtggcgtttacaatctaatctggcatatcataaacacttgttacaatgtgtgtagggagtgctagcatgaaaaaagcacagggtgctttgtgactccataaaaatggcactatccagactcaacttacaggggaaaaacctgaattaagtgccagcaaagcaaaactactataataaaaatgaatttttttaaaaaaaaacaatgattaatctagccatagcagcagctagaatactcttattcattttataagttctcagtttatgctcgatagagatggttgacacaagttaggaaacttaacctaagtagtattcagcatgaccaggacttcttagagaacatccataacatattggacgatgaaaaaccacttcatagtgtctttggtagtctgcaccagcctttcattctaaacattcggtaaagcaggtgaaatgcaatggtgacagctttgatgagatccttgtccacaaataccctaacttgactgaaagaaatgtgagcctgttgtcagaaataattgtgtctggcagcctgtatgctacaagaaactggcatggagtcacattgtcatcccagaggcttgaggtagaagtgaaagacttgatgtcactgtgagaagcagtatactaaagggcaaagttttcatctcataacaagatcaatgtgaagtcctggtccaactcttttggtcttttcccactggaaaattaggtgtcttactcagttatgccaagtagcctggcatgtggcatgtactaacttcctttagacttttcaatatcagaattaatttgaggccatcaaatagaacttctagccaagactttcaagtagacaattcccagatgtgctatgtgtagtgaagccaagataatgtcttctgaaatcataatgtaacttctctacaaaatacatccctcatgttaagaaaattcatatggatgttttgagattggctttaatttttttggtcagttcctatgatagccttcaccatatttgctttatgacaagggacagtctgggtttcttttaatttaattaccttatttcatcagcttgaaaataagaatcaaggaagccttcacttatctaatcttccagtggtagtggcacatatgttttgatatctgttggggtagatattcccaactacttgatattgatgatgttctctgaactataattgatggtagagtgaatagaaaacttaaatcattgcgcaaactcatcaggtatataaatctgaaagttcctaacatgggatattgagagctagaagtctggcaggaacataatacaagtttttctttgctttaagatggaaatcctctcaaaataaggatttcaggaagcaactgaaaggatatcaaccctttcaatacagttgtcagcacatatttttcaaagagaggagaaaaagaagtatttatttgtagattatggattgtctacctgaaatatctaagaggctcaagtgaaaagttattagtaccagaaaaagagtataacaactaggaaaattacaaagtaagtatacaaaagcaattgcttcatatttgttttcaaactgcttattgttactaaaacacaaaaagacttacaaattagtgaaattgaaaaaaatctcacaaattataacttacctctgagtaagcttaagaaatgtgcacagtttatacctagaaaatagaaatgaaagtggcaatgctaatgacaagagaaatgttattgagggacagaatgaacagagatacatttttgaattgaaagaatcaatagcttaaattaatcagtgtataaattcaatgcagcctgatcaaaacctcagtaggatttttttgtatctaattctatattttaatgttttttattgtttagcattatgttatgtaaatttccaaacatacacaaaagtcaagagaataattaatggacttccctgtatgtgtcgctcaggctcagtgtcagcagttactagcataaagccagagtttatttacttatactcccagttataccccaccctcatggatcatcttgaagcaaatctcaaacatcatataattcatctcagtgtaactctaaaagagacgcactaaaaaaaaatgctataatgctatcattctactttaaaaagttagcaaaaatttgatgacttcgaatcaaataccagtcaacaccaaattcaatatgcacacacaaacacaaacacacacacacactgtcaatttttgaaacaggatcaaaagtagttcctcatattgtatcgaaaaattaattgtagattaatataagtctacaattcctttaaacttgaaagactggtgcagactaccaaaagacactctgaagtggacctttgaagatacttttgaagatagactttctcttctattttccacttgtattctatttgttaaagaaactgggttatttgtcctgtagaatttcccacttttggatgttgttgaatgcatctccatgatatggcttaaaattttcctctgatcctttgcttcctgtaagctatttctaggcatagagttttgatcagatccaggtttgatgttttggcaagaatacttcattcaagatgctgagttccttctactgcattctatcaggaagcccataatatctaatatctcttcgttatggtgttaagattgatccttagatttaagtgtggttggcctgattcacccattatcaagttccctgtcaactattcatctaatgctttagtagtcactgatgattattacatagatctatttgttcaacagagattgtaaaatagtaatattctgttattcctttttcatttattagctggaattctaaagtttttattaaaatatttttattatggtaagaacccttaacatgagatctacttcttaacaaaattttaagtgcacaaaacagtattattaactataggcacaatgttgtacacagatctgtaggatttatttatcttttataaatgaatctttatagctattaaaaagcaattttctctttcctcctcacccaatgcctggcaaccaccatttactctctgtgaatttgactattttagatacctcatgtaagtgaaattatgtatttgtccttccatgactggcttatttcacttagcgtaatgcatgtagcaaaatttccttctgtttttaggccaaacactactccaccattatgtgtatataccatgtttttctttatctagtcatgatcaatgggcaattaggtgcttgttatrtcttgactattacgaatattgctgcaattaacatgggagggcagatatctcttcaagatcttgatttcaattttttaaaaattatgctttaagttctagggcacatgtgtacaacatgtaggtttgttacattggcatacatgtggcatgttggcttgctgcacccatcaactcgtcatttacattcggtatttcgcctaatgctatcccttccccagtcctccaacccccaacaggccccagagtgtgatgttccctgccctgtgtccatgtgttcttattgttcaattcccacctatgagtgagaacatgtggtgtttggttttctgtccttgtgatagttkgctgagaatgatggtttccagcatcatcgatgtccctgcaaaggacatgcactcatctttcttatggcgtcatagtattccatggtgtatatgtgccacgttttcttaatccaatctattattgatggacatttgggttggttccargtctttgctattgagaatagtgtcacaataaacacacgtgtgcatgtgtctttatagtagcatgatttataatcctttgggtatatacccagtaatgggatggctgggtcaaatggcatttctacttctagatccttgaggaattgccacactgtcgtccataatggttgaaataacttacactcccatcaacggtgtaaaagcgttcctatttctccacatcctctccagcatctgttgtttcctgactttttaatgatcaccattctaattggcatgagatggtatctcattgtggttttratttgcatttatctgatgaccagtgatgatgagcatcttttcaagtgtgtgttggctgctgcataaatgtcttcttttgagaagtgtctgttcatatcctttgcccactttttgatggggttgtttgtttttttcttgtaaatttgtttgagctctttgtagattctggatataagccctttgtcagatgggtagattgtaaaatttttctcccattctgtagcttgtctgttcgctctgatgatggtttcttttgctgtgcagaaggtcattagtttaacttgatcccatttgtctattttggcttttgttgccattgcttttggtgttttagtcatgaagtctttgcccatgcctatgtcctgaatggtattgcctgggttttcttctagggtttttggggttttaggtcttacatttaagtctttaatccatcttgaattaatttttgtataagatgtaaggaagggatccagtttcagctttctacatatggctagccagttttcccagcaccattaattaaatagggaatcctttccccatttcttgtttttgttaggtttgtcaaagatcagatggctgtggatgtgttatttctcaggcctctgttctgttccattggtctatatatctgttttggtaccagtaccatgctgttttggttactgttgccttgtagtatagtttgaagtcaggtagtgtgataccttgttctttttgcttaggattatcttggctatgcaggctcctttttggttctatatgaactttacagtagttttttccaattctgtgaagaaagtcattggtagcttggtgaggacgactttgaatctataaattaccttgggcagtayggccattttcatgatgtaaattcttcctatccatgagcatggaatgttcttccatttgtttgtgtcctgttttatttaattgagcagtggtttgtagttctccttgaagaggtccttcacatcccttgtaagttggattcctaggtattttattctctttgtagcaattgtgaatgagagttcactcatgatttggctctctgttggtctgttattggtgtatgggaatgcttgtgatttttgcacattgattttgtatcctgagactttgctgaagttgcttatcagcttaaggatattttgggctgagacaagggggttttctaaatatataatcatgtcatctgcaaacagggacaatttgacttcctcttttcctaactgaataccctttatttcgttctcttgcctaattgtcctggccagaacttccaacactatgttgaataggagtggtgagagagggcatccttttcttatgccggttttcaaagggaatgcttccagtttttgtccattcggtatgatattggctgtgggtttgtcataaatagctcctattattctgagatacattccatcaatacctagtttattgagagtttttagcaggaagggctattgaattttgtcgaaggccttttctgcatctattcagataattgtatgttttttgtcgttggttctgtttatgtgatggattatgtttactgatttgtgtatgttgaaccagccttgaatctcagggatgaagctgacttgatcatggtggataagctttttgatgtgctgctggattcggtttgccagtattttattgaggatttttgcatcggtgttcttcagggatattggtctaaaattctctttttttgttgtgtgtctgccaggctttggtatcagtatgatgctggcctcataaaatgggttagggaggattccctctttttctattgattggaatagtttcagaaggaatggtatcagctcctctttgtacttcgggtagaattcatctgtgaatctgtctggtcctggacttttttcgttggtatgctattaattattgccacaatttcagaacctcttattggtctattcagagatttaacttcttcctagtttagtcttgggagggtgtatgtgtccaggaatttatccatttcttctagattttctagtttatttgcatagaggtgttatagtattctctggtagtttgtatttctgtgggatcggtggtgatatccattttatcgttttgtattgcatctatttgattcttctctcttttcttctttatttgtcttgctagtggtctatcaattttgttgatcttttcaaaaaaccagctcctggattcattgattttttgaagtgtttttttgtgtctctatctccttcagttctgctctgatcttagttatttttagccttctgctagcttttgaatttgtttgctcttgcttctctggttcttttaattgtgatgttagggtgtcgattttgtatctttcttgctttctcttgtgggcatttagtgctataaatttccatctacatactgctttaaatgtgtcccaaaattctggtacattgtgtctttgttctcactggttttaaagaacatctttatttctgccttcatttcgttatttacccagtagtcattcaggagcaggttgctcagtttccatgtagctgtgtggttttgagtgagtttcttaaccctgagttctaatttgattgcactgtggtctgagagacagtttgttgtgatttctgttcttttayatttgctgaggagtgttttacttccaatcatgtggtcagttttataataagtgcaatgtggtgctgagaagaatgtatattgtgttgatttggggtggagagttctgtagatgtctaataggtccgcttgggggtacagagctgagttcaaaccatgaatatccttgttagccttctgtctcattgatctgtctaatattgacagtggtgtgttaaagtctcccattattattgtgtgggagtctaagtctctttgtaggtctctacagacttgctttatgaatctgggtgctcctgtattgggtgcatacatatttagcatagttagctcttcttgttgaattgatccctttaccattatgtaatggccttctttgtctcttttgatctttgttggtttaaagtctgttttatcagagactaggattgcaacccctgcttttttttggctttccatttgcttggtagatcttcctccatccctttattttgagcctatgtgtgtctctgcacatgaggtgggtctcctgaatacagcacactgatgggtcttgactctttatccaatttgccagtctgtgtcttttaattagggcatttaacccatttacatttaaggttaattttgttatgtgtgaatttgatcctgtcattatgatgttagctggttattttacctgttaattgatgtggtttcttcatagcatctatggtctttagaatttggcatgtttttgcagtggctggtaccagttgttcctttccatgtttagtgcttccttcaggagctcttgtaaggcagacctggtggtgacaaaatctctcagcatttgcttatctgtaaacgattttatttccccttcacttatgaatggtagtttgtcttgatatgaaattctgtgttgaaaattcttttctttaaatgttgaatattggcccccactctcttctggcttgtagagtttctgctgagagatccgctgttagtttgatgggcttccttttgtgggtaacccgacctttctctctggctgcccttaacattttttcttttatttcaaccttggtgaatctgacaagtatgtgtcttgcagttgctcttctcgaggagtatctttgtggtgttctctgtatttcctgaatgtgaatgttggcctgctttgctagactggggaagttctcctgcataatatcctgaagagtgttttctaatttggttccattctccgtgtcactttcaggtacaccaatcagatgtagatttggtcttttcacatagtcccatatttcttggagactttgttcatttctttttactcttttttctctaatcttgtcttcttgctttatttcattaatttgatcttcaatcactgatatcccttcttccacttgatcgaattggctactgaagcttgtgcctgtgtcatgaagttctcatgccatggttttcagctccatcaggccattgaaggtcttctctacactgtttattctagttagccattcatctaaccttttttcaaggttttttttctaatccttcccatgggttagaacatgctcttttagctcagagaagtttgttattaccgactttctgaagcctacttctgtcaacttgtcaaagtcattctccgtccagctttcttccattgctggcgaggagctgtgatcctctgggggagaagaggcactctgtttttttgaaattttctgcttttctgttctggtttctccccatctttgtggttttatctacctttggtctttgacattggtgacctgcagatggggttttaytrgggatgtcctttttgttgatgttgatgctattcctttctgtttgttagttttccttgtaacagtcaggcccctcagctgcaggtctgttggagtttgctggaggtccactccagccccttttgcctgggtttcaccagtggaggctgcagaacagcaagtattgcagaacagaaaatattactgcctgatccttcctctggaagctttgtcccagaggggcagccacttgcatgagttgtctgtcggcccctactgggaggtgcctcccagtcaggctacacagagtcagggatccacttgagggggccgtctgtttgttctcagagctcaaacactgtgctgggagaacccctgctctcttcagagctgtcacacaggggcctttaagtctgaagttgtctgctgccttttgttgagctatgccctgcccacaaaggtggagtctatagaggcagtaggccttgttgagctgcggtgggctccgctcagtttgagcttcctggctgctttgtttacctactcaagcctcagcagtggcagatgcttctccccctgccaggctgcagcctggcaggttgatctcagactgctgtgctagcagtgagcaaggctctatgggcgtggtacctgctgagccagacatgggagggaatcgcctggtctgccggttgctaagaccattgaaaagcacagtatttggggggaagtgtaccgtttttcccggtacagtctgtcatggcttcccttgtctagaaaagggaaatcctccgaacccttgcacttcctgggtgaggcaatgccccgccctactttggctcaccctccgtgggctgcacccactgtccaaccagtcccaatgagatgaactaggtacctcagttggaaatgcaggtctgcgtcgatcttgctaggagcttccgaccggagctgttcctatttggccatcttggaaacgaccatcttgatttcagttcttttgaatatattcccagaagtgggattgcttggtcatgtggtaattctgtttttattttttgaggaaactccatactgttttccacaaaagctgtgtcattttacattctcattaacagtggacaaaggttccaggttctccrtatctttgctgacatttgagttgttgttgtatttttctataatagccatcctagcaggtgtgtggcgataactcataattttgatttgcatttcccttatagttagtgaagttactgtttgatataacctgtttgccatgtttatgtgttctttgaagaaatgtctattgaagtcctttgcccatttttaattggataatttagttttctgctgttgaattgtaggggttcctcatatattttggatattaatctcttatcagatatgtgatttgtaaatattttctctcattccatagattaccttttcattctgtttattgttttctttgcagtgcagaagcttttaagcttgatgtagtcccagtcatctaattttgcttttgttgcatgagcttctggtatcatatccaagagatcattgccccattgccaagctcagtgtcatgaaactttcccattatattttcttctaggagttttacattgccagattttacatgtaaatctgtaatctattttgagttgatttttgtgtctagtgtgtggtaagttagtgtgaggtaaggatccagttttgttctttgcatgtggatatccagtttcctcaacattatttgttgaagatgctatctttcctcattgtgtattttttggcactcatgttaagtatatgtgtgtggtattatttctggatgctctattctgttccattggtctgtctgttttttgtttgtttgcttgtttgttgccagcaccatactgttttgactattgtagctttgtagtatattttgaagtcaggaaatatgatgcctcaatctttgttcttctctctcaaaattgctttagctttacagatactttgtagttccatatgaattttaggatttttattctgaaatccctgattctacaaagaacaaccttactatattatgtgtgtatttatattgagtcacattttgtacagagaaggcagaaataatgcaagctactctctctaatgataagtgattggttctctaaaattccgtagatatgaccattgagttgtttttaaatgtcattatgactgcatagattttgtgatatttggtatttttcaatccattgcagttattgttccttatgatgttcagtttatctcatttgccaataggaattctttcacttttgctcctgagtccttttgatatgattccactagtcattagcacattttcactttctggtaggacaaattagcctcttctcttatattttctgacctgaccaggacataaccatatcaataaggcaccttggttccttttgtatccacagtccaggtactggaaatgttcatttctcacttagtcactgtttctaggtcttttctgaagagaagttttgaaagagaaatattttgcatgtttatgttgatatttttatacttctaatttaagtttgagtttataggtttttgttttcaattttaattcatatgtttatctcttttctcttaaactaaaagtgttagttttatatgattctatatatgcaacaatttaatagtattctaagagtaactcatattattaacaatttgatgaataaaaatgatttaagatttccttgcatttttcattgtccttagaaaatacccaccaggagtatacaatcaagttattggtttttgccttttaaaataatttgttgttggttaaactaccaatccatacacagttatattccctttttaaattttcttttaatttttatgaattactgttttactttgaattaattttgtttaataattatttgaaacattttcatgtttccaaagtcaaaacctcaaagtaaagcacatttggagaagtgtaacttatcttgtttgctttactttgtcccttttcttcccatggatatcaccacttttattaatttttggtttaaaatatatatatgtacacacatacacacacacatctttatattttcctatatatataaaaggtagcatactgtatatgcttaaacactttgcttattttcataggaataatatattataacaatatttagtaatatttctcatttttttcacacaaagcagacattttaagcatgagacctatcaggattcaggatgggtaatctcattcattcattcaataaacttttgctgagaactcaataaaagtaggggtgaagttcttggatactaagattaatacaccacagcttctgtcagaatggagcttcagatgcagtagcagagaattcacttaaagcaaggattgctcctcaatggtaaggactaatggaggtgagcatggggtgctactgcaggagcgcaacaaggaacacaaaactcaagactgagaggccttgagccgactcctacagaatggtcagaagttaaccaggttaaaggtagaaacaggaaggttcaggaagagggaaaggcatacaagaagtcccatggatgatgaaatgagagcatggacgctakcaagaggaggctagagaaacagatgaggaaggcsrtgactggtgaagtccttgtactatgggtgtggcctggaagattctcactggcccagaaagggaaaaaaaggaaccttttaggcaggagttaggttttataaaaaccactcttcattcagttatttaccagcattatttaagaaatgatctgtagtccatgttactgtcagtcaggttcttaaatatcagaacacagcctgttggatacaccataaaatttgcagcctttaataaaatatcattattagtgtaaataaacaaaaacaaacaaagctgtggcccaattatccatcatctggctaaccacaccccctaaacttgttatgtaatctagaaatatgaaagaaacaaaatatgaattctgttttatagagtccattagcctacttaaataacagagttatagctatttaggcctagaaggaaggatatattcagttgtaaggcacaagaaagtcatggcactctttgtggagcaccatgcagtatttacctttgaattttagaataaatatcagatcttgtgctaaacttgttcctattgtatgcattgtttatggcaactattttattttattttattttatatttttttgagatgaagtttaactcttgttgcccaggctggagtgcaatggcgcaatctcrgctcaccacaacctccacctcctgggttcaagcaattctcctgccttagcctcccaagtagcttggattacaggcatgtgccaccatgcccagctaattctgtgtgttctttttttttttttttttttttgtagagacaggttttctccatgttggtcaggctggtctcgaacttctgacctcaggttatcctcccaccttggcctcccaaagtgctgggattataggcgtgagccaccatgcctggcccaactattgtttatgtgatgcttaggtctgtactgttctagtgctttatgtgtattacttccattaatcctcctggcttctttataaagaagcacttgtattatcctcattttataaacgaggaaaactgaggcataaagaaatggactgtatcaattataggtggtgaatggtagggattcacatgtaggcagtctgactccagggtgggtgctgttaattgtaatagcataccatgtctctctcctggaatataaaagaaagaaagaagctgaaagataataaaggtgaagataatatgtgaaagaacattttatattaagaaatttttaatattaacattttcccgcttaatgaacaaatctttcttgattttactgataatccatttttgatctacttcataaaagtttgagtactcttaaaggcattggttgaagatccattgatacccaatgtttgacrgatgaggtacctgcagtcttgcaagatatagtgacacagctggtttgtaacaaaaagactgcaattcatgcctcctgtctcacacaataaagtgtgagaattggggcatagcttttgggactttgagacccaatgtaaccagaggtcactccgaaaggattatatttagttctagacccttctatgctctagagaagtgaaagatggaattgaggatgcatcttcttcaggggctacatttccaagtaggacactttcttttttttttttttttttgtttatttgtttcactttttctctatagctctcgccaatggcacaattatatataaatatatataatttattgtgaatttcttcatttttcaatattgaaaatgctctgatcattttctaaacttcttgcaaatgaaacgcctactatatatacacataaattacagtattagtatctacaaagacttgcttcaagggaaacaagattttttgatttggtgccacagctaattggttttaattatgcataaataaagcccaaactgcatagttctatgtctttcctttctttgttgagcttgttgtgctttgaaaaaatctacaatgtaatcagtgatacgtattatcagaaatataattgcaaatgtcttaattaaaatatacattcacacaaatatgaggaataagaaaattaatttttcagtaagtatatagactcctatactaaaatgttttattatttttttaacatccggttacaaaaatattttgtttatactatattaagttgcccttattttatatctttaagttctttcttttgtcttttagataacttttaaaatcttctcaatgaagaaacaagcttgagtcagatattttgtaacattttgacatatttaagagaaaggaagagagagggaagcttgtaaaataaaggcttatataagaagacataagaacaagcaacttaaagaaacagaaaatcagagttctggatagactttagagtgataaagtggatagaatatggtttccggtattgttccctgtcatgagttctgttcaaactcctttacctgtaaaactctgctcaagttattaaccatctctgcaactcagctttcttttttttaattataaaaattaacgtgtataaattacttctgaagttgttttgagaacatgtgacaccatctaataaattcatggataaacacctaattaatatttttgttttatttgtatatattttgttagacacatgatttaaggtaacatgcaataacttttttctttctgttatgatttattctccaaaaataaatttgtagatgataccagttgattcagaaaattttaaaaatacatatattaaacacctattgcttttcttacagcattagatacaaaaaacataaggatgagaaaaattgtgctgctattgcaaagaacttgtaaactttttctgctgacctctggcagaaggacttccttggactcagtcttgattatctgtgttcttttaggtagtatccacgacaaatcaaaaggacttagtatgtagccagaataatttgagtatttcattcagtactgaaaagattcatcttgcattgaatttgagtacattaggtttccctcatattttccccccattgatttgctggacagagtaaacaattctctaatcttatcttgtaaatcttacttttcttagtctttgtcatcaacactcataagtagctagtaagtgcaagtcactgtaattaaatgggtttttttttttttgaaattctgttgtttacaatattctcttggcctgtctcccctagaaagtttgtaccttaatctatgctttagactgagtttattgaatttcttttattggcaattctctggttgttagagacattacacataattatttagatccttctagaagaactcagagggccaaaattaaacattcttgttaagacagcttctctctggggatcacttgttagtttatttagttattcttttatgtaagcggttaatcagtgcaagcaatgaaaaggtatagggcatcttggctgctttctgcatttcaaaatatttttgatgtcttttcagatctccctatagagagctttgtaatgcttttctgcaacagagaactgcatgcacggacccaagggtcaaaccttttctaatgtaaatttaatgccatggcttcgtgagctaagatcatttataaatataaaactcacagaagagcagattcatctgttaccatgtatagtaacatctcaaagagacaactaaacatgacagttgaggggatttgcaagtgaaagagaaaaacatgagcagagttgagagccatataattatgctcattcacactgtgactagttttaaagtgatttattcaaaatggttaccagtgtactcttagtcaccttctttcttgactatgtgctaattctgattttggcatttgtctatagaatatacttgttcttcctcttgaaagggaattgtgctacattttcgtagtgtttaaatcagttgatcatatttcacaattattccataacgttagttatttgaatttcaagttgcagtgttcttagagaaagcttaatatcttcattatacatacagtcatggctagctaattagcatcatgaatgctgaagtttaaccctggatgccactatttctgacttcaagaatatattggattttttcactttaaaaagtttagaaggaaaaatatcactgttgaattctacttcttggttatttcaaattatttcaaataggaagccccctgtaaaagtgtccagacttactataaatgcattatagttctcatctattggtttataaataaaagcatccttgaacgttttccaaaagagtaatgcgatttacaatatagttaatgaaaattaagctatattggttttccgggagggaaattgcactacataattaattttaaaaatcactgtttatttattcagtttattgggaaacaagaaacagattcaaaataatgaagctaaaggaacacattgcattttgacatcgtccgtaattaaaagttcagtgttttggaggcaatttcgttttgtttgtgccgccattttagttgccattgtacttaaagctttccttctcctttcttatataggggttctcagcttttaaataaaagatgtaaaggaattatggttatttctgttttcagaataagtgtctaaaattttaataattttaacatttttgttttggttttttatttagtgattattatacaataggcaaaaccatagatcagtataaataagacaggtaaagtgatttgcacaaggttacatgtttggcaatggcagactaaaatgcggcttctagatatccagtctagtgttttttcccttatctgaacttatggtgccttgtgattccttgatttgttaaatttcagaaaataggcattaagagatttctagcccagacaggaatggtacaggaatggtaacttctttatttgagtggtgacttaggctaagctttatatacatacaatcacactctacatttgtaaaacattccgtagttttaaaaagtctctctcattctctcgtttccaacttatctttccctctctttctttcttgctttcactgtttcagaaagtgagaactttctctgaaatctacatacaagaaaataaaatgaaatcatggaaaaggtacagaagcagcttatgacatctacaagggaaatggctagtttttttaggataaaacaaattgactgattatccttacagtgaagacaaagtttgaagtttttcagaatgtgattaaaaatgatgaatgatataatcaaaatatccttcaaaattctgttttagaaatttgtgtaaaagtttgactttctttgaatgaggccttccatagtgagagttgctttatgagagctatcagaccctcatcatgaacttaaattgacttagactgatttctacggaaatgcctaacctgcatttctttcaatttcccttcatcttttcaatgtcttccaagctgtatgattcaccttaatatgtaaaaataaagtaaaatatatttgtttctacataatggtctctatattaacatctttgatgcacaattgaaataaaagctcaaatagaaatactgattacagtggggtaaatagcttaccagaattattcttatctggtcctaagatttggattggagatatggtaatacttccactcacaagtccatgaggaaaagatgggaggggaagggttggaattttaatatgaactataccttaggttggagatgagcctggggactggccagaggtctcttctagaattgaggtgggtggggcacacaaatggctcttatcctgcccctgctccttctctctgtgctctgaatttcacaccttgactccttcaaagggctttacttcagtccttcagtggtggcatcgtccctgcatcaccattctctctctccctactaaatcattcctaatagttcaccaagatttttcaaaatctttcttcttaaaaagagaataatctaaagccttctcttggaccttccttaaaccacaactgctcatctccgttctttctatactaacctttttgatgttttgtcggtatccatcaatgctaattcctcatacaccattcactcttcaacccacttcaatctcttttcacccccattgcacccttcaaattgttcttgttgaagatctccatgctaccaaatctactgtcctgctttgccttaatcttaccccatctctcaccagtatcaatacaattgcctactttctctgttgaaccactctcctttcttgccctcctagccatcatgcacttaaaagaaatgttttcatgttctcctccttctttgctactatttttttttttttgattctgaaatctttgaatgcctcagagcctctcctcttttcctacgttcacttgcatacttctctacttaggtaatattattccgttccatgagcctgaaaccacctgtaggttgatgattctcaagtttatattaactgccaagccttcaaccctgagctccagatttattcatttatctatctattctgcatctccactgagatgtctaaaggttgtttcaaaccttacatgtccaaaatggaaattttgctttccaaattatcacttaaatctgtggttccggccgggtgcggtggctcatgcctgtaatcccagcactttgggaagccaaggcgggtggatcacttgaggtcaggagttcaagaccagcctagccaacatggtgaaaccccatttctactaaaaatacaaaaattagctgggcgtggtggcgtgagcctgtaatcccaactacttgggaggctgaggcaggagaatcgctggaaccccggaggcaggggctgcagtgagccaatattgcaccactgcactccagccttggggacagagcaagactctgtctcaaaaaaaaaaaaaaaaaaggtctgtggttcccctgatcttccccatctctctcagcttttcttcttctcaagccaaaaacacaaaagccctttttgatttctccctctcgttcacttatttcataccttatgcatcataaaatcttatagttctgcctctaaaattcagctccaatcttgctgtttcttattcttgcaagtacctgctaccctacacatacaatccacttaggagccacggtcatctttttttctttttttaatagactttattttttagattaattataagttcacagcaaaatcgaatggaagatagatttaccacatacacactgcactcacataggcacagcctcccccattgccaacatccctaccagagtggtacacttgttacaattgctgaacctatattgacatatcacccagagcccacagtttacattagtagtaactcctggtgttgtacactctgtgggtttggacaaatttacaatgacatgtatctaccattacagtatcataccgagtagtgttactgctctaagaatcttctgtgtcccacctattcatccctctctcctacccaagctctggcatctgctggatgtatttatagttttactgccttcataattttgtatttccaagaacgttatagttggaatcatacagtatgaagccttttcaggttgccttctttcacttagtaatatgcatttaagtttcttccatgtcttttcatggctggatagctcatttcatttagcactgaataatattccattgtctggatataccccagtttatttatctgtttgctaagtgaaggacagcttggttgcttccagattttggcaagtataaatgaagttgctatacacatccgtgtgtaggttttagtgtagacataagttttcaactcctttggggcaaataccaaggatcgcagtagctggattgtatggtgagagtatgtataatttcgttaaagtgtcaaactgttctccaaagtggctgtaccattttgtatccccagcagcaatgaatgagagttcctgttgtttcatatccttgccagcatttggtgttatagtgttttggattttaaccattctaataggtgtgtagtggtatcttgttttaatttgcatttctctatgaggttgtgaagcatcttttccacagtaatcttttaggaaaatcattttcctccttaatatttgttattttttccccattgcttaaaaaaaaaaaatgaaaaactaccatgacctgaaaggcctgcatgatctggtacctgtatagcttagtcatctaggtgtatcttgttgctataacaaattaccacaacctagtggcttaaaacaacacacatttattttctcatagttcggtatgtcagaagttcagcatggacatcactaggctagaatcaatgtgtcaggagggctggcttcctttctggaggttccaggggagaatctgtttccttactcttaaagtgtttacagaattcagttccaagtggttgtgggactgatgtctttatttccttgctgggtgacatccaggccactctcagcttcttgaggcctttatctagtccttgcacatgggccactacagctcagaaccagcaataagccatcttatacacttcaggctgttgcctctctgacc

SEQ ID NO: 10855 - DNA, 17903 bp, Homo sapiens
gaaagagtgagttgcagatggtggggttaactctagatgggcataaaaatctgagtccctggagactggaaggggaagacgaagaagacggaatgaagatcatgtcatgttgagttagggcctccccagtgagggcgtcagccttccctataaaataaaggtcaacctcctgagagttaagttgtggtgggaggcatcagaggcattgagtggccctgtgagcctggactcagaagccacagaatcagaataggtctttcctcgcttaacacaagctcaaaagcacccaagacctctttcattcaataagtagcatgagcccccttcacaacatcctgagccacaaatcctgatcctgctataagttttataaactgttataatttaattacagtctgatccctcaccttaaatacacaatttacctgagccccctgcacaatatccccaaaagagaacacgcagcctgtttgcccctcagaataaaaatctcaccacctctttaagcagtctattccacttgtgaacacctctaatatttaggtaatttatccttgtatatttagcctaaatatgcctctctttttttattacactctaagttctagggtacatgtgcacaatgtgcaggtttgttacatatgtatacatgtgccatgttggtgtgctgcacccattaacttgtcatttacattaggtatatctcctaatgctatccctcccccctacccccaccccacaacaggccctggtgtgtgatgttccccaccctgtgtccaagtgttctcattgtttaattcccacctatgagtgagaacatgctgtgtttggttttctgtccttgagatagtttgctgagaatgatggtttccagcttcatccatgtccctgcaaaggacatgaactcattcttttttatggctgcatagtattccatggtatagatgtgccacattttctttatccagtctattattgatggacatttgggttggttccaagtctttgctattgtgaatagtgctgcaataaacatatgtgtgcatgtgtctctatagcggaatgactgataatcctttgagtatatacccagtaatgggatggctgggtcaaatggtatttctagttctagatccttgaggaatcgccacactgtcttccacaatggttgaaatagtttttagtcccaccaacagtataaaagtgtttctatttctccacatcctctccagcacctgctgtttcctgactttttaatgatcgccattctaactggtgtgagatggtatctcattgtggttttgatttgcatttctctgacggccagtgatgatgagcattttttatgtgtctgttggctgcataaatgtcttcatctccacctactaatcctcatacttccccacagaatttatttaatttttttctcaatagcccatcaaatatttggtgacagtgatcacaggccatgtctccctcttgaagtccgctcttccccaagatacagcccagatgtcccaagcacttctcctttgacatggttatgtttttttcatcatcctgtttcttacggatgggaattctaatttgctgatgcccctcttcccatgtggcctcaagttcagaatgcagtttcttgggtgtcatctgagcaggcctggtaagccagggagaagccaggctgaggctgcatggtggtgccctagaatggcccaagtctgcctggctcatcaccatctcctctgaagacaggaggaaccatgagtggcctgtgtccacgtacaggctgggaggaaacagctgagggttgggggtggggtgggcaatgagatggggttaagtggagaaaattctcagcaaaggtggtcaaagggattaggaagtgggttggagagagtagcatggaagtggttggccccaggggtaaggtggagtaagagttcagcacagccactctgagaaactgggtggaaatgaaaaggttccataagtggaagccaggtttgctggaagtgggtcaagtgtccagaaaatcctgataaagcagtgacaaatgggacagcctaatgaatgtatcttttttgcaggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcaggtaagcgatgctccacctctgctatgaatgagccagagctgtggaatccgtgctcccttagctttatgttttaaaagcacatgtgagtccttcatttccctttaaaaagaaatattttgagtcttgagaaaaataatgcagacaatgggataagatcaggacagagtagaagccagaggaaggaaaggaaaggacccaggagccagaacttacccagagaagcccttggatccagaagatcccatgaagagagcttatcagtcctggggacagcttcacagactcaactttaccctaaaaatggtcccaggaaggtagacatcgaaaataccagtgtgaactggacaatctttccctatcagagaccacaagtttataggctaagctgggtgacagggagaccaccatgaccaactagactttctaagtgttaacactgaaacagcccacatcagggaagcccttcagttctaggcaaaccaaaagggtttgtcaccctaggtagaaaccgcctaagtctcccattaggagtgagcagtcaaacacagttattctcttccaaatgcttccaccctgttgggatttcacaaccatctactggtgcatgccactcctggaagccaaaaacaaagctggcaataaggaatgacctgcaacatgttccctggaaagacccaggccaccggcacatttaaggagaaagctagaaagagactctgcccctttcactttattgggaactcggccttgaagcttcatgttagctgaaaatagctaaccccacattgtggattccctgttcccataattaccccttttttgaagtggggcgttccatggtgggggatgacctgacatgcttatctttctcacgcccagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccctccttccctcctttctttcttgacagtatctcactcttgctcagtctggagtgcagtggtgcaatctcagctcactacagcctcgacttcctgagcttaagtgatcctctcgtctcagcctcttgagtagctgggactacaggcatgagccaccatacctggctgatttttcttttattttttgtagagatgggggtctcactgtgttgtccaggctggtcacaaactcctggccttgaacaatcctcccacctcagcctcccaaaatgctgggattacaggctacagccactgcatccagccccaagtcctttataatgggccaaagattctcatcttctgacactcttattataccagccacatgtcctgttacctttcaagaacagtggctcttttctggccctgatggagtcttttgcctaatcccatcctgtcttagaccccagagcctcaaaagcccaaccagcattttggaatctagttcccaaggcattgcctgctcctggccctgggtggcacagtggctatgtgcctgtgagtcatcagccactgcccccaccctcaggtcagacagacagtcactttctgcaaaggtaggagggggagatggttgtagtttttagcacttttgggtcaagcattgaggaaaggactgaagaagtcaaaatcagggcactgccatagagattatagtttccatgggaaacacagatcttccctagccctgttttctccatttctggtcctatttgtcacagattctttttttctgaattgcaaaccgaaggcctcatatctatcttcacccaagccctccttagtgtaggtggcttaataagagtcaggagaagaaggtatatgcccagagagctatacccctgactgataatcctggaaagaggttgattttttttttcttttttggtcctatgggaaacaggaatgaccttcttaatgaggtgagatcatgagaagcctttccatcttcttttattattctgccttgcaaaggaaaaatgacaatagccaaaggaaattacatccagaaatccaaaggtgaataggtgataactgtgggcctacttcccattttatgagatgcactgtcttcactagcacaatttgatcttaagcccaagagagctagatgctctagaagccgtgacctttcaatttctcctccaaatccaatatcagcaaccatccccgcaacatctgcccaaatccatgcccagttccctgagctgtcttctccctttcctctcccattcctcaaggcccagcaccattttctgtagtgcctatgtttgtctgaccagagcagtgtgtacctttgccaaccagttactggatgagccttagtgtcggcaattttctaatggaaatatcctcactcttaccaagctttgagaaccaagatgaaaagtcccttgggctgaccatcaggcctcggacctcatggggatgcagccagccaccattgaatggaggcgcttcccttgccgcaggcttctaggctttgttcactgcggcagtgtggatgtgacaggcataaccctgaaaaacctaggcaccacttgcatttctcagttaaccatgggcttcaacaaactgggaggaggaaaaaacagaaacagatcctttcaacaagcatgtaaattacagaagacttacctagagacggggcaacaatgaatagtaggaagcacattgcatgggaaacttgagggccgaggtacaggccaacagctgtcatcttagctacgacatgacatcggctgggttgtttcacctctctgggccagtttcttcatctgtcagatgagagattagactagaatgagttctaatttccctttcagttttgacggtcaatgatgctaatctgtgatctgaaaacctaagtagaaattggcatggtgggacagcacaattaggtaatgaaaattcactagactccctgtttaatgaggaaagaaggaaagaaggaaggaaggaaggaaggaaagaaggaaggggagggagggagggaaagaaaagagagagattgattcaggagtcataagtaaaacacacacacacacacacacacacacacacacacgaaaatactgcagaaaagatcatgccgagtgagaggctgaactctttttgtccataaaaacagagaccaggtacctgggtggtgccagcacgcccacttcatcaaggaagttgaaatggaaaaagattatgtgttgtcaattcaggtgaaagtcaagaaacatcagtggaaacaaaaatcttccttttattgaaaccattctacactatggaacatttttataaatagtaccagcggcattgcatagctttattttgaagcaagaaagagacttcaaagatcagcttattcaaccctctataaaaggatttatagattccttttatttaatagggtgattttctcatgagttttcaccatgtttaaaagacactgtgccccactctcatcccaaggtctatggtcaacttgactcaatgctcataactttcctcrctgattcctgcttatcctgctcctccaagcacaactgcatttcccaaaggtagatccagtaagcaatactctcaaagcacccaccctatgcacaccagtttccctcaagggactcaaaaggaatcgaggtagacccttctcagaggctgtttaactrcagacayatcaggatatgtactaatacccaaaaccaaaaccaccaccaatgactgcaatagattcactgtctagacccaaggtccaggcagtttcccttttttgcatttccccaacatataaagataatttccaacatatcagatgcacattcaccagggttatttctggaaggtgaaggggtcaggtgtagaagaggtggcaagaatgacaagtctgtggaaaactgttggccttgagaccacagtgaactggtggaaggggacttgctaagtgtggccacaaggtggcagtcacctcctgaaaccccgtgtgaaacgtcagcggggttgagaaaggccacgtctccaagtttccaggagagccaaaccaggactcaggaaaaccggccagctgatttgtatgggagattgatttgtaaaagaacaacaacaacatatggcagcaaggaaatgcaaagcaaacatctacaaatatttgaatccacctgtccctcacctaccarcttccccctctacyactcataaagtggtaggactcmtaatgccccgcttccttccacctgagaaccaaccagcaccctgatatttcaaagccagacctaaagaaccatggttgccaataacctcaatgccaaaccaaacaatcctaatcacatttttacttttcaaatccagtctcagagcagagctgtagattaagggacaaaaagtcattgtggaatcttttcaaatagctcttgtaaaagcatcagttgggaaagagtttatgagttcctctttgtcctctcctctggagaaaagacagaacatgcaagaacactagatacaycaagctatgggtgttgaaatagactagctggtgacctggatttgcaaataccctagggwcatgaaaacattttttctttttctttttcttttttgtaacctccacccagaatttcaggaaaggtggggccacatgcccaggatatatggtattctactgcttgctttcttatcaccagaatactagtcaatctgatttcttagttccatgtcttttcttccaaggaggtagggcatggggttgggggacactttccrccttccttgcatctcactgtccactcttaaatttttattaagaaacctctgaaagattcaaaattcagttcagtttcaataatcccaaagaagttgggataatttgttttcacttgcttcaaacttgccacggctgcaggaggagtctcaggacctcagaggaatggggcagatgtgtgaagtctgggagtctgcctcccacccagatgccaggagctgcatactcagctctgcctcacttccctgatggtctgctttcatccaggttaccatgacagagagggtctatcctctaaagaaagctgagttacaggctggcccctggggttgttcctgtagcctctctttgaccacattcctgaagatgtttagctgaatgcctcctcaaacctttgcttcttccataacccaatcctacacatatgtgataaagctttcttcaacaatactgggtcatttggacactaccagtccagatgagaactcacagaccaaatgaaaactttcaaaagcaagcagggaaagtaactcctatatgctttaagatgatgtattggtgtagattcaggtccaatttgaaaaaatgtctctggttctttctaattgtatccactctggatttgtttatgccagttctacattcatcaagccttgagaaacaggtggaaagaagaaaaatataaaattaagaagaagctgatggatcattggagattcaaaacaagccttctaccggtggcaccacactgaaaggcagagacaaggcaggagcggccatgggagaggaagcagcattggcttctcacgttctggcctccagcctcccaccagagcttctgccattcacccacttaacttgaggagaaactaaggcaccaaggcctgtcactgcaccgaaaaccagaagcagaaggactttctttctttgctcaaccagttctgcctggatctgacttttgcgtcaccagtagtcacaagcctgatttgtcatctccagcattctgtttatttttttaaggtcaatctttgcctgaaacatgacttcattgcacctgcagcacttcattgtccaaatgtccttggcaaacctcacagtctttggacagtgttgcattttctccaaaggggaaatcctctctccttcctcaagcttaataaggctcttgcagtgcatccaaataacacagctcttgttcctcagacacactcagccccctctgataacttcataaaacagctccttattgtctgggccatgaagccaggctaatgctaaagttccagttcaaaaacatttaactctattatccttatgaggccagctctcctgggtactggcactcactcactggcaccatggattcaggtcaggtggtgcaaacatcttccctgagaagcaagccatacacccaacaggtctagaacacctaggtcacaagaaagggtttcagtccagatgcactgtcagtaagtgaacacaaggacaagaatgcatgaactgttattttcttcccatcactggtttagcagcccctagggagaccctgtgttgctctttaatattctgacatggagcactaatatgctcaacactgcctccaacaggcaaatgttggaaatacactttcagagctggatgggactcaagatcatctaatataatcctctcattttatttcctctcaaggaaaccaagggcaagaaagtttaggcaatttgctcacattcacacaggcaattagtaacagagctgagttcrggtctggtataggctttttaatttgattctccacaaatgaasactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataagaaacattctgacatctctttccttttctttctttttaaatttggtagacgagggagagggtccccaacagaatgagagggggaagataagaaccagaacataaacccaataccccccaccccactcttttgggaacatcccaacattagaagagtgggatatccagtcatatttttcaagctggagcaggcagtgtagccaggattgaggaaggagaagccacagaataaacatggcacatgttctcagagcatcaattttactccagaatttgggaagaaaggattatattattagtgtattcaaaccagtatggatagcacaaatgcagatatcctataaattttgaggctaactccagcaggttgtagactgatttaggctacctccttccagactcccaggggtacaaacaccttcacagtcccctgcgggagtacatcagtggaaatatttggggaatgaggctagaaggcaggagatacattcagtttacttatcccyctggtttcttttccccactccttacctgccccacatccctagtgggtgggaaggcatcagaagacagttggctacaatatcagctttctctgctactttggggaatttagaaggaaatcagtacttggcaacctggtatttttagctgccaggccaaaactccagacataaaccccttccctttaattgaatgatgtttatatataaaggaatagatctccccaagaaagaaccccagaacactggttccattccagtgtgggggctgcttgggcagcagtgacacctgtgcattagatgcaatagacacttcaattcctgcaaaaatgtcggccaactaagtgctcctttaccaactgcggaggcccagactcacaccatggtcccacagactcaaggtttagaatctatgtgagtctattttggttaacacacaggctcctccttccaatcattcacacacacacacacacacacacacacacacacatgcacacacacacatgcatgcacacatacacaggtgcacatgcacaaacacacacatctaatgattccaacctcgaatactccccaggcccatggggatgcccaagtaccctaagcaaatcactgtgacactgagggggtcattaactggggctccgagcagctgaaacccaccctggtggtctctagattgttgttctgagaaatcataaacaccaaatcctccaatccctttgaatttgagtttgtcattttaacctttaacagccttttcaggtaaaaataacaaagaccaatttattgactttgtagctacaatragcttgaaaaagcgcttacttaaaagaaagactggaaggaagaaaaaaaaaagaaaatggagtacatactcctcagacgatgcacactttaattagctaaaataaaaataaaaatgtacagaggaagggagaggaaaaaccaacttctctgatcctttcatggcactgtagctcaaagactggaatctctgcttgttaaccattgttaactagtatttttagtcctggttgcttttagcctctgtatagttccttttttaaacacattttctatacgttaataaaagatcctgaaagaaagatgcgtgtcttctgagtcctaggggcactggggggcatgcctgtcttaagaatgggcctggcttcttttctctgggcctcccctccttaacatttcagtcctgcttctgccagcccrtcttctccgcatcaccctttgggtggactgttctcccccatggccctgctcccccttctatgccccttgtccgccctgtttctgtgctttcattatatcctaaatatctcagcccccttcctcattcttccctccttcttctctcctcttttctactctcctgcttctctcctctcttctactctcctgcttctctcctctctttgcatctttctctctctctttgcatctttctctctctcttcctttctctttcttccctaccttccacccactttgaggaatcgtaaacaccaaatcctccaaaccctctgaattttattttgtcattttaacctttaacagccttttcaggtaaaaacaccaatttcatctcaccctttgcttttaccatcagaaaaggtcaccaacgggtggtggtctctgctgccctagcattaccagacaggccttttgtacagttttgagtccttgatcagccacagagacggtgactcactgcctacctccttccagtctcgtctcctggctccctcaaccctgaagtgcccaggggtggtctgatccccaaggctctagtgccatctgtgggtactgccagagaacatttgacaggcccggtgtgctgagccagcctgccctccactccgtcagctcctccactgccaggttctgttgctctgcctgggagcagctccagctaatgcaccattagccactgcctctcagctttggtcacttggaaaaaccttttccctttctgtcccttaaaaatggacccagtgcataatataagatcaactctcaccactgggttacattaagtaagaccccagtcagggaacagccccaaaaagagagtcgtgatgggagcttcttccagtccagttccaggagcacaggcagtcaggaagtgcagagataactgagtaacggtgtagggtaagcaccgcaaacccagacatgctctcccatgctggagtgggcagggggatattaggagcctgtctgggggaggtcgtatgacaacagaaattatccaagggaaaaaaaagaggtgggagggagcctcatgaaccagggtcgggggcatgaaacggcagagcctgctggaacggggccaggtgtggtttagtactcatgtttgcttgaagttcaataacagagccaggaacagactgggcattgtgaagacccaagaccacaaaggagagacctttctccatcttccatgttaaaagggagaaataatgagtgctttaaagaaggaacagaatcccaaccctggaaataaatttttaaaaaggcttgacaccagcaggcttcttcacacccctggggccatgtgtaaaacagggacaaaactccagccacatggccatctaccatagaaggcaccctcgcaaacagagcaggcaaagcacctttcctagcccttgccctgtgccgcatttcctctttttctcctcatttcctaaaaaaaaaaaaaaaattctggaatgtcagaccaaggtggccctttaaaaacagccacatttcctggtcctgttttaaataagccattctggaaacctatagctcaggattatgggactggaggagtgactgctgtaatattgagataaaaacctgtcatttgtcctgtacgttgtcttgaaaatgaaaatggaaactaatgtgatacagtgaaacttaaaggaactttagtaattagtatttattcctgaggttgctgaatgctagcattatgttctaacttaaatgggtataattcacccattgcttaagacctctgggtgcatttacaaccaactgaacacaaatttaattattgttgtgttatgggaacgaagaactgccaggggtaatattaaaagtggattattaagcaagagaaatgttagcaacattagtaatcagtgcaattacccagtagcatcttcttgcccgtaatacccccagtgtccctggggatgtgtgctttagcagtgacccctttgccagtcagcaataagacatcaccacaaattagggccctctgggcctgtatctttccactcatgtgacatgtacaatattccccattgcccagtctttcaaataattataaaaagagtatgcgttggacttgtaaagctacacataaacgagtctcttgttcctcttcactcatctcaccatccacattcaatagttacctactatataccagatccaatactgattctggatatacaaaaagatgaaaggcctgcacaccctctgcttctcccagaagagatttggtctctctctgtctctctctttttcacagttaaaaaaaattcttttatttaaactttaataccagtatgtatcagtcaggattctccagagaaacagaaccaataggggatttacattatgtttgcgtgtgtgtgtgtgtgtgtgtgtgtgtgtgtgtgtgtgtgtgtgtgagagagagagagagagagagagagagacttatgaggaaatgacttatgtgattatggagactaagaagtcccacagtctgctgtctgcaagccacagactcaagacacctggtcgtacaattcagtccaattccaaaggcctgagaattagaaaagccactgttgtaaatcccactcaaatcattaaagaaggacaacatttcagcttaataggtgggcagaaagaaaacaaaaggcaaattcctctatcctcagcctttttgttctattcaggtcctcaatggattggacgatgcccactcacattaggcagagcaatctactttactcagtgctccaattcaaatgccaatctcatccaaaaacacctttgcagacacacccagaaataatgtttaatcggggcaccctgtggtgcagtcaagttgacacataaaataaaccatcacacagttgcaaggcagtaaacaaaccagatgtggttcctttcccagagacgttcctgctggtggggaagtcattctctagaaagagattcagcaatccatggcccgacggccagacatttattctctttttgactctttccttttccaccagtttttaccaaactccctactctcttattcagatatttcacacatatgtaaggctccttgcttcaaagtttttaaaatagaataaagtaaaatttccaaacttatgtttatgtgttcatgagaaaatggaaagagatatacagtgaaaaaactcagttaattagatgagcgttgtcatttcaacactgacaatatttttttaaaactcagacacatttcaaacacttctaacactaagaaaagtggcaattaaggaggctcttgaatccaaaaagttgacagaaccttctaaaaagaaactgattactgtagaattttccccgggggcaggggccaggggccagtggaaggtatggatcaacttttagatgttgatgccctttaatgctttaaataaaaattgctatcatcagagatcactgctaggcattcattcacagctgtgctcttcatgacaaacaacaagctcttcagaggtttctggcaaatatgtgtaaattataagaaatgcagtagcaattatgaaaattcagtatgctagctgtacaggaaatttaaagatccaagataaacaatgaaaactgaggaacgcatatattatgcctgcatgccggtaatacctggcttgatttgtgagcccactcactgtttatgatttctccccccacaaataaaaaccacaaagtaataaccaaagcttgtatttacaaccaaagctacactgaaacgattggcaacaacaataacaacctgggttgcaattaaaggtaacccagttgatttattgacttggaaaagcaagagatgattaaagaagtcaatgtggaacggcctgccctcctatcctccccaacccccaaccagtaccatttaaagaaattgagacatattcacataaatctggttttatctttcaacgaaatgacctaatgttaactcggtttgaaatgtccacgctacaaagcagtgtttcaatacagcagtactattgacattttggtcagataattctttgttttagggacctgccctgtgcttttacccactaaattccagtaggacccccgcctcccaccatgttgtaacaaccaaaaatgtctccagacattgccaaatgtcctctgggggaaaaaaaatcaccctcagttgagagccactgttacagggagatttatcacagaaagaagagataacttcaatccagacttcatggaagcaaatttcaaaaagcttcaggctggttcatttcagcccaaaagacaaaaggatcgcccaaatggaacattgttatagcttttctattgaatttgtctttatatagtttataaatgtttgaaaagcttatatctgtgttttattttagtttcattttgtcggaattactctgggtatttttgtggtatgagattagattccaaggtagaaagtggaattgataaaatgacacttacagaaaatgagagtttgtcttacaatggttcagtttgtcatggctccctaggaatcatttagatttcaaaccaagagtcacttgtaaattagacctttggctctgttgcttcacctgatggacaataataaatggtatcgattgtttaagatccccaaatacctcacaatctcatatgtcctaaaggtttcttaagaagaaagaaatacagggtaattaggcactaaagatagaaggaagagaagattttgtgccacaattctacctaagaatgatattcaggtccaggattgcagtcaacagagcaaggaagggcagtatcaccacccaagctccccaggagaatgtgaatatctaagtcgcatgcctaagggagtgttccatgatgttagggaaagcaaagggctaaccagctgtagtctcagcttgtggcagaggaaaacaccctcagctaaacccctttacccaattcatcctcccagataagaaatccagtacacagaaaggaagagactaggggcaggggagggtgggggcagatgttcacctctagctttttcagagatgtttcaatgctgatttttctttccaattgtcctggccatgactgttgggctacatggtccagttttgttttaaacaaatgtagtcaccacagtaggtctctgtaatggcatgttagttgtgaaggtcacctgggatcgggtcaacatgtgaatgtgactggcatcaatggtcctcacgtctacttctcttggccagacagacagatcagttcagtctctcaagaaacgctgataaagtcccttcctgcaagggtggaccttaccacagagctcacagcaaagaaggacaattcgaagttcacctcttggtgctaaaggaggtatgctgctctccgtcatgatcctgtttatcacagggtcttctttcagatcgagagccagtgaagcatccccaaacaggtctctcctattagagcctggctgcaacccactaccagatttgcagaaccatttatttctcttccaagacaaaaacaccctgaggaggaaagacctccagcttggcggagtaaagggtttattttctttccaaagggctggagaggattgggaagcaattgggaaagcaccggtgagaagagaattcccatcatctgtgaactctttaagggaagagccttggctttccatttctatttccagtatttagcccagaactctctttggactcagtatagaattgatgtaaactgaattgaatcaaccgtatcttccgtctatgaaagaaactcaattaacagcttttagtactgtaaaatttaggacagatccataaaatattcaagaagagcaaatattaagattatctgaggagcagaggaaagaacattgtatttgacgtcaaaagacctatatagttgcataagtttgttctcacactgctatgaggaaatacctgagactgggtaatttataaaggaaacaggtttaattgactcagttccgcattgctagggaggcctcaggaaacttacgatcatgatggaaggcaaaggagaagcaagcaccttcttcacagggcggaaggacagagtgagtgaaagcaaaggaaatgctagacataaaaccatccgatcttgtgagaactcactcactatcacaaaaacagcatgagggagactcccccgtgatccaattacctccacctggttctgccctttacacgtggggatgatgaggattacaattcaaggtaagatttgggtgcagatacagagtcacaccatatcagtagtcaacctctttctgcctcttactggtagtgtgccctaggataagtccttctgtcactcagg

SEQ ID NO: 10856 - DNA, 13337 bp, Homo sapiens
tatttattcaacacttggcaagttgaaccgtccaagtatgaaaatattattttcagggaaagctgttatctgtttatccatatagagtgataaatacattaagtttttaaacatatttctgagtcacattaaatttttccattgctaaactaagaagatattattattattattatatacaaaatcatttaccctcataaattatatcctcctaatatgtgttttcatatttctgtatattccaaatacagaaattatgtttcatttctaatcagaggcagatgatgccttcagtacccagaagccaacatagatcctggaaatatcacaaatgccagcacacacatggtgtctccttgctggtgtcagatgtgtagctctagcaaagagcatccatggaaatagctgaaaaatagaaggcaggtaggtgggggaccagataccagcttctaaaatcataatggaatgaaaccgcaagaggcagttgtccaatgaattgagaaatataattcaactggatatggcagaacagggtgacctggtacaaatcttggccaaccagccaattggtaaataatagagaaacatcttttatcaatttcaggttcatttttctcctcactgtcctcatctaaattctacccattgttcaaattccagtttaagtctcattttatttaatagtaatatgggtgatgacaaaaatagtatttacatatatgttcttatttcatctttgcaacagctctttaaggaagtggatcctcagaaatgttaagaaacctgacaagctatttgtccaaaatagtattgatgagtttaggacttgtggagaatacggctcttatgcaagatccatgtgaaagtttgtaggaggtttttggctaggtgagtctcaagtttgagggtcaaagcatgactagacataaagttttggaaatctttagcaattaatgatgatagcttataacaagagaatagatgagatcacacagagagagtctctggaataaggcagggtgtctgaggtctgagggatcttaggacaaaactcaggaagacaccggtatttaaaaggtgaatgaaagcacagcaagcagcataaagaaactaggaaggagcagctagaggggaagaaaatcagtagagtttggtgtcacagaagaaaagagaggactgaatttcaaaaagggattggttgaaagagtcaaagtctacagaaaggtcaagttaaaagaaacttgtactattgggtggggaaagaaacttgaacatgctcttactgtgatgggaaggagccagtgaagaggaagaggctgaaacagataagagaatggagcgctatgaatggatcaaactccccgaggagatgggagaggctggtatccaaaccacaggtgaagaatttagttttaaagttgaaaaagagaaaaatccttcctgtgagagtgagtgaggcaggaactatgaaggaggcttgaagacagtatggctactgagaagtataagagaaggaactgagcaaacaggcaaacagcagccttccttcccccacaccgtaatagaaaatttattcatatggcttttggtatcctcttgaaagccctcagaaacatctgagatccaacatcattactagtattcacttttctcacacatgttcacacacattttctcatcattcatcagagcattctatctcaggatgctgaggaaacaaaaatatgttacagcagtctgaactaagtgaggtatatagtcccagagggacatgagtatgggactttaatcatatcctctgtgtccgtatctgtgggcaattatttaaagtcattttgtttttgacaagttgtcttacccaatatctttatgtttttaaaatttgtaatacaaataataatgtatagccaattaatagtttatgctattttaatgtaaatttttaataaataactaaggaacgctctcttaaaaaaatacttgtaactgtcaattggggtatatatttaggacaacttaaatttatactctgacattacaatcctcaaacttggcccaaataaactcactacttatattaactttgcttcagtttcttccttttaggttgaccaggctaagttctgaaatgtcttctcctgttcaccgaattaggtcatgcatcctagtagcggcctcctgtttttgatagctccctgtctttccagaacatcttggtctgacttcccttcctgccttatctactcagccatggtagtggtgctttttctagtgtccctggttagccttcacctgtggtttgaatcttgtaatccctctaacagctgccagcctctcacttcactcatgtacagggcatacaactgagcctggttcccactgttggcccaacaagggcatctgctccaccagcttgtaccctattcacttccctgaactgagagccttgcaactttattttcttccatctacacctacatccccctactcctccagtctccaaaccccacccagaaggtctctgagctcctttcacctgtgtccagaatttgtgggttcttggtctcactgacttcaagaatgaagccgcggacccttgcggtgagtgttacagctcttaaggtggcgcgtctggagtctgtcccttctgatgttcagatgtgttcggagtttcttccttctggtgggttcgtggtctcgctggctcaggagtgaagctgcagaccttcgcggtaagtgttacagctcataaaagcagcgtggacccaaagagtgagcagtagcaagatttatggcaaagagcaaaagaacaaagcttccacagtgtggaaggggacccgagcgggttgccactgctggctctggcagcctgcttttattctcttatctggccccacccacatcctgctgattggtagagcccagtggcctgttttgtcagggtgctgattggtgtttacaatccctgagctagacacaaaggttctccacatccccatcagattagttagatacagagtttccacacacaggttctccaaggccccaccagagcagctagatacagagtgtcgattggtgcactcacaaaccctgagctaaacacagggtgctgattggtgtgtttacaaaccttgagctagatacagagtgccgattggtgtatttacaatccttgagctagacataaaggttctccacgtcctcaccagagcagctagatacagagtgtcaattggtgtatttacaatccctgagctagacataaaggttctccacgtcctcacccgagcagctagatatagagtgtcgattggtgcactcacaaaccttgagctaaacacagggtgctgattggtgtatttacaatccctgagctagatataaagactctccacgtccccaccagactcaggagcccagctggcttcacctagtggatcccgcaccagggctgcaggtggagctgcctgccagtcccgcgccgtgtgctcgcattcctcagcccttgggtggtcgatgggactgggcgccgtggagcagggggtggtgctcgttggggaggctcgggctgcacaggagcccatggagtgggtgagaggctcaggcatggcgggctgcaggtcccgagccctgccccgctggaaggcagctaaggctcagtgagaaatcgagtgcagcgccggtgggctggcactgctgggggacccagtacaccctccgcagccactggccggggtgctaagtccctcattgcccagggccagcagggctggctggctgctccgagtgcagggcccaccaagcctacgcccaccggaaccccagctggcccacaagcgccgcacgcagccctggttcccgctcacgcctctccctccacacctccctgcaagctgaaggagtgggctccagccttggccagcccagaaaagggctcccacagtgcagtgcggggggctgaagggctcctcaaatgccaccaaagtgggagcccaggcaggggaggtgccgagagcaagagagggctctgaggactgctagcatgctgtcacctctcaaacccaccttccctttcagagcagaagtgtgtgtgtgtgtgtgtgtgtgtgtgtgtttgggggtccattccactccgggtgtgcaaatagccactttatcgtctccaaaaaacctgcccttccctctccgtctctgggctcgctgcagttcccagctcagccgcttggcgactctccattcaggaagtgccttctcaaaggaagctggtcccagctggccttgcggcatgactcagcttttctctgtgatgtgtcgcggagttgccgatagggttcggtgtggcgaggaggacctgcttctctctttgtgagacaagggagtgagggaggaaggaggccaaggaggaggccaggactgagcaaggactaaagtaagactgaaaggggaggtgaggggtggactggttggtggcagcaacctgtaccggaagcggcggcggcagccgaggcgacgcaccgtgaggcagctgcttgactaggccgcagccgccatggcgatgaactttggggaccatgccagcgggttccgccatgatgatgtgatcaggttcatcaacaatgaagtcctcaggaacggcggcagcccagccttttacacggccttccgctcgcggccgtggaacgaggtagaggaccggcttcgggccattgtggccgacccgcgggtgccccgtgccattaagagggcctgtacctggagcgctttggcgctgagtgtgcaagtggctgcgaggcagcaggaggagctgctgtaccaggtttggtggctgcaagggcatgtggaggagtgccaggcgacctcctgggctctaacttcccagctgcagcagctgcgcctggagcatgaggaggtggcaacacagctgcacctcacgcaggccgccctgcagcaggtgctgaatgagcgtgatgggttatgcgggaggctgctagaagttgagagatccatgcaggtctatccgatgcctcaggattttgtacccggtccagaagccggccagtatgggcctgtggccgggactttaaatgcagaacagagtgaggcggtggccacagaggcacagggaatgccacattcggaagcccaggtagcagccccaacagctgtgtattacatgcctgaaccccagagtggcagggtccagggcatgcaacctcttctgctaatgcaggcacctcatccagtcccattccatatgccttcaccaatgggactgccatactcaacacctctaccacccccagtagtaatggaatcagcagcagcaattgcaccacagatgcctcctgcagggatctatccacctggtctttgggccacagtgggatcccaggaggagacggcccctccgtgggaccagaagtgccatggccaggatggatatcctgagaatttccagggagtatatcacccaggagataacagaagctgcaaccaaaaggaaggttctgagtgtccccaaggaatgacttcccaaggggacagcagcagccacagcctgaagaaagatccagtgatgcaagagggcacagctcccccagagtttagcaggagccacagcctggagaaaaaaccagtgatgcccaaggagatggtccccctaggggacagcaacagccacagcctgaagaaagatccagttgtgcccaaggagattgtccccataggggacagcaacagccacagcctgacgaaaaatccagttgtgcacaaggagatggtctccctgggggacagcaacagccacagcatgaagaaagatccagtgatgccccagaagatggtccccctgggggacagcaacagccacagtctgaagaaagatccaatgatgtgccaggagatggtccccctgggggacagcaacagccatagcctgaagaaagatccagtggtggcccagggcacagctcccctgatgtatagcaggaggcacagccagaagaaagtgccaatgatgcccaaggagatggtccccctgggggaaagccacagccacagcctgaagaaagatctagttgtgcccaaggagctggtccccctgggggacagcaagagtcacaggatgaagaaagatccagtgatgccccagaagatggtccccctgggggacagcagaagccacagcctgaagaaagatccagtgatgccccagaacatgatccccctggaggacagcaacagccayagcctgaagaaagatccagtgrtgccccagaacatgatccccctggaggacagcaacagccacagyctgaagaaagatccaatgatgcmccaggagatggtccccctgggggacagcaacagccatagcctgaagaaagatccagtggtgccccaggrcacagctcccctgatgtttagcaggagacacagcctgaagaaagtgccagtgatgcccaaggagatggtccccctgggggacagccacagcctgaagaaagatccagtgatgccccagaacatggtccccctggaggacagcaacagccatagcctgaagaaagatccagtggtgccccagggcacagctcccctgatgtttagcaggagacacagcctgaagaaagtgccagtgatgcccmaggagatggtccccctgggggacagcaacagccatagcctgaagaaagatccagtggtgccccagggcacagctcccctgatgtttagcaggagacacagcctgaagaaagtgccagtgatgcccaaggagatggtccccctgggggacagccacagcctgaagaaagatccagtgatgccccagaacatggtccccctggaggacagcaacagccatagcctgaagaaagatccagtggtgccccagggcacagctcccctgacgtttagcaggagacacagcctgaagaaagtgccagtggtgccccaggggacagcctccctggggttcrgcagaatccacagcctgaagaaagagttagtgatgcccgaggagatggtcccyctgggggacagcaacagccacagcatgaagaaagatctagtgatgcccaaggagatggtccccctaggggacagcaacagtcacagcctgaagaaagatccagtggtgcaccaggaggtggtctccttgggggacagcaacagccacagcctgaagaaacatccagtgattccccagggcacagcctcactgaggtttagcaagagccacagccagaaggaagatcaggagaggccccaggtaacccctctggaggatagcaagagccatggtgtgaaaaatagcccatggaaacaccagcctcaggggcagaaggtcaaggaacaaaaaaggaaaaaggcctcagaatcccagcaacagaagcctgcctcatgctccagcccagtgaattgggcctgcccatggtgtaatgccatgaattttccacggaacaaggtgtgctctaaatgcaagagagtccgtatgccagttgagaatggcagcgttgacccagcgtaaactcattgatttcaggaaggtaagtaagatggaagcactccaaagagaaaccaatttcccaggacccccttctgataaaaaagtaacttatttacttaacagaaaatttgaaaccaaaattgtagagaaaattagataaaataatccattatcctattacccaaattaagtactttttatcattgtgagtatacatacacacaaatacgtatgtatttattttcttattttattcatttatttgaataaagagagactacttctgagtataacactcagtctttaattaggggatttctcctaattgctgtcaactttttcaggtagtagattgtggttggctgatactaattggttgacaccctggagaagctgaagttatagttataaagcctgttttaaatcaaccattttctgttttttttttttctcttaacctccttttcctgaaaatgccatgtatttggctgggagcagccatgtgattttagagttccaggctatattgtattctagaaacactgcttttccttgcaagtgctatcattccttttgaaattactgcagtgttgatttttgcttatttttgttttattagttttacaggtgaagtcctgtttttgtgtcttagctccaccaaacttgcttgtttctgaagaagctgaacctgtgacattagaagatctgccaaagccacaagaagtaacacctcaattctgatggacccacacctcactgagaccccaactggctgcagtcaagaagagtgaaaggaagtcagggaagaagagatcatttgacactcattagggggaaaagggagaacaaaattgtttttgtagagttgaattttttcattggtatgggaattaacttagaaaagtttggggagttgtagtgttaaattctatagatggtagcaactttgatgaatttcacttaattcattaaatgagaagtttagggaaagagtttagggggttgtagtgttaaattctatagctgatagcaactttaattaatttcatttaattcattaaagaaatagttattgcctagtatgttttgggagctagacttgtatgttattatctagtacacacagcataatcttttattgtgaattcggttagaagataggaaagagcataatttggcatacacattagatcagggatgtattctttgccttgcatatagcgtgaccttggataaaaccaattgaagtaacatccagatccatttctgtggttctggggccaatgcgaaagagactttcatgaaaggttttttgttttgtttttgttttttttaattttttggagaaatgaggtctcattttgtcgcccaggctggagtgcagtggcatgatcatcatagctcactgcagcctcaaactcctgggctcaagtgatcctctgcctcagcctcccgagtggctgtgagccaccatgcccagcccttatgaaaggtcttgagtaaccaaactgcttgtctcattggtctcaggtgagataaatgagcagtgacaaagtttgggaaagtgtcctcacaaaaatgcaggcagagcttttctgaattcctctgctgatttcctcctttgagaaggatagctattttcctggttgcccaccagcctgcctgaaagacctggggtgtcttgaagaaaaacagtgctttggggagtgttcactacacacgctagctttcagcctcaggctgcccccatcccaagtcccttttcagtcagcagtggatgaagaacaaaatggattccaaggacaaacattgggggcaccaggttatggatggtgtttctcttgggaggataaattgggttaaaaatagagctagactggggcaagcacttttgggaataccccaggacccccacctctccctctttggtgtgttctctgcaggcttacccaaggcaactgctgcaaggcaaggaaggagccagggtggagcccaggggtggttggttagatctgccttcaatccaagctaaagatgtccttgagtttcccaatgagatcccacccagctcaccaaaatcaatgtttgtcagggattttctgggcctaactagtaataaagaatgtgcatttgactgctgtgtcttctgtgtagtgtgtatctcagggcaggtttgctcagaggtggcagcttaaatccgcatctgcccttcatcccactgaagtgaagaaaagttcaatctcattcactattggagggcccctcctcttctaaggagttacccaagaatgggggcaaggtactatgtggacttagacaatgattcccccctacactcattgtctaagtccacatagtaccttgaaggtgggcatttctgctgctgtggggccagtgggagatggaaatgtctgctgatggtggaagccttgatgcctagggtccagcctccttacatgcaccatgtacccattctcctttggggccctgctttctttctggggtctttgcatagagtaaggggtgcttagttatcatgagcagaaatctccttcttttctttctgttctctaagtcactcttctgtcagcataattctttcaagatgttcaggattaaagaaaaccaaatacaggctggaagcataaacctcccctaagataaggcaggggaaagatctgggcatcttcttggaatgagtatggtgagataaagggtgaacaacaaaaataatcttaccataccagaaatttttctcagagatgtgacaaacagtaagggctttgtttacctgggacaagagtacaagaaaagaagggggctgttggggaacaaacaccttaacttttgttggggagagggacagatactataatattttgtatatcctaatggctcctgtatgtttgggaatatgggtatgtgcaggtattttttttttcctactgggtctaaatctagagctgatatgatacaggaggaagagtagaaattgtagtggtggaggaagaggggaaggactccaggtgctgccagtagtgatggtaggagtgggcctggtgctgctgccttgcaagcacttacggaggtggtggtgatggatgaggaacatgggtattgctctgagcaagtgaatgcaggggaagtgggaagaggcctattagagtctttgagggcctcagaacaagagaagcaatattttctcttactgctcacccattcctacacttcttcataccctgctagtgagcctaggcaggagcagcattgccttcacactcccatttccatttctaccctttaatataaaagcagaatcaaaagaagcagcttgaataagggcatgtcctgtgtgtgggacatcagttggcaggatcgaatgtggaaaatgcttctccgcccgcctcagactcccgaagtgcctggattataggcgtgagccaccatggccagcctaaaaagcactttttaagggaccttggagtttttcctcaaatggctcaaccctgcaagccggactggtcccagcacccctaccagagagctacagtcaatgctaggggtccaagtgcccccagcagactccccccagctttctcctggaagagggttggggccagcagggaattctggggttgacactcatggtccaggagccttctggtgcccagagggtagagtggaaggtctgggggtgctcagccctgctgtgtcctggacaggctggtccccatggaagctcagaaggaaagtgtgcaagagcaggtcaggaagggacctagtggtccgctcactgcctaacacccagcggtgctctcagcagcacccagcagcactctgcttcacgtggcactgcttgcagaagagatggttgtccagggggtagcagccttggttcctgggctccacagacaggaggatcctgcagtcctcacacctgtagcaatttacatggaagtttcttcccatgcacttgattttgaaggcatctttcccatcccgaggaataatgggattctcacagatgctgcatacgggagcaaatttcttgtagaattcgtctaggcagtacatctcgttttggctgcccagggcagagctctcatcctggatgcaccgggcacaggtcacacacatgaagcaggaggggtggaaggcctggcccagggccctgatgatgtgctcccggaccacctggccacacttgccgcacttctccagtgtgtcctggtagcagggtttgcagaggggtcgcccatcctggtagaagctctgcccagctagctggcggtggcaggtgtgccacgtgaagcactgggcatggtactgcctctttatggcctccacagccagctcttgcgggggacacggttttgtggcagaaggcacagatgtctgtggacgactctctctcaacaggctctgctggggaaggcggaagctcttcctccccaggcccgaggggactgggcccaggctggactgaaggtccctccactggggcctgtggtcggggtgggggcgagggcaggtgcaaccgctctaagtctgcaatgagtgaggcccccattggagcaggagcctcttcttcagaagacaggagcaccggagggggcagtggagggggtgggacgaggtccaggtcaggaagtgcgtcctcaccatccaggacaggaggagggggtgagcatcctccattggagagctgcagaggtgcagctggcactgtggctgcagccctgccagggggtgcccaggggctgggctttcccgctaagccagctccgggtgccttcatgggggcaggagcctcccaggggaggccacatcaggcctcacaaaccgcctgcccccttcctcaaccacagctaaatcgtggcacaggggtgcaagggtgataaagacagacgatgccacactcttctcaggctttgaggccatggcttcagctcctggtgtggctgggatccaattctcctggaaggtccgaaggcccggaagttcaggccagctccacttgtcagcccgcgcccgggggctgccatccgatgccctcatccataggattcgaccaccttgacttggttaactggaggttgcttgcttgaaccgttgcctcatgtgcttcgataaagtaatgcatgaaaccaccaactggaataaaacttaaaaattcactagaaaacagtgtaggctcagcatttgacagccagatagagttttctcagagaaatttccatatttttattaccatctagaaaaaagtaatactcatcgtattagtttgctagggctgccttaacaaagtaccacagactggatggcttaaacaacagaaatttagcctcacaggtttgaaggctagaagcccgaaacgaagatattggcagggctggttctttctgagggctatggggggatactctgttctaggcctttctcctgggggtgtgaatgtctgtcttgtccctgtgtctcttcacattgtttcccctctgtgtgtgtctgcctttgtccaaaattctgctgtttataagaacagcagtcatattggattaggggcctccctagtgagctcattgtaactaattaaataaggtcacattcaaaagtactggagtttagaacttcaacatgaatttttcggggggacacaattcaatccataacactaataaatatagtttttctacttagacatctgaattttagaacaattaagactattaaaactcttggaactcttgtgtagtatagtggataaacagattttggatcctagcaccggcaattgctagctatgtgatattaagcaagttgctta

SEQ ID NO: 10857 - DNA, 13781 bp, Homo sapiens
gccaggtctgggcagctgcaggtgaccacttccccatcaggctgccctgtcatgaccacctccccacaccccaaccccgtcgaagctcacttgcctcctccgggttttgctccagcttctccttctccagcttcacggcaccaggggtgacggtgcagggctccggggaggccccatcggagttgctctccaccccgactcctgcttcgccctcaggctgagaggtctccaagccgccttggggcactagccccactccaacctggggcccacagtacgccatccccccacagaactcatacggcggggggcatgggggaatcccccacacctcagagcctggcccaacccccggcccgattcctggccctccaggagggccttggaagcttagccaggtccgaggatcaacccagcccggctccggcccccctggcccatcacctccaccacctggagggggcgagaaggcgaaatctgaagccaggtgtcccgccatggggaaggaaggcgccccaagccgggggcctggtgaaatgagggcttgcgaagggactactcaacccctctctccctccccagtcccacccactagccttgacctctggccccgccccctggatgggtggaggagagggaggtggggggagaaactgaggcgaaggatgtttgcctaatggtggtggcaatggtgtctgtggaaggggaaaaccgggagacacaactggcgcccctccaggacctcagtgcaggtcccccacagaaactttttttatttttattttttaagacagggtctcactttgttgcccagactggagtgcagtggagtacaatgatggctcaatgtagcctcgatctactgggccaaagcaatccttctgctccagcctcctaagtggctgggactacaggcttggaccactgtgccctgttagtttttttatttttagtagagatggggccttgctatgttacccaggctggtcttgaattcctgtcctcaagaaatcctcccgcctctgccgcccagtgtcatgattaaaggcgtgagccaccacacccaactttcaactcccaacccgctccctggcactctctcaggctctgcacatcccagctgtctggaatcactcccacacctccatgttcttcaggaacccaggtgcttgaccccctctccacagacctctggcactgtgccttcaggggccagtcaccctctcagctcctcaaatttattgaatgtgtgtgtggcgctatccctcaatgcatcaacagccataagcacaatggccagctgctcccttatgccttcccccgatccatccagaatcctaggcattcccatcccgatactggccaaatccagccaccccgcagcctgggtgcctggcaccatctgcccagcctgccaaatttcaccccatcttcaagagtagactgccagacaaggcctccgtgctatatccccccaccccccatccccccacccctccgtcttccagaatcagactccagactctcctcatctaacagactaaggggttggcccctacttccccttcaagggaccagactttggactgattgggcctcagtttcccaacctttgctgaaacagagtgataagacacccgctttgggccccctccactatggaacctgcacatcaggttccttgctcccctctcaaccaaaactcagacatctaataccacggtaggccccgttctccctcccccacctccctggcccaggcctccagccctaggccctgggtggggaaaaccagggggtggggggtgtggagaaaaaatatctgacttcaggttcaaagaagcctgggagggactgggggaagggggcaggacaatggccttggctggacaatcccggtccccagagggggcagctctaaccctaaacaagtgctcaacccttgaatgggcctggatggctcccctggggactgcttcctgctccccaaccccccagtcccaatcccctcacacagaatccccttcagagacgctaaaaggagctccagcaacccccctctgcaatcccctcaaagactgagcctcagacgggcaccaagggccccctacagggacctaggtatctagttcctccttcctctggggaactcaggcgtccagcttcatcgtgcatccctccccgagcccggaagattgagggatgtgctttgtttagtggggctggctggcagaaagacgcagaggaggtggcgagtgatttgtggaggggtgcaggaaggctgccctaagctccccttcagggtctgtttttctgggcctggcctgagtatcctgaggctcatgctgctggtctagtgcttgattctgtttgcaagagaatagccaacggaatgcctgtctgtgagggatgatgtttgtctgtctgctcccaaaacttgatctcagtggagggcctggggtaagtctgggggctccagagggggctctgggccagggctccccacagcttcgaaggccagaaggccaggtctggactgggcacgctgacctctgtcgacttaagtaaggcttctcattgcaggctccaggctcagccctgcctgggcttgtctgctggggtcagtggctctgtctgccttctaaggggatgggtgtcccgtggccagctgtcttcatcttggtggcatccgtgagtcttttgagacttttcccccactcttatgttgcctctgttcgtgtgcccatctcctgtctgtgtagactttttgagcctaattgtatgcgtgcatttcaatacctgccacaggtctgccggaaggtctacaaggcagtggggttgcagctgtgttcacttctcggcctttaactgcccaaaaggcaggtagattatggggcctggtgggggtgggaggaacatgcttcggaacaggaggaggcccctccccagccatctcaatccccaggacagaaccatcacggcacctttgtcatgcatctctctgctgtctgccaagaagacggcctctcagaggagggggaggggcaggcctgggatttggctggaatctccacaccagtgtttctcagcttgccatcctccaggttccccaaaagcgctcttcccaagccagtccagagagtccctgctgcccattttcctagtggctcctaaaacaccttccccaatttccccactcaacaccaccctcttgtttttagattataatttgtactgtaggtggtgtatttctggcctgggcaagaggcccattcccgagagggacgcagacaaggggtgggtgcctgggtccctggctgccttgtggctggatatgagcccagtcaggggtcagcctcctgcatgcctagactcctagccggcccccttctggggtgctcagggctgatgggaggttgaggcaggctttccttccttctcactgtcctgttatgcctgaagggtaggtggcttcacttcagccaaggccagctctcccaggccccaaccagtgctgggggccaccgttgggcctggaggagactggaagccaggctgagtcatcagaactggtcccatgattccctgggttttagaaagtcaccataaaaagatacttcacacacacctttattattacagtgcaatgtcaagacccttcacagagcactgccaggggacccaggtgaggcccacctctccccaccaggtgtggcggctggcatggctgggtggggagaggtgagatgagcagccttgctgctgtcagcccagccttcccttcccctcactgggagatgaggtgctgtttggttgaaaaaccagctgaaaaaactcagttgggaccaatagagacttgctctcgacccggtctaggaaaccacttattttgacttccgaggcctgtcaatctgaaggcaaaagaaagggaagaaatggagggctgagggttcaggcttggcccaccttgggagatgatctcccttaatagcaatttagacaaattcctttgctcactgtggaccaagtcccctcttctcaacaaaggaccctctgatctcccccatgagacctgcaaactgaggtcaccttatcccaaatccagacactcttacctcaaatagaggagtcaactctctagctgtagcctgtagggagtcagaggtgagagcaaaaggagtgggtgagctgggaggattggtcaggaacaaactaggaggcatggaccaggttctaagtcctggctctgactccctggctaatggcacctccccctcctgtgcctcagtttcctcacctagtaaagaggatttggactcaatgaactctaaacttccttccaactaagacataaaattgctgcccggctctcatatgccctcccatctacccaccccccttacttgacatgggaatgtagacttctctgcacacctgtgaagagaaatgggggtaggaaagctgggagtggtgttcaatgagaagttggcataggcctccctgtaccctgccacctacctccaagcatccttcctggggaatctggcaggttttcccctgaagtttgatcaagagatataggaggaggccgggagcggtggctcatgcctataatcccagcactttaggaggctgaggcgggcggatcacttcagatcagcagttcgagaccagcctggccaacatggtgaaaccctgtctctactaaaaataccaaaaggtggtttttttgtttgtttgttttgttttttttgcatgtggtggtgcatgcctgtaatcccagctactcaggaggctgagaaacaaaaatcgcttgaactcaggcagcagagggtgcagtgagctgagatcgagccactgcactcggcaactgcattgctacatgcctccaaaccccagctgctcatctgaggttgcacagagactcagcatcagcctggtgcatcaccagacaggagagcctatgctcacgtcaaagggatcacagcagactgctggctctgggcatctgagcagcgccatgcaagggggcaagtggcttagggttccagggactcaggggctggggcagcccatccctcagctaagttagctggacactggaggatagaagtcaagggcctagcatgttgggatggctcctctccaggggctttgcagagagtcccatgcaccaagggggctagcgggacagggaaaagtggtggcaaagacctcccagacaaactggctgcctctggtcctatcaagctgccgtacatcctccacaccagggctttaggcaccattccactgtgttccatggtgactgtaggtgatgccccaccttgagagcccttgggtgctcagccctgggtcagaacttgaacaccaagtgggaaaagggctgaccaagcacgggagagggaaggaaagcagagtggctaggacggtcagcaacagagctgtgttcatttaggacatgggtattgaaatggagttttgaaggctggctgaggggcctgcactccatccctcccacagtgccctcagctcctccaccttccccacatgaaccagtccgcacctatcacacctacggtgggccgtggtcccaccccagctttcaggtgtttccggagagggtagacgcagctctaggtcaggaaggattgtttccttcccttctctccttctgcagctctgcttggttctggctggcttttgctggagttgaaagactcaagtgtgctaagaagggagtcctggccatgacagttgtagtgccagtgtccccagctgctccggttccccagcaactcacagacaaccgtggtctggagggtgtgtgactctgaaaagccaaaaccccagaactccaaagttacaagaggtcaaaacagtggctctctccacctccgctcctacctcctcccaaaatgcatgaaattcccttcctctgactgataaaccctcactcattctccaagacatatcttctctgtcaaccacatccccaccraagtcacactgcacccgctctccctcccctgcagcatgtggctccctcccatgtacccagcatgcactgttcagccacatatactcacccaccctcctgaaggcccagcacagacagcattgtgtttaaatccctgatctacacatcagctactggctatatgcccacggcaaatgtaatggaacctctccaagccttgctttcctcatttggcaactggacacaattatagtctctaccacacaagtaaagataacatgagataatccttgccagtgttaatgtaggacctaccaagaagaattcaagaactagtagctgctattgtaaggtgtattattggtaacagcaaaatgaacagcacttactaggcttaaatgtttgctagatkaaaaaaaatgatattggttagaaatatattttsctcaggtcaccaggtttcttattaactactggtggtggcgagagaggtgaatgtcagaaaaaggccagtttttcccatttcctggatttgagaaagttggataaatttttttcacctggccgggtgcggtggctcacgcctgtaatcctagcactttgggaggcccaggcaggtggatcacgaggtcaggagtttgagaccagcctggccaacatggtgaaaccccatctctactaaaaatataaaaattagccaggtgtggtggcaggcgcctgtaatcccagctactcaggaggctgaggcaggggaatcgcttgaacctgggaggcggagtttgcagtgggctgagatcgggccattgcactccagcctgggcaacaagagcaaaaaaataacagacttttttcacctgaagggaaggcttgggagcttaaggacaatggcttctttcttagagacctagtccttgactgagggaaagggtgagggtcttatacttctttttttttttttttttattgagacagagtcttgctctgtcacccaggctggagtgcagtggcacgatctcggctcactgcaagctccacctcccgggttcatgccattctcctgcctcagcctcccgagtagctgggactacaggtgcctgccagcgcacccggctaattttttttgtatttttagtagagacagggtttcactgtgttagctaggatggtctcgatctcctgaccttgtgatccacctgcctcggcctcccaaactgctgggattacaggcatgagccaccgcgcccagccagagggtcttatacttctgtcctactcttgctaatacctaagacccagtccttttggcaccactgggtacataaaacaaggtttgagtcagggatgaactcccccaggcaggaggagatagcatcaggatctcagtgaagtgggrtggtatctgagtgcctagcacagtgccccacgcagagctcaatgcatcttagctgaacaataacgaatgcagctgcacatcttcaggcccatattgagctcttctctcttttctgcctcctcctgagcccccaagcccaatyaccttggctctggttgtygtgtgccatgatgctccccaggatggtgacaaggtgctgggctctggccttcagtctgagaaccagcttctcccaagctcttgggtccctggcctgagcccaggatgcacggggctctgcccacctgccctccttgcagcatcataagaaagggtggtcatccaggtagcctgagacttcgtaaggggcttgcccagggctgggctgggaaagagtaatgaagtcatagcacagagagtgggttgctgaggaaaagagaatgatgggaaagggttattttccaacaggagtcttacctgggagacactgcacaaggtgcctgtgtggtgaggctgtgtgactatttttgagggcaccaaaggagtgggtaaggggaatgcagactgaacaatgggaagggaatctcttgtttccctgcagggcctcatctaggctcattgttttaaatagtaatgactcccaaatctcttcatccctgttcttcacatcggtatatccaactacctacctgttggtcatctggacctaaggttccatatggccttaaatctgacacatccaaaactgagtatttcctcttggccctggccatggaacaacctgcctctcatcctatattcctggtgagtggcatcatcctctcacctgcctgcttactcaagccagaactgggttgaggtgtgggcaactaccggatgtcatgtagcctcctggcacaatagcatgaagtgagctgagaggtcatggaacaaaaaggctcacagaccaaatgtaaatgctcaaataacatcgtttattaaataaatgtaaaacacattctgagaagcaggaggcaggtgctggggtgggtcaacacacgggagagggggcaagttgggtggaatgatcacaccagctgaactgtgggtcatgcagtgtgcatccatcctgtcaaattgaaacctcctgcatcctgagtgcctcatgtctcacgtatttagggtaccgtgaatatttagtgcctccttggtctttctgtcccttttgatctctgtacacacgaatatgttgtactatctacagatgactaatttagttatctatgtgtaacacttcttttgagtttattgttttcctgtcttctacagcagaattggatattcccaaacaatcggcaagtctggtgtttatcctagagtgctgcctcccttcacaccccctagtttcaaacagtcagcaagccctgcccatttttaacttcctgtttctccaatctggacattcctctacctccaccaaaccagcccatagtatggcttgcttggattatagccagagtctttctaactggtctctctccctccagtcttaagcatataaaatctgtcctccttgatataatcagagtgatctatccagaaatacatatcagaccgcatacctctctgctcttcctctaaggattccccttttgtcctcgggatggtttccaagctccttagcaagctaaacaaggccccttgaaggctgccgtctccaccctcatctcccaccacaccctgccttcacctgacccacttggaacaggaaggttggagcacctccatactcctgcagttccacctcccagtgccttcctgagatggtcccctgaagggaagacccatccttcccttctccaaacaccacttaaaccacttaaaccctttcattaaacccttaccctggcctcaaaccatctaccacgctgctgtacccctttatttcagagacggctctgactctcactcagaggtgacactcaccctaccacttgtctatggctgtgcatccctcttggggccatctcttgtggacaagaatatgagccacattcttcatatatgagaaaattacaccaatctcagaggattagaggtcatgccaaaaaacacacctggtagttatgtttaaatatatttttaaggctgggttaaaaaccacgatgaggcgaaaccccatctctactaaaaaaatacaaaaattagctgggcctggtggtgcacgcctgtaatcccagctactcaggaggctgagacaggagaatccctagaacccaggaggcggaggttgtagtgagccgagattgcaccactgcactccagcctgggcgactgagtgattctccgtctccaaatatatatatacacacacacacatacgtatatatatgtgtatatacatatatatatatttttttttttaacaaacatagctgctatcattggctccttttctcttttttttcgagacggtctcactctgtcacccacattgaagtgcagtggcacaatcatgaggcccaccccaacctctgcctcccaggctcaagcgatcctcccacctcagcctccagagtaactgggactacaggcgtgcaccaccacgcctggctaatgtttttgtattttctgtattgacaggttttcctcatgttccctgggctggtctcaaactcctgtgtccaagcaatcctccgcccagctcggcctcccaaagtcctgggattacaggcataaggacctcctacggccaagtttaagcttcaagtgggagacatgggacaattacttaccagatacaaccagtttcagaggaagccctacctaccctctaagcctgaccttatcttgcaacctccatcgccccagacctcccccggctccaaaaagcactcccaagaggcctcataaaggccacagtttggggaaggttatggctcaggggaaggggagaggtgctaaataattaagcccccctactactcagcacccgcgtgaggcatcgtcaggcatcgtcaggcctccagtggtggtggtggcaccgggcctcaacctccccggagggctggactctcgctgccaggctgtggggatcaggcgttgtgggggagggggacacttaacaggtatggagggcggagcagagccccgcagtcactggcctgacttccggaacgaaccgtcgccagcaagcacagcagtaggaccagggggatgcaagagcgggggcggccggggatcgtgcttctcgctcaggtccagattcccggcaaccaggccggcggaatcacgtgccatgctccaggccagcgtagtcccgcccatcttccagctgagcgtaccgggaggctcccattggactggagctgctacggaggcgggactttccctttttcttgaaccccattgggttaagtccagtccgagacaagcgtctctcctcagcagtgggaggggtgatttggctcatccatacttaggaatttggggtttgaggccgggtgcggtggctcacgcctgtaatcccagcactttggggggccgaggcgggcggatcacaaggtcaggagatcgagaccatcctggctaacactatgaaaccccgtctctactaaaaaaatacaaaaaaattagccgggtgtggtggcgggcacctgtagtcccagctactcgggaggctgaggcaggagaatggcgtgaacgctggaggcagagcttgcagtgagcagagatcgcgccactgcactccagcctgggcgacagagcaagactccgtccccccaaaaaaataatttggggtttgagacccggcgcggtggctcacgcctgtaatcccagcataatcccagcactttgtggggggccgaagcgggcggatcacctgaggtcaggagttggagaccagcctggccaacatagcgaaaccctggcgcgcacttgtaaacccagcttctcgggagactgaggaaggagaatcgcttgaatccgggaggcggaggttgcagtgagccgatatagctagcgccactgcactccagcctgggcgacagagtgagactccgtctcaaaaaaagagagagaatttgaggtttaagttgtctctccttggtcgctgtgcagtcgagtgtttttatgttcagacctcttcctgcccattttatttatttaatttattatttatttatttatttatattttttgatatggagtttcactcttgttgcacaggctggagtgcaatggcgcgatctcggctcactacaacctccgcctcccaggttcaagcaattctcctgactcagcctccctagtagctgggattacaggtgcctgccaccataccccactaattttttgtatttttagtagagatggggtgtgtgtatacatatatatatatatatatatatatatatatatagcaagtagtcaagagctagtctattttgatagatagcatttctcatcagagtctcttgccgggcaagaacagtcaaggtttgacgggttttattagtaataatttctaaacagcttgcaaccatatgattcggttgagcatgtagatgggggttcgatatcctcatgagccatcttgtgtctaagtggcaggcctatagtattatataatttttttaggaggtcatttatcatctttccaattacctatggctatgcttcgtttttcgcaggaagcatagactgggaagcccagaagtttacctgtttttatgggcagtaagaagaaagatggcttaatggtgccaattacacagctacctgtccactgatcagggagcttagcataagctctgcgtataacccggtgggggctgtccagtcccggtggagttctgggtgggcccaaacagtctgcaactttggaaatttactgaatggatttctttctgtgtaattggaactccaccatgtaactttttgtggtaccattatacagtttttgcccaagacaactaagccgccaaacaggatcttttttatcttctttttaagtagcccaaatgacacaagaccagtattgacacatctcacataaatacaattcttgacagatacacttattttttttttactgtgtcactttttttttccaatttagagaaccgcatcctattccatgctgcttactatcaatagcggcacaagcaccaaattttaaggttacatttttgggggcccctcttttttccgttctagctattaccttacttgtgtcacctagaaaaggaccagtccttaattttattttaaaaactgtgatcacgggaggcttaaaatgggtcataacacacatcaggttggttattccctgggctacataccttggatagcattatacaaacaagtttcttttagagtcctggtacacttataataaccataaaataataggactgtagcaatttttgtcctacctcagtgacttgatgtatatactggaaacagttctcaatctgaggaaggtcagttgaagtccttactgtacaagtccaaattttaaggaaaatgagtcccgcaatgagtttcctcatgcttcgcctgtgcgtggaccagtcagcttctgggtgtgactggagcagggcttgtctccttcttcagagtcactttgcaggggttggcaaagccgctcccatccacgtacagctcccagtctactgatgtttaagggtggtctcggaggttaggcctactagaataaactgagtccagcacctctaaacagttatgtttaactgggctctctgttaccaggagtaaggtggctgggttagggtgttggaaacttcaatggttttgtggggattttcacagagcaaggtttggtatctagttagtctagcatttattagctaatgatgtcctttggtatttattaaagtcaccacagcatggggagactttctgtttaggttttgcctaagagttagctcatctgcttcttgtgctaacagggcagttgctgccagggcccttggacatgggggccagcctttggaaaccccgtctagttgttttgagagataggcccctggccttgaccagggccctacagtctgggttaaaactccaactgtcattttttctctttctgacacacagagtgtaaagagttttgtcaggtcaggtagcctcagggctggggccgacatgagtttttctttttaactaatgaaaagctctttgctgttggttgtaatagatgtagtttatctaatctacatttttgttgactgtcatctactaaaatattgacttaaatcctgtaactatttgatttcaagctttaaattgatctggtattccttgtggggctccaattgcatttaagtagatgtgagaattgaaagacctataaggggcttctctcgttttatgatgtcttactttttttttcctctggttgatgaaatgccagggtgaaaggga

SEQ ID NO: 10858 - DNA, 13948 bp, Homo sapiens
ggagctgtatggaagcaaaggttttgtgtgctattgaaattaaattgctattaatctgactaaattgttataaattattaattgcaagatccagggcaatatttaaaaaatacctcaaaaagtatagtaaaagaaacaacaaggagaattaagtaaaacactaacaaaatttatttaacatacaaaggcagtaataatggaatagagcaataaaaaacacgatataaagaaaataagtagcaaaatgacaggtcaaaatcctatactatcagtaattacattaaatgtaaatatattaaacaccccctttaaatggcagagacatgaaaaaaaaaaagaaatcctgtcattcatggcaacatggatgaacctggaagacaccatgttaactgaaataagcaggcacagaaagataaagactgtgtgttctcactcacatatggaagctaaaaaatgttgagctcattagaaatagagagtggaattttgattattagagcacaggaaggatcgaagggaggagagagggaaggataggaagagattggttcatggatacaaaattacagctagataccaggggaggaggctggcaagatggtggaataggaatagctctggtctgcacctcccagcaagattgacccagaaggtggatgatttctgcatttccaactgaggtacccagttcatcttattgggactggttggacagcgggtgcagcccatggagggtgtgccaaagcagggtggggcatcgcctcacccggggagcacaagaggtcaaggaactccctctcctagccaagggaagccgaagccttgagggactgtgtggggaggaacggtgcactctggcacagatactgcgctttcctcacgtcttcgaaacctatagaccaggagattccctctggtgcctatgccaccagggccctgggtttcaagcacaaaactaggaggctgtttaggcagacaccaagctagctgcaggaggtttattttttctgattaagtcaagcagcagttctcaccgtggctaattaggcctcccactgggacatttggcaatgtctggagctggttttgattgtcacaattagagaggatgcactactatcacctagtgggtagagccccgagatggtgctaaacaccctacaatgcacaggacagcacccccaacaaaggatgatccagtcaaaatcgtcagtagtactgaggtggagggcactgatctttagatcttgtgactaggctttttctttctgagtaacatggaaactgctgaaagattttgagataagaagtggtatgatctgagttgttataaatgggttactctggcttccatgttgagaatatactaaaggttaagggaagaaccagaggattatttcaatcatccaagcaagagatgttgacaaggacagaccagagtggtggtcctaacagtgataacgacttgtcagtttcacaacatatttttgcaggtagagccaatagaatttgtgggtagattatatgtgagtgagatgaagaagagtcagtatcacaagatttttgtctgagaaactagaagaatggattttcattacgggagatgagaaaggctacagaagaagcacattgtgggggagagggtgggtagtaaggagctcagtttatggcatgttaaatctgagatgtgtattagataccaaaagctgctggtgggtagacaattggacataggaatctggaggttaggagaaaaatccagcctggaaatataaatttaggagtcatcagcatatagatggtgtacaatgtcataagactggatgacggaagtgcatgtaaaaaaggaaagaggactgaaccctaggcacagcagggagaggaggagaaaccaataaaggagattcagaaggagcagctgggagactttggtgatttgaagctgtcagtcagctcagactgccataacaaaataccataaactgggtggcttcaacaacagaagttgatttctcacagttctggaggctgggaagttcaagatcaagatgctggctgattttgttcctggtgatggctctcctcctggcttgcagacaactccctacttgctgcctcctcacgtggcctttcctcttttataaggaaactaatcctatttggccctcacctttgtgacctcatttaactataattacctcctaaaatgcccatttcaaataccatcacattgaggattagattttcaacatatgaattttggggggggacacaattcagtccatagcagaagtgaaaggcatgttccaaaaaggaaagctaagtccactctattgaaaagcttctaacaggtcaagtaacatgaggactgaaaactactatatcaatgtggaggtcagtttgtgaccttcgatgaaaggtttccagtgcagaaaccttgttggagccaacccgaaagagaattcaaggacttggatggtagctagggggaagtgaagtcaagagaagattattttctgatgagtgaaatcaaagtatgtttatgtattgatggggatggtccactggaaggacaaattatattacaggaaagaggggaaagattagagtaatgtccctgaataagtggaaagggatggaatatagtgggcaagtgggggtactggcatcagacagatgcaaaatagtatattcctagcagtatcagaagaaaaggtggagtcccatatgtgagcacagatgcaagtaggtgaacagatgggttagtaagaacttctctttttattgctttacattttttcagtaaaaaatgaagtaaaatttttatctgagaaagatgatattatttgagagagaggagtactggggatttgaggggagaccagaaagtatgcatgagttacgtaggagaggggaaagtgagtggactaggaaaatatgattatcaatgacattagccccttcctcttaaagtagtggtcatgaatgtaaagtgaaacctctcagtgtggctattggctttccttcggccacagtcagctgaacaaatatagggagagagtaggactatagttggatttaaataggaaagcaatttagctgaaagagtgtaacaagtgaaaagggcaggaacattgatgtatgcaaaggagtaatagtgattgacgagacagtctaagcttgatagagaactgaagatacaaggggcgtgaggggccacgatgaatttgcggacctctcactgaggaagaaactgagaggaaagtatagaaagataatctatgaggatactgaattcaccaagaatcatcacagtactggagagagtgagaggggatcagggacaaaaatcttcaaggacgaaggaggagcaaagggaaagagaatgatgagagccacaagtggggaggtggactttggagcaaagctgatgacataacagtcaaagctacattcaaaactaataatgacttcaacaaatctacaaaattcctgacagaaagggttattttccttgttttacagatgatgacattgagagtcactgaagttaaacaattagcttaaggtcactccatcagagaatgaaattctaaaccagttccaattgaatagtagaaatgttaatgagagggaattacgctgcctttggccttcatacactgccagaggcacactaccctaaagggactttccctccagaatttcctcttccccactcttggggactcctctccggacaccttcatgcaaagtactaatgataggagtgggacatctattccccagagctccatcctctcttctaaataacagggaacgttgagtcccctgttttttctctagtgagagcactcatcagcatgcttcctccttctctctaactgtgtcctttagatccaggagggatatttgctaccaccaccagctaatgctgatttgctaccagcacaaggcccaggtccttgtctggtctgtaccccattacaaggttctccaggaacagacatcaccacctctgcctagatcctgaaatttcacaaatgtaggttctttcttacccgttctttttattcctctatttacaagcacaatgacacccacccctcatcttcttcctgaaatacctggctctgatctcaggcatccattccagaaatcaacacagctatgcaattgcatcttttattaaatactcccaactccatttcaaatccagagaatccagagcaggagcaagagaccaacctatcatctggaaactcaaggtgtaaacattagtgccaaagattagtcatgaaggtaagttgggtattacagtgccctacaacaaaatggtcttgtgccgagagccacattctgaaataccaagtgaagtttgatgacacattatattatatatttcacaacagatttgtcttctagatgtgtgagggagatgatgggtttatgtgtacaggtgcacacatgcctatgttttggggaatttgtgcatacatgtaacaagaatgttatctgtgcagttttattattgtgtgcctgttttcatggtgtggcatatttgaagaggaatggtttagagcttgccaggctgaacagttatgtgtccgtgtaatcaccgcattaaagaatttgaccttttgtaactcaacatctctagccaccattggtctgtaagcctgaatgtcacctctcctactttattcatctctgatatgaccccaaattataaaatgatctataaatataggtaagactttgcatgtcctttcatactccacagtctctagcacagtggatcctggttgatcaaacaggaaggacctcgaagttagtcaaatataagtggaaaacctattaagcatttacaaataatgtggccttgggcaagtaatttaacttcagttactctcctaacatactctataaaataaggctattgcctaatattcaagtgagttaagattagagttaataaatgaaaagagctgtaaatgttcatagcagttgtatcactgcctagcataagaaccccttaaaaacctgtttcttaatttgggaaacagatatgacgatagttagcatttattaaaggatgacagttaacaactgctatgtgccaggccttgttctaacagcttttcatatttagcccacttaacatatttctattttcatatgaggaaactgaggcagagagaggctaagtaacatacccaaggttttccagctagaaaatggcagagccaggactcaaacccaggcagtctggctgctgagccctggttcttaattatgacattaatgcttattctgcccagtgaggataaaatgagtgaaacataaaatcaaacaggatgttttggtagggagcagtgttttttccctctgaaaaatgaaaaattaggttattgtgattttgtaatttacagcagtgaatatgatgtgaaaaataagttatccatataataatttatgtcaggagtcatgcagcagaaagatttctgtccatcacgtaaactttcatccattacataacccatatgtttctgtaccattaagacacttggttcaacaagacccttggagaatgaggttccttttgttccctggggttctctttttattttatttttggattaatatttgatagtaaagccaaggatttgggacaggaaacttagatgacatctagttcaaactccttgatttacatatgaaaaaattgagacagagggaaatgaagatttccccatatcatataactggctaaagggagctatgtaggtaaaaccaagatgtcctgatattctagtctaccagaaagtgttctttttttctacccaacttattcctgatttaaaggctagtatacgtgtgctgatctcccctcagtgggaggggcatggacgttgggagtagtctctattcacaacaaattaaaaatcagtaatcagccgtataatgggttgtgttagaaagtaaactaaggcccaataaaatatttaagagtttatttgagcagtgatccatgaattgggcagctccaagccagaagtggctagggagctccccagagagaacatgaggaggaggctttttaggacaaatagataaaagcaaagataatatttcattggttacagttatacagttacacagttatacagttgccttatttggtctatcccatgaggaagtcctagttactaattacgtttttgttggctgcttctgattggttgagcttaagttctgtgtttctttaacataggcatttacaagaaataccacaaataaagtttcagacatgcttgcaaatcaagcaaggttaaggtcacttaggaggcccaactggctctgtctgctcaaggattcttctggcctcgtctccattttacatgaactgttgcataaataaacacagagtacctgaaacaacggaggtgatcattctgcctaccgagtgttggccasgccaagcttggagtgttgctcttattcttagggagtttatttttaagtaatctcatctgtaaatgggattacaatccacaaactgaccttgtatatgattccattccttctcccagcccagccccacactccaaggttttccctttgcttataaggggtagtcacccttttttatttcgaccttccaaacattctgggagttttcctcctttaggccaactacagcgcagaggagcgctttctcctgctgggtttctccgactggccttccctgcagccggtcctcttcgcccttgtcctcctgtgctacctcctgaccttgacgggcaactcggcgytggtgctgctggcggtgcgcgacccgcgcctgcacacgcccatgtactacttcctctgccacctggccttggtagacgcgggcttcactmctagcgtggtgccgccgctgctggccaacctgcgcggaccagcgctctggctgccgcgcagccactgcacggcscagctgtgcgcatcgctggctctgggttcsgccgaatgcgtcctcctggcggtgatggctctggaccgcgcggccgcagtgtgccgcccgctgcgctatgcggggctcgtctccccgcgcctatgtcgcacgctggccagcgcctcctggctaagyggcctcaccaactcggttgcgcaaaccgcgctcctggctgagcggccgctgtgcgcgccccgcctgctggrccacttcatctgtgagctgccggcgttgctcaagctggccygcggaggcgacggagacactaccgagaaccagatgttcgccgcccgcgtggtcatcctgctgctgccgtttgccgtcatcctggcctcctacggtgccgtggcccragctgtctgttgyatgcggttcagcggaggccggaggagggcggtgggcacgtgtgggtcccacctgacagccgtctgcctgttctacggctcggccatctacacctacctgcagcccgcgcagcgctacaaccaggcacggrgcaagttcgtatcgctcttctacaccgtggtcwcacctgctctcaacccgctcatctacaccctcaggaataagaaagtgaagggggcagcgaggaggctgctgcggagtctggggagaggccaggctgggcagtgagtagttggggaggggagaaagtattaagccagaacccaaggatggaaataccccttagtgagtcagtttagacttcaggctgttcatttttgtatgataatctgcaagatttgtcctaaggagtccaatgggggatatgttttcctcccgtgaggaaatgtttagttcttgagggaaaatccctaaatcctctatatactcaggtttagggaaggaaaacctacccctcacaactccacgcgcagggaaaatgatggacgtgatgctcgcctttagcttcctccctatctgatggaagaccatggaagacctcttggtctctgcaatcagaagtctcaagttgacaagaaaatcatagtccctaccctgcaggagagggtacatccagaaaaagcgaccatggactctattctcagaaatcagtccaacttagtgcagacctggccagatgaccagtgccctccccggggcatttcacccataaatgtgatgaggaaagcccataaatggtggtgaattttgctgagtggggttaagactggaaacccccctgcaggagttggttcttgagcaagttttaaagaaacaaggaactaggatgagtgtggaagaaggcgggcacgtctcagcccgtgaaaaaaactcacaggtgatcagtagtgagtcatgagagagagagcaagagagagagtcagagagaggagtaaatggagggaggaagatggaggaagggactcaagttctcaagacaggaacagggatctcctcatgaaaaaaagaagagaggaaaatgctcaatcagcagaacctgagcagaatattgaggtcaacccagaagccagctcctcacccaccctcacccagactggcgccctcatcctggagaagacctgctagaccctaaggcaggtaggagagagggtggtccacagtcccccagctttagaaagtttgttcgctcccaatgtccatctacccctaggaatccccactagttaaacagaattgctagatccctgtggaaaatacctttccttgcccaccatcatccccagaaataataactattttagttgggtgtgagacatagagaataaaagggggcatggtgccagacttcatttcatacaaatagctttaaaggagaagaggggggaaggagtttaatttagtttctaaaatgtttagtaatttgattgtgatcatgtcagagcaactaattcattttataaaatatcatttcactatgctctataagtagaaattcaatttggttcaaccattattgagtgatataaataaagcactggacttaacaaagacagaaatacagaaatcagtagaacatggatcccaacctaaaacttactctcttgtcataaaggaaaggagataggagtttttgcataaataacaaggtatcaagacagaattaaattccaagctggctttgaatgctctattttgccttaaaaatttatttactagtctcagtaatacattagtaaaaatcatgtcacttaattaattgtgttagaatcaaagaaacatagagttgggcaatatacttcatcctacccatcccacccaaatcttactctactcatctcattctcattaattttgggaaatcatcagaagatgtgttcgttgagtaagagattaaaagaaataagctttttgacccctgccaacaccccatgcccagggtggtcaccctccaatacaataagatgccaggaagagtaagttgccctttctgatgccgtaatctgccatcatcttcccatcttccagtctctttccattgcaagtcacaatctgggtctcagggattatacccgtcttagtctcgatcattgctttcacttgtgccactgagctggaccttcgcacctggaggaggtgcctctttgcctcatcacctgactccacaagaaacaagggcagctcctcatcactgggcttcaccactttcagggtaaggtggatggtcttctctttgtcaatgccataagatgagaggcttctccgtggctttaagatcttggagcccagcaaaagaacctggtcctgcacaggaaccttggtcttagaccggacatgttctttgatttttttcacgctgtcatatgggttggcatcaaaggtcattaaatcccattcctcggaacggacatgcacctgggaagtgaaagccacaagacagttacctaggatgcctgcctcctttacacttctactccccaccacaatggctccccctcttccactatctatctggtcctctagctcctattcagtagccagtgtccctctctttcttggaacttcttttttggaattaccaagttacaacacaaataagataatttgtcccattcctttataatcacacctttttttcgatcttgagaatggaaaataaaatcctgagcccccaaccaactgaacggacgctcttttgctcagggggaccctagagaaactttaaaaacttagtcattgggccaagggtggtggcttacacctgtaatcccagaactttgggaagctgaggcaggctgatcaattgatgctgggagttcgagaccagcctggtgaacttggtgaaactctgtctctactaaaaatacaaaaattagccagtagtggtggcaagtccctgtaatcccagctactcaggaggctgaggcaggagaatcatttgaatccaggaggcagaggttgcagtgagtggagatggcactactgcactccagccagggcaacagagtgagactctgtctcaaaaatataaataaataaaacattcagtcatgatggaacaggaggttggatatgcctcattgtatcttctcccttttgcagtttagacacaactgaccagcaaagttagagattataagactgagagaatggattctttgtggcaataagatagcaaattataaacaagaccgagggctataacaggcaaaagttaagtcatgcatcccttacacttaaagaataaactatgttctgccacaaagttttttcttttttctctagcagctaaacaagcactggccttgacaggaacaatattaaaacaattacagctcaccctgtgttggggaacacaggctaactgaccccgtgttccacaagccataactacagttttaattggacaaaagactgatttcagtaattttctcctgataagagaccactgaccatggactggttctggctagtttacagaagctgtgcatttgaatgcctttgtgtccctgcttcaccttttcatgtataaggcctaactgtaatgcaattaaatgttaagtctccacttcagagtgaccatgggtggtatgtaacatgcaagcttattcaatatgcatgcattaggaccccctccatgaatattcattgcctctgctataacctattggatatgtatacttagcaaaccccttcagcataaattcctgtgtcacctttcctcctgcaaagtgcttgcttttggttttcaatcagaagcaaaacttcccagcctgtcagaatggctaccttgcagactataacctttcataagaaataaactccccttctaaatttatgaattgtgtgattttttttagttgacaatctttacatttcgtttttctgtgcatttcaatggatgtaaaaaacatacctttatccatctcaaaatgtaattagtgattttccaccttatttacctgcctctcctatccagataaagtttgtcaaatgtcaacaagtaaatacgaggcttcaaaagatgtacatcagactctaaaaacaactctcaaagagaatttccaaaatatgacagcctcatgaagatactcatagccataggataccctctgtcaatacttcagaaggaaatcctgggtaggacacataatcactgaactgttagtttcttttcaaatatcccactgctttataataataactcacatactaccgtgacactatgttcagtgtttcttgttaatttatatttcttgtgtttttatttctatctaatgagagacaggactagctggatttcctaggccgactaagaatccctaagcctagctggggaggtgactgcatccacctttaaacacggggcttgcaacttagctcacacctgaccaatcaggtagtaaagagagctcactaaaatgctaattaggcaaaaacaggaggtaaagatatagccaatcatctattgcctgagatcacagcgggagggacaatgatcgggatataaacacaggcattcgagccagcaacgctaccctctttgggtcccctccctttgtatgggagctctgtcttcactctactaaatcttgcaactgcactcttctggtctatgtttcttacggctcgaggtgagctttcgcttgccatccaccactgccgtttgccaccgtcgcagacccgcggctgacttccatccctcggatctggcagggtgtccgctgtgcttctgaaccagtgaggcgcccattgccgctcctgattgggctaaaggcgtaccattgttctgcacggctaagtgcccaggttcttcctaatcgagctgaacactagtcactgggtccacggttctcttccgtgacccatggcttctaatagagctgtaacaaccaccacatgacccaagattccattccttggaatccatgaggccaagaaccccaggtcagagaacacgaggcttgccaccatcttggaagcggcctgcggccattttggaagcagcccaccaccatcttgagagctctgggagcaaagaccccctggtaacactaatatagaatgtgatctcctttgataagactagggcctcactcacagaaggtagggactatatctaagtcttacttcaatagctggaaaatcctaaaagatgggaaaactcacccctaatggccacttgaaagcctgagaagacctccctcatactccattcagaaatattttcccaatctagatattgcagacatttcttcactggaagatctgtgttaagcattgccttaattccaggttctctccatagtgcatattttcttatataatgtaatgtgttagatcattaacaacttcagatgaatgagttttgtgaagctctcctttgagaggagagggaagattaagtttaagaaccttaaaaaatgttaccataatttcaaatctcaccagccctgtggaacacaaagctcacccccactttttcttctaccatttatccctaagagtagctagtccaatgttttatttaaaaaagaacacagaagccagataaccagcttctcttcagacaatccctcttcccattctgcaaatgtcaatgccagcctcttctcctgaaggatgcctgcccagccccccagagccctgagtactgcccagcccccgtttctaagatctctccccaactcttgaaagtgcttttcctttccccatcccctttatcaaatcccaacttacacagaggcaggaagcattgggagccatctctgcagacaaggggccagaaaccagagacagaaaaaggactttgcatgcagcttatataccagagttgagttggaaatcccctgcctggattgctgtgtttgtccagctttgctgtgctctttgttcttgcatgctcccatgaattttctttcacttttgctgggcaggagttaatagacaaagaatgctttctgatcacatacttctctcctcaagcaatctatttgcaaacctcattccaaacatgggatggtctttctgtgttgaaaacttttcccttttctcaggaaagatctttgtctgttgaagccacctggatctatacccacagcccaaacctaagctgcagatctctatgtctagctgtgtctgtgtctatgggaattctcgttccttgaattcccggcatatccttgaacaccccaatctctctgccatctccacgccactgagcatgccttttcctccaactctatccccaccaccatgaatttataagaacacacggtgtaaacagtatcttcgtcaaaaagccttccctaactcttttcctccccatcctgggttatgtgtccatcttctatcctctacacttccttcaaatgcctctcagagcatgtttcttcaacaatagcatcgtctgcttgtctgtaatctttagaaaagagtaggaatcttgggggtcgtgattgtgtcttaattaacttgtatctttagcactgttccagcatgctgtcaggcacaggaaataatttataaatgtttactaaatgcaca

SEQ ID NO: 10859 - DNA, 13808 bp, Homo sapiens
ctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggagggagacagaactcagctcctctgagaggagaagtttacacagcacctggggccctccatttgggagtcacagtggaaaggagtcttggctgagctttggggcaggtgcaccttattttctttgcggtctgggatgccctcagagctgtgctcctctgctttgtccccatctgcctctggccctgggtaggaggcacttggagcatactttgtcttccttcagcagaggtgtgggcagggaatctacttgtctcttgttttcctttaagccgttgtgaaaatcaagtatgtgactcttccttggaaaaaataatctctcagaaaaggacttctaatacatcctcagggtagaatgtgtttccgtgattactttttttttttgagatggagtttcgctcttgttgcccaggctggagtgcaatggcgtgatcttagctcactgcaacctctgcctcccgggttcaagtgcttctcctgcctcagcctcccgattacaggcatgcaccaccatgcccggctaattttgtatttttagtagagacagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatgcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcggattcaggatttacatttttggcaggaacagcacagaaatgatgctgtgacccacatgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcagccctggagtcagtcttttgttgtggttttgctttttagagacagggtcttgctctgtcgctcaggctggagagcggtggtgcagtcagctcactccactcctgggctcaagccatcctcctgcctcagcctcctgagtagctaggactataggcatgcaccaccacgcccagctttgaatccgtcttttatccaaggagctctggccttttagcggagaatagcggatgacatgaatgatgggcctgaagcaggaagtgaaatgcaatcctgaccaccagacagatgggatcttcagctgcactcaggcaagaactaggctcggggtagaggtgacagctctgtgatggggagctcaggctgcaccaggaggccatgctaggtttgacttcatttaaaaagcacactacacagctgacgggctcaggagctccatgaagggcaccctgcagaggtctggagggtagtgagaaggtaccaatggggcgagcatgcctgtgtcgggaggctgatccgggtaggaataagcccagcatgccccacatgagcccaccatgaggaagcatttggagagaaagcttgctctgtgttgtcagaagggagattgaagaaggtgggcccaggggtgctgttgacagtataggctcatgtgctgttccaaggctcatctctggctcttgcctggtctggccataccatgtccacatccgctgtacttaggacttcctctgggcaccagggcagtggcctcaccaagacctggaggcctagatgatgaaatcatactggtgtttgctgtgcttgtacattcccatcagcagacatccgtgtttgggcctgactggccaacagggaagtccagggaggacacagtataagctgcttgggtagaggtcagctggaacctcttgtgaactctgcaccagagtgaagccttcacccatggcagtattcctgtgggtgggagggaagctactgcagactgaaagcaaatgattccaaggaaacacagtactttagagaattctctttagatccgtgagtgctgcccatggagctgggccattcctcctgagatacaggacaggacgcctcaactctgcttctttgggctctcccagacctacccaggccactggagtgagtctagagaaatgaccagggtggtgaagagacaccctgcaaactggcacatacgagaggaacccaggagggcagcagaccccagggggatgagggtgctgcctgcaaatctctgaagagttgtcacagaacagagtgaagagatgtcctttgggggccccaggaggtagagattctgggaatgaggttgggtttgtttcctcatttgtctgcctgtctgtccgccatccatccaacacttagtgagctttgctctgtgctgggcatagagaatcaacagtgaacaagatgggcaaagtccctgccctcaaccaacagactgaaaagagaggattcagtgccatctgcaggtggcatgtggctgagtgggcacaggagcatggagaaggcgcagttaactgttatttgtagagacaggggaaggtgttccatagaagtagtgactaaggagcttctgaaggaggggtagaatttagcgagggagagagactttggctcaattaagtaaaaagttagatgggctcagttttcttgggcaagtctggcctgttgtgcaaagcacccgcactccctgactcttccccaaacacaagagctaaggtgggtgttctgttcctcccacttctgcctccaaatgacctggagggaatttgtgtcccagctgttcccttccctgccacctttgctccaggtaatagccctcctcacacctctccacatctgatagggaactttcccctgccggatctcaggagcatcagcactcccagcctccaaaatggggacaatgagctcaccaagtcaatgtttaatacattattgacagaacttacgatgattttaggtggctcagggatgtagtaaagtacttgtgttctgctggttaggctaagctgaagtgacaaatggccctcaaatgtctggtttcaacaaaagttcatttgcttttgttgaatgtctggcacatgtctgtcagccagcaggcacctgggaccctgctccgggttagcttcaccccgggactcgggctgccatgtctgacacgtggtggtccactggcagagggacacacgatcggggcaagttctgctggcccttaaagcttctacccagaagtgaccattaaccacttctgcctacattcactgggcaaatcaggtcccatggcaacgtgagagggcatgtactctccctgaggggcagcaaacagtaactaccaaaaccaatgaatattttcattttaatagtttaatgtatgtttatagtaatataaaaagtcttttcagtgtgtgaaaaaaagacatgttgtaggatgggatcctggaatggaaaaaggacattaggtaacaaactaaagaaatctgaggccaggcacagtggctcatgtttgtaatcccagcactttgggggattgaagcaggcggatcacttgagcccaggagtttgagaccaggctaggcaacatggcaaaaccccgtctctacaaaaaaatacataaattagccaggcgtggtggtgcatgcctgtagtcccagctgctcaggaggctgaggtgggaggatcacctgagtgagcctgaggaggtcaaggctgcggtgaaccatgatcacaccactgcactctagcctgggcaacagagtgagatcccgtttcaaaaagaaaaaaatctgaataaactatggactttagttaataatgtgccagtactagtttatgaatttttacaaatgtacactgatagcataagatgttaataacacagaaactcgggggtggcaagggtgatatgggaactctagtaatcatctgtctgctcaatttttctgcatatttaaaacttctaaaaattaagtagatttaaagaaaaaagtactaacttctcaggtgacatatggatatagcaaaaattctaagatgctgagtaagtgaagttggggaagtgtgctccggggtctgaggtccctaagctgacagtccagtgatccatggggacggcctgtttctgttgtcttcacagagcaggcaggagtggaattatagcccgattgagcccttcagccctatatctggaactgtcacaggaacaagctgacccaacaagatggccccaggattctcctgtctccttcagaggaaacagtgctgggcctggccagctgggagccccagtatatgcccagactaaggaaaggcttccaaaagtgccttttttaaaatatagaactttattttggttactgaggtttttgttactgttggttcacagaaaagtcatttcttagaaaatagtaacggcagcattttttacagcgactcacattggggccaccaaacaagtgcaaaggacagtgccagggatagaagaggccagtactcttgtgcccagtgttctcagggagaacccagtgctcctggctccctctaccccctcccatcccacccaacagagcagcacctagggccaatagaaccagccacgcagccaagtgcacgacagtgaccccagcaggctggtgaaggccccacaggaaaggccgagtgggaggggattgttcaggttgagctggccctgcatccagccctcttcctcaggcagtggggtctgacctcacctggctttgggacttggacatattcacagtacggttcagtaaagtcctctgggagctggccttcctctcctcactcaggccactaatcctaccccaaccccaggctggatctggggacacacagtcagaagtggccctacctacggggagcacacaggtgagtggggggtcaggcaatggacccagatagctccaggacaaggcagaaagtgctcagtaccctgagagggagcagagaaaggccactgaggcccagagggggaaagagggcagggagagctatgtggaggtggcagtgtctcggctaaaccttgaggaacgaggacacggagatgggggagaagggcatgccgggaggaggaaagagcatgagccaaggcacagagtggggaggcttgggagggtcagtaaagaccagcgctcatccatgagaacacagatgcgaacgagaggcccaggtaccctcatctgaacaggctgatgctcaggaggggcggctggtgtgggcaygctcacatggggtttgaatccttctgcatttgggagctctctggggatggagtagagccttgtgyatccctgcccacccagcctagcatctgcctgcacgctgcagccccacctgtttcagcatgtccctcttgtcatccctggggcagcctttccatggggtctcctgttgctcccaggtccttccttcctcccaggtccatgtccaagtcctcaagtcaaccaaactcaactcctccagcctccagagacagctgggagggtgtggtggggtccctggagggattgagagggagacagctctagcaaaggggamaattctggagcagttgtctctctccacctcactagaatcacttcccgccatcagaagtaaatctgctctttcctgagaagagtctgggtttggtgtgtgtaaaacacagttccttagaactcagagaaaatsctgaccaaaagcttcagcatttgagcttcccccgctcttcacaatctttatagacttcgagtgactggaaacccaccagcttctatcccttctccctgaaaaacattgcccactttcttcttgctatgggctgtggagctgaagtgttctggaggtaccgtgttttggaggcccgggacccatttgttcgagggggagggggaggggcggagtcttttcaggcagtatttccaccttagctcctctgagcacccatccaggcttggccctgaagcaggtctgtgtcctcacaggatggtgcagaagacactgcggttgctgtggtaaccaccttccacccgggctgtgatcctcgttgccatggctgtcaccttctgcccattgtgggctgccgagggacgtctgagagaattttcaaggtggggccgtgctggtgggttcaccaggcgccacgtatcagacctggaggtgcaaaacgaaagtcagtgaacttctgaggggtgtgcagtgctggctgaatgccctgcacagtcttaacttgggttccagatcggtggatccaggtgtttaaatctgggtgtaggttttatcttccagtttagtgttagtccaaagaggtgggctgttgagaaactaaggagcaaaagccctgcattccacgtccagctctgccttcaactctgcatgtagccttggacaaggtccctctgtaggcctcaattttcccgctttgagacactctgttgcccaggctggggtgcagtggcacgatcatggctcactgcagcctcaacctcctgggctcaagtgatcctcccacctcagcctcccaaagtgctgggattataggcttgagccactgcatccagccgacttctccactttaaataaggatctggataagatcatagggtggttgttgtgagacagggtctcattatgttgcccaagccggtcttaaactcctgggctcaagtgatcctcctgcctcagcttcccaagtagctgggattataggtgtgtgccacggtgccagcttttcctctttcatttcttttcagctctatgaccacaaatgtttatagaagctttattcataatcaccaaaaactagaaactacctaaatacgcttcagctgatgagtgaataaactgtgcagtacacccatacaggggaagactactcagcaattgaaaggaatgaacgccttacatgcaacaccatgaatgaatctccagcatgttaggctaagtgaaagaagccagactcaaaagactacatactgcaggatttctgggttttttttgtttttacttttattttttaatatatatatatattttttccgagacggagtcttgctctgttacccaggctggagtgcagtagtgtgatctgggttcactgcaacctcttcctcccaggttcgagtgatcctcctggctcagcctcccgagtagctgggactacagttgcgtgccatgatgcccagctaatttttgtatttttagtagagatggggtttcaccatgttggccaggctggtctcgaaatcccgacctcaggtgatccacccacctcggcctcccaaagtgctgggattacaggcgtgagccaccgcacccggccacgatttcttttatatgacatttgggaaaatgcaaatctatgggggatagaagttggtgggtttccagtcacccaaactcttgtagagagcatggagggccagggaaaataaaatgatagtgaagctgtggtcagagttttctgatgcttgagttacaaggaaccaactttacacactaagtctccatttgcttaaggcaacacattgtcttatatgtatttttatgataatgatgttacaatgaaaggactggaaaggtgtggacggaatcagaggttggctactagcatgtgaataaaaaggcctaagctatgttgggaggactgtatgtatttgagtttggcagcaggggagcactactgaaaaggagtgatgaaatgagaggctggaaaagacaattaggacctcagggtacacagcggacaataccagagctggcattggcaaagtccgggctgtatcctgtaccctggggtctccaaagggaaggaggaggtggatcccagggagtccacaatataatctgctgggatattggaagaaaatactagaattttggttttttttaactgtatactttaaaattttctattttggggatagtttataatgtaaataatatactgctagaatacacatatataagttataaataggtataccggtgaggcgcggtggctcacacctgtaatctcaatactttgggaggccaaggcgggtggatcacctgaggtcaggagttcgagaccagcctggtcaacatggcgaaactgtctctactaaaaacacaaaaatcagccgggagtggtggtgggcgcctgtaatcccagctgctcaggaggctgaggcaggaggatcgcttgaatctgggaggaagaggttgcagtgagccaagatcgcaccactgcactgcagcctgggcaacagagtgagacttggtctctaaataaataaataaataattaggtatacctacatcggggggtttcttcaaagaatattttttcccgagagtgtgtgtaatacaaaaagtatggagatcattacaacagaacatgaagatccatgagaggttttaaaccatggatgtgatgtgactgaccagagctctcacttagaaagattaacctggcaggatgcatgggacaacctccagagtggagcagggggtggccacgggcagggagactggcaggaggctgctgcagggggacaggtgacattggcggtgcaggagtgataccaactacagcaaatatcagtatgattttacaaccagaatgtgaaagcgaaagcacggaccaatcagaacacagcccaagcagaagcaactggaacagctgtgcattgcagtaacacaggcggtacaggttagggtgagcggtgctgagacctgaattaggatgggggcagttggggaagaggaggtgctggaaaaaggaacattttagaagcagaatcaacaagacctggtgactgactgactggacatcttcggattagggagaaaaaggcagcagaagttttgttgtcagaacactgagtggatggtgatgtcgctgaaatggagaacgtgaaaggacagagaggtttgaggaagatgggtggcggcaattgtgatacattgaggcagagtgactaaaggacagcagcagcatcaactaacatttttacagcccctcagagattcagccagatagtgtgatcttattaaatggattttactaaggctcgaagatgtgaagtaagttgcccaaggtcacacagccagtaacctgcagagctgagatctgaaaccacatacccctgactcttaaaaagcttgttccctcctggggagtcctcagcccgggcctgacatagagccaggcacaggcctttttctgactggagtcgacagctggcagggttgcagggagcccgggcagccacaatccctgggtgtgggcctggcttcttcagggagcttactgtggctctagaggactcgttcaggcaaccccaagcactcactttttcttgaagaccaggaacttgttgttttgcatgatgcattctcggttgtttgagatctgctgaaagatggtcttactggttttgccctggaagatgatgttttcctgcaccagggccttggcacggccccgcacggcgatgccgtaggcccggaacgagtggatccggttctttattacctgggagaggcagccagagattgtcacacctcagggattcacagactgagtgggagagctgggcaagtgaattatcagttctaaaaccaagaggcaggaacatgccaggcaggtcagtgaagagcctatgagctcaaagaagggcaccaagaacagcctgggggagccagggaaggcttcctggaagaggtgataggtgagttgtaggcatttatcagatgcacaacagggagagctgttgcaggaaggagaaacaatatgcaaaggcctggcagagaggggaggcagtgtcagaagtcagggccactggcaacccaactgagacgaaagtgtgtccctctctcccttcctctgctcccacagtgctcagaggcaaagccccagcatttttactctttgcctaaagtcactaacccacgaagctgcagaactgtaaagaggctttaggcgacccagcaatcccactactggatgtctacctaaaggaaaaaaagtcatgtgcacacgcatattgatagcaggacaatttacaattgcaaaaatatgcaaccaacctaactgcccatcagccaaagagtggataaagaaatgtggtataggctgggtgcagtggctcacacctgtaatcccagcactttgggaggctgaggcaggtggatcgatcacctgaggtcaggagtttgagaccagcctgaccaacatggtatctctactaaaaatacaaaattagctgggcatggcggcacatgcctgtaatcccagctacttgggaggctgaggcaggagaatggcttgaatctgggaggcggaggttgcagtgagctgagatcatgtcattgcactccagcctgggcaaaagagtgaaactccatctcaaaaaaaaaaaaaacaaaaaaaaggtggtatatatataccacagaatactactcagccataaaacagaatgaaataacagcctttgcagcaatttggatggacttggaggccattattctaagagaagtaactcagaaacggaaaaccaaatatcctatgtccttacttgctcactacttataagtgggagctatgctaatgacgaagaaaaggcataagaatgatataatggactttggtgactcagggggaagggtgggagcagggtgagggataaaagactatatattgggtacagtgtacactgcttgagtgacaggggcaccaaaatctcagaattcaccactaaagaacttatccatataaccaaaaaccacctgtaccccaaaaactgttgaactaaaaataaaaatagagcccttgggatcgtaattccataagggcaggaacaagatctgtttggctccacagtgaaacggagctctgcatagaaaggtgctcagagctcagtccggtggggagacaaataggtaaaggaagagataccaagccctgtggggagtgctctgtgaggaccaagccctgtggggagtgctctgtgaggtatgtgtggacaaaagcactagacaagagataactcaaacagcctggggtgggaggtgggagctcagggactcttcctgaacaaagatacagctaagctgcaggactgcagtgcaaggggggcaggaggtatgcagggtatatagggaagagtgtatgcaaaggccccaaggcaggatctctctcttcatgaagcatctactgtacagcaggcactgtgcatgattattctgttaaggaaagagagctgaaatagtcctgaccttgacccggagaccatgaagataactcgggaggctcccaacaccatgacaaggaggggacaccccatccctggcttcctgctggtgagcccttgttcatccttcaggactcagcttctccgtccccccctgtgggaagtcccacccacatttcccaggctgagtcctggcaggagggatactgtcccttgtagtgctgagtgattacggttctgttctcagcagaggccacgaggactatcccagggttgtgccctgtgtgggcaccacacgtcacacacatgcagacatactcactttagtgtcggacctgggcagcagctgcagcccgctgccccggttgccaatgatatcgttttcaatgacgatggtgctgtcgcccttggtgataatgccgtggcctctgttgtcatagataccattgccccggagctccactttgcactgggcctcaaccttgaccccactttgccggttgcaggagatgctgttgttggccactcgggtgggttggctgctctgggccacagtaatgcctctgtccccattcgcgtggatcacattggtgatgacatgcagtgcctcgctgctctggacatagagtcctgaggctatgggtggaagggttggaaagcacagggggtcccagggtcagccctgacaccaccagtcaggaaaagccttccctgaattgtgcactccgggagaacggagtggagaagaagaggtaccaacactcagaaacaacccttgagtttgcgtcttccaagctgatgaaacagcaggaggaaatccaggtgcgtcaacaaaactctggttcttctgcatgaagtccttattcagtgtagccagggaaacaccatgtgagaagg

SEQ ID NO: 10860 - DNA, 12919 bp, Homo sapiens
tggcgccactgtactccagcctggagacagagcgagactccatctcaaaaaaaagaaaaaagactattgaaaaattttacccagttaattcaaagcttcttcgtgtgggggaaaacaacaaaacaacaacaacaacaacaacaacaaaactcttagtatgaatgaatattttagcattttgaaagcaggtctttgtgagaaaattccataaacaaagaaaacttttagatgtgtcaaattcaacaatctgcttacgttggtgacatgaaacacactaagtctttcaggaggtccaactttaaaaatattttaaatgaccaatgacatgaaagtatgaatttgcttcacccttttctttttgatatcagtgatatattaaggaaaagataaagtaactcttaacaaagtaacattttatttcccatgattaggtctgttgacaaatataacaggtataaccaaagttttattaagcagttaaatttccaatcttggtaaaagatatccagaaccagtccacatttgtattttaaatgtttttgtttaactcttctgcaggaaaaaaaaaaaaagtgttcctcagtcattcatatgtgatacgagattcagtgcatcttgcaaaatattatgtaaatatttgaaaaaaactgctcttttcaattgcaagaaggcaaactgtaaaacgcatattgtgtggcagcatagatttactgtttcaaattggatgatgcaggcaaaagtactttgtaagtggtaaataaagttctgcatatttgcaagttattcaaactgcttgtgaagcttcctacatgaagttgatggtggtggtgataatgaataacaatagctattatttactgagtgagtgtgccagccaccattctaagcacttaacatatatttgcttatttattactcagaagaattggtggaagtttggttgaagtagatactcttattatttccacttgacagataaacactgacagtacaaagaagttaagtaaattgccttaggtcatacagctcatcaccttatgactattaaagtagttcttcatgacttcacgcaactgtagtcacaaatgaaactgctggcacagaatttatgaattactgtctagttagaatatatgatccaggtaacccaacctatggccacatttctttttggttattaaagtaaaagcacacatgcgaacttatttagatacccaaagatatggcaggcatctttgaactaacgcacagacttgttctctttgtttgaaattgattcaaatgagtcatatgatctgtacaaatgctcttcctgttctagagtaagacatgctaaatgtttaataaatgagtgtgtgcttcccagtgtggcagtgtttgcctttcttacttggtgtgttactcagaaatctttggtttgctggctgggtgcagcagctcacacctgtaatcccagcactttgggaggccgaggcaggtggatcacctgaggtcaggagttcgagaccagcctggccaacatcatgaaaccccatctctactaaaaatacaaataataataataataataataataataataataactgggcgtggtagtgcatgcctgcaattccagctgcctgggaggtggagacaggagaattgcttgagcccgggaggtggaggttgcagtgagccaagattgcgccactgcactccagcttgggtgataaaatgagactgtgtctcaaaaaaaaaaaaaaaatctttggtttgccatgagtaaaaagtcaactgaaaccaactaaaaccaaaaaggagaaacatattagttccaataagtgaggagtttagagagttcagttttcaggtgtggctggatccaggtactcaagtaatgtcatcatgcgcatctaactattgctcctgctctgtgctgctctgcttccttctccattggcatccttcatcaggctttcttcactgcagttaatggtttatatgtggctcttctagaagtgagcatacttctttctttacatctccaaccaatgtctcaggcaagccttgtattggcagagcctggtatcatgtacccatctctgaacaaatcacttccttcagaagaataagacatctgactggctaatcaagaagtaggaggaggagaaagtggggggaagggaagagaacatagagaagatgatggtgataaatggacatgtgacataagagtagcctctcgtagcccagaggtgtcttgctgatttttatctttaatgttatctcaaaaatttagcttccaaaaaacaaaaagaaatagaccattccatctcctctttaggttatgttgtttatttgtgccttatttattttatttaaaagaaaataatacagagtagctttgaacaaggcaaggcttatatggatgatgccatttaggagcgagatagtttctttctctgcttcattgtacttggtgataattataatcggtgcccatggtgactctttattgtgtcattccaataaattcacattcatatttaaaatcataaattaacaagggttactacaaagtgttccttattacacatttataatttctcagacacaaggaaaataatgggagtttccctgtggtcatttgtcacataataatatccttccgccctgctgcatacaaaggtcccattgattggaagagcagctacacttgtgcgcagggccaaaggattggggaaattctcaactggtttaacaagaatgagcaccacacattctgaaaggtctgcagtgaccaagtcaccaaaactgggtctgcaatgagaattgggaaaaattagagaagtgcctttaggcaactagaaactgagagaccgagagttcacataagagcaaatgagtatcttgggccatgccttatatttctcctgaaatttcttcccactctcaacagagagagagagagccaagggagagagctattccatagccacgtgggtgccggtcctcacacccagaccctgaagcccccgtagcattactgagaattatattctcccccttcccttgacttttttgttgaacttttctttttcttttagacccaggacagaacattgagtaagtcatactcctcaactcatagcacgctatcgttacaagtttgtgccaagcccttcactcatgtgttcattaacttttatctccttttccccttccattttcctcccacaacccataaacaatagcagtattgtgttcgatgacatccttgagtttgtatgcattctcataagacaccccaaatttccttgttctgtctgtatatgtaccttatatacacatacgtttatgtataagcatatatatacatacatgtttacatatatacacatatgtatgtttatacataaatggtgcccacagatgtttttgtggttttcctccctcttagtcagtttttaagatttaatctgcactgcttcatactgctgcatagcattgtatgatgagcctccctgacatctcactacccatctccccagcgaaaaacacctcagtcaccccatcctcaccaccacacccaatgctgggatgggttccactcccaggagcaggacagctgggtcatggggctcatggatcagtctccatctgacttccctgcgttgactatgaagcacccaccatgatgacggtatcaggttcatagcatgtgaatggaagaatctggggctcaaagaggttaagtgatctgcctaacttcacatcgctagttaaatgctggcgtctggatttaaagccaagtttctctgactcccaggttcacatccttccaccgtagactgccctctgagacagccacgtataaaggggtcctggagaacctctgactggcctgcacactgggaggagtgtggagtctcgggaagctcatgccatttgcaggagggaggagcctggctccttctcttcctgggtggtacctgggattcagcctgtgaggtgggaagcctgtactagcaggactctcactatgctgagaatctgcttccccttttattcccttttgcccaataaattccgtttttctaacccttcaaagtgtctgcaagcctaatatttcgtggttgtgtgacaagacccctattttagctgaactaaggagaaaggcctacaacacttccatagagagcttatgtttcaatatcctaggctataggtagcaaagatttggttagcaatctttcttgtaagaaggccagaaaaagtattccttcccttcatcaggcatccaatccccccagtgccttcaggcctgctgggagtggagaacagggcctgccacaaggtcattgtataatcagaggtgagggagagccccactggctaggggccaggcaaacgtaggcctcctcgcacccctgatgcaagcagattaacagctgccatctggcaagcacagtttctccatgcaaactgcaaacctcaccccccgggtgaatcactggtgtgtccaataccagtcaagcccgatgaaactctgatggctctattaatgaagatgaaaacttgagatacgccaaatacagattaaatggcatcttggtaacatgattatctctgaattactagcagcagagagacagccaaatgactaatcttggggaaggccgagtgctttggacagaggattcgctacttcagccccagggcatcatttgctgtatcagagtcgtattttaccacagggaacacccaagagtggtggcttcctctgcagtagaaagtcactctgtttccagagaagatttactttcttcaagttctgagatgccaaatgcagaatggtctgaaacaagatgacgagggagtatgtcaggaaaaaatgaggaggaatcacaggaatctggcagatgttcctgtggatagcattgttgaaattaacagaaatgaaaggatagaaatgattgagagggaagcctaaaagccacaagccaagtcattttctcctgctttctttccacttccgtctttagctctctagtatttagtaagctcttcattttttttttgtttttttttgatggagtcttgctctgtcgtccaaactggagtgcagtggcacagtcttggctcactgcaacctctccctcctgggttcaagcaattctcctgcctcagcctcttgagtagctgggactacaaacacctaccaccacacccggctactttttgtatttttcttttttcccgagacggagtcttgctctgtcacccaggctggagtgcagtggtgtgatctcggctcactgcaacctccgcctccagggttcaagcggttctcctgcctcagcctccccagtagctgggattgtgccactgtgcccagctaatttttgtatttttagtagagacggagtttcaccgtattggccaggctggtcttgaactcccaaccacaaatgatcctcctgcctcagcctcccaaagtgctgggattataggcatgaaccgccgtgcccagcctgtttagtaagtttttctatgctagtgctttcaatccattagcacatgtcacctctgtgaggtgggcattgtcatttccatgttccatgtgggaaagctaaggtttacagtgttcatgaccagacacagtggctcactcctataatcccagcactttgggaggctgaggtggggggatcacttgagcctaggagactagcctgggcaacaattgtgagaccctgtctctacaaaaaaattaaaaattagccgggacacctgtgctcccagctacttgggaggctgaggtgggaggatcatttgtgcccaggtgggtagggctgcagggtgctatgatctcaccgctgcactccaggctgagagacagagtgagaccttgtctggaaaaaaaaaaaaaaaaagagtgttaatgacttgtctgacatcgcacatcagctggaaaagggaggttaagaaattttcatcttcttttttttttttttgatatggaaatccagctctgtcatccagccgggagtgtagtggcatgatctcggctcacygcaacctctcccccctgggttcaagcaattctctgcctcagcctcctgagtagctgagattacaggtgcccgccaccatgcccagctaatttttatatttttagtagagatggggttttaccatcttggccaggctggtcttgaactcctgacctcgtgatccatccacctaggcctcccaaagtgctgggattacaggtgtgagccaccgtgcccagcccattttctttaaaacagatgatccggacttgtcaagtgatgatgatactagaggagtgggattgatagtaaatatctgtagataatttgggatgggtacagtggctcatacctgtaatcccagcactttgggaggccaaggcagaaggatgcttgagtccagaagttcaagacaagcctgggcaacatactgacattccgtctctacaaaagataatttttttaattagtcaagtgtggtggcatgcacctgtagtcccagctactcaggaggttgaggtgtgaggagctctcgagcctgggagtataagactgcagkgagctactatcacatagttgcacgccagcctgggtgacagggtgaaaccctatccaaataataataataataatttgacaaataaagtctcttttaatgtagctggaattgtgtaagaaagtctttcctcagcaaataagaaatggactatgaaatctcccagaatcttttttagcccctaattagctataaatctccttacagtttagccatgggaggcccaagacatgaattggtggcatggcacatggtctaatgtgcatattgtataaagttatctaaatacatcttgagagagtccacactttctccattcttttgaagtacatttccatgggtagcagacagatgaacaaaatgctggttctaggacctcagatatactgtacctgtttcaatcagatgcataactgtggtagggctgttattgtttacttttcatactatcactagcaactttaatttttggttaagttctcgaaatctctttctggaaaagcaaatgatatcacattctccattctcctggttaacagtgtcattatcacactgcagattctcaaacaaacagctaagttccactgtcattccgaatcctttctctttcttttgtaatgcattcacaaacatattcagtcttctgccttctcaatggagaaaatgttatagaaactactataagcggtgcataattgtaaatggctttaaaaagccatatggaaggatgaataatcttcctttttgtttccatctttccttaatattcttttgctttgtgttttgcaataccttttgcacccagctttggtcaaaattgttgttggccatttgccagtttgaaatgtcctacaaaatgaattgcttcttttgtaaataagaaaaatcttggtaactttggaaaatattgcttggaaataccacactggagttatagctagctgtgagcactttctgtgggggcaaaggagtgcagtgagtttattgtctgttcagcatgtataaatcatgatccaggtagtattttgtgcttgccttcatatcttctagcagctgtaggttggggcatcgcaaatattctttcaagaaaacaccacgtatttcctttctcaggatggcctttcattttgggttaaattttcaaataacacaagtaccagatggaatttgggacaaatttttaaccactgatttattggctgaggcttaatgaggacaccatgatattcaaatgaataagttcacccacttttattggcttccttttcttaatttttacattaagaagttaatttagtcctcttacaagttaaatgccaacctcttctaaaattattctaacaaggtaacttctgatttggccactttttatcttttctctttctcctatcatcctgtgcttttcagggtgaaatatctgtaaatgacacatcaaggacagataacagagttgccagttcattctcaaaccaaagcagtcatcaaaattaacccaataatgcactgcagggcacttagggtatattatcatatggaaaataatgtctgtaatttttagggacttagaaaagacaatggaagcacaccaaaggggaatttattaaagctcacattttttttttttttttgaaatggagtttcactcttgttgcccaggctggagtgcaatggtactatctcagctcactgcaacctctgcttcccgggttcaagtgattctcctgcctcagcctcccgagtagctgggattacaggcatgcgccaccacacccggctaattttgcatttttagtagagacagggtttctccatgttggtcaggctggtctcaaactcccaacctcaggtgatccgcccgcctcggcctcccaatgtgttgggattacaggcgtgagccacggtgtccagcctaaagttcacattttaaaagagaaatagttctctatttttgcccatcgaaagaaattctatacatatatacactatgaatcactatgtaggattattaaagcaactttcaatagttttcttcccaatatatgattcttcttgaatcatatatcttaatacaatattcaaaattatgagaataaaattttgaaactttattgaaatgatggactacttaaggtaggattagattaagggtcacttaaaactgtatctctgcactttcattcatgatgtagattattttttattttgtcctctgagaattagctgaaataagatgtactagaccaagatacctggacaggaaattgccacgaggtatgaacaaaagacatccaagctctccattctaatgaaaacacaatcagccatatcttcacttagaagaaaagacaaaacatgcaaacaactcagatattttgaaaattgtcattaaaactcagcttatgcataactcatagtgaggggcatctaactaatcaatgaatgagtggtacaaagcatcaaaccttgataattttcagtccctctcccacagacttttaataccatcttaagaaaaaatccatttaaatgtttacctaaattcagaaaaaaaatcttacgtagatataacatcttgaatctccttagacacattgaagagactactaataaaagctactcagaatcactacatgaaataatgcaggtgctctatgacacactgggtcacgtcatagccacatactaaacaaaaatacagttagtagagtccgttggatacaagacatggtacttcttcatttttccacatggtatctcaaacggtgttccctctgaaagccaagttttatcttgggaaagacttcattttaaagaccaaagcccaacattacagaatcttagaattcaacaaaaatacagagaacatagttttagcgcaaattttaattgagaccaacctttgctgatgtcactacaagcaaatacactaccttaaaaaatattaaaatacacaactctcagactttatttctgtgtgtgtgtgtgtgtgtgcatgtgtgtgtgtatattaatgcaagtcttttctacaaagaaacttggccatagaactccttctcctttgggagtgttgtatttttgttttcatatgtggcactgtatgtatttctatagttgtgaacaactacatttgattaaaatctgtcagatttatctttttagcaggagaaaagaaatatgtgtttctccagaaaggaaatcaatgtgtcttcatgatagatgcggagtggaaagctggagactgtcgcttcaagtgatgaagcagaaagacagggtagctatcacaattggctgccgacataattgtcgtgagccaaagccctgtttaaatatcataatccttgtttatagggtagacttagattcattgacttagtagttattactccgacttgttaagtaacaaaatcttgcatctgaggtatccgtagtttgctctgtttaaatttctttagcaacatactttagccagagctgtgctctgttcttttctgtagtacaagaaagattatttccttccttctaggaaggcaccaggctttcaaggccctgtaaatgtaccaaagaatctcccttctcaaggcaaacaggagaaacccaggctatgccagagacagatgtagcaggaaacatactcaaggaaggatgggaggctgcttcatgacaaaaatatgtccaaaggtcttctcccttctgttggaaatcactctcctccctaagatccccaaggtcttcagatagagctatgccagatggaaaagaaagcctctgcccttgcattgtgagattaagagattccccattcagagatggtacaaccagcagacaccctattaagatagcctaggaaaattaggtgagctctgatgtctttgcagcagacgtatgtatgcctctatgattacagccagcaaaaccattctaatgaacttgtaaagcaacgtgaacatctatgaactcgcacatcagttgaaattgctatatcttgtgtcttatgaacgaaatctgtcagcaaagtatttaacgtgtttatctgcaaccaattgcaataatcacattcgatgcataagccccttttttacctaacttcttctaaaatgatatgttgatttctggtcctcaatgaatgtttctggaaggcattctattaaaatgagtgtgtgctcagcatattaacccagacctgattaaatcgttaaatgaaaggacactgtatgcaaagcaccctagtcaagggtttggaacatgataggcacttatcacaggcccatggcttagtcatcactcttctcttcaacttgcatcctaaaaattaaatcaataagcacaaataactaatgcatttgcctaaagctaaataactcttttccactaatgtccactctctacccttaccccactcctgcaatcaacaagttattcagaaatcaggatttaaggattcattgaccaccatcacatccattacaactaattggaagcctttatataatttgctaaagaattgtaataactgagacacattgttgagttctggtaatagactctatctattgtcatagatagacaatagatagagtctattgtcatagatagtggtgtcataactttttgatacactgatggaatttaatttgctaaaatctcttcataattctttattgaaattggtcttcaaattctgtactgtctttccaagttatcttcacaaaacaatttgaatgtcattccttgttgtggtcaaataaagtttatataatactgcaaatgatttttttaaaagactataatgtcatctgtaaaaccatctgggtctggtgccttttttaatgcaaggtatttcactttccagactcttctactactaattgatttatttgtatttcctatctcttcatgctataactgatttccagagtctatatttttacttaaaaaaaatccctttactctaggcttccaaatttattcctgtggagttgtacataatatccaccagtaaattttcttatcttcttcatatctgtggttgtagttcctttataatagtatattcatttcattttctccctctttctctctccctctctctcttcagtcataatagacagaattgtatccagttcatcaatatttttaaagcgcctaattttgattttacttatccgtttttatgtttgtcttctattttgttagttttagcttttatctttattaattccctccttcctcattcatattttattgttactttagaatttaagttcagtattttaaaatttattttcaatctttttttaacaaaaaacacaatttaagggtataatttttgcctcagtacaaagttgtttgaatgtcctatatagtaggaaatacttttattactctaattcataactttaatttggttatcttctttgatccaaggattatttaaaagagtgtttttaattttaagaactttttgtcaactttttatgctcatgtctagttttactgcattatgatcagaaatgtagcctataaaacctctactttttaaatttcatttagtttttttgtgtggtcagttacctattaacttttacaaatgctttatggacacagataaagataaaaattcctgtagagtaccttgatacacacacacacacacacacacacacacacacacacacatttgcatagatctgtgtgtgtgtgtttgtgtgttccatgttattgactatcttattgaaatccactatatctttgtttactgtttggtttttttttttttttgagagggggtcttactctgtcacccaggctggaatgcagtggcatgatctcggctcactgcaacctccacgcctcccgagttcaagcaattctcctgcctcagcctccctagtagctgggactacgggtgcctgcaaccacacccagctaatttttgtatttttagtagagatggagtttcaccatattggccaggctggtctcaaactcctgacccattgatcctcctgccttgggctcccaaagtgctgggattacaggtatgagccaccacacctggcctgttgttttcttaatctaccagatactgaaaatgctttattaaatataccccctacaattgtattctttttttttttttttttgagacagagtctcactctgttgtccaggctggagtgcagttttaccttatgtgtttgtctcctgtgttatttgatattttgtgttcatcatatttccttaataggttatgccttttatcattacatagtatatttctttgaagtgtttcatgaatccaaactttcataccttggggtttgtt

SEQ ID NO: 10861 - DNA, 14484 bp, Homo sapiens
tcacctacaggcagctcaaacaggtgcgcggtcagctacaggcagctcaagcgggtgcgcggtcacctacaggcagctcaaacgggtgcccagtcacctacaggcagctcaaacgggtgcccggtcacctacaggcagctcaaacgggtgcccggtcacctacaggcagctcaaacgggtgcgcggtcacctacaggcagctcaaacgggtgcccagtcacctacaggcagctcaaacaggtgcgcggtcacctacaggcagctcaaacaggtgcccggtcagctacaggcagctcaaacaggtgcgcggtcacctacacgcagttcaaacaggtgcgcagtcacctacacgcggctcaaacaggtactcaggcacttcgggaccccagagggtgccagagtactccagcctcgaaggcgggacaccgcgcttcccgtgtgggggtgctgggtcctcgaccctcaacaccacttaggccgaagctggctgcacccctcaaaccatgaagctgagaagcacccactttacaagtgcagcagccggagaggaggctctcatcagtgcaggctcatccacaccagccgtgttttggggacttaaggaggtcattcgcgctcagaggctgtcccgggcaccatgcggcgtctgccggggtctttctcctgcccagcctcatttgcctgtgcatgcacttggttatccaacaagagctagaacattctgggagaagcccacggtggctccttgccgggctggtcagactccgtggttgtcctgagacacccaccctctgctgccctgagggtggcccaggaaagtttgtgtgaccttccacacggatcccctgggacatgcaggtgtggctcttgacactggaaaggctgagggttctgcccaaacctaggagtgaattcgacttctttcccatctcacacacacacccgagacgtcacccgaatccacgtatttcccacgttcggctgccactgcctcccgggtgggctttgcaggacccaccatcgcatcccctctcactccacagaaaactcgtggggccatgttccccctgccactgaccacgcttcccttgcagatccgcctcacggacacgctgggcaggctctcgcacatcctggagatggaccacttcgccctggtggtgcacgagcagatccagtgtgagtggggccctgctctgtgcgtggggttctcactggggtcaggccaccaagcctggcctctgccatgggcagcagctgggccccccatcccctgcggggtgttaggggagtgggtggtgccgaccttcagtgacacccagtctttatgcccgggcctcccacatgccctgggctggtgggctgtacctgtgattcctgcagggacccctcatcaggccacactgggtagggccctttgtccagcatgcagaggctcaggagtccaggccccttgcctccggggaggccagcagtcttggggattctcagggacaagcccagaaacatctagaagggtttcaagtcctgaccctggcattcggagggctgctctgaatggaagcctcatgtgggtctcacaggagccactgatgggctgtcctcagagccccgctcccagcaagctcatgaggttttgcaactcctgagcgcatccccgggcgtccccaccacatccccacaggccaggagagtcgctcgcaggttttgggtcatagatggcagccctgggcctggggcccacaggaagagttgggaggggccctggagcctggagcctgcccacccaccaggcctgtgtgcagggggtgagcgctcggtggctgaggctggtccgtgagggccccaagtctaaccccatctcccgtccttggctctgcagcgcaggaccaggcctgggcaggcgtggtgggggggcctgcaggtaggtatcacccacccctcagaatggctctcaggctcagattcacagcctccccatggcaaatggaggccttccagggtcctggacccacccccaagcttgggtaggagggatccccctcttaatctcacatttacttgtgtttgaacatctcagaaaaaaaaaaagatgcaaattccaatgtcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgcaaggagctgatctcatctgtgttccctatcttttcctggggctctaagtgggccaccccaagggacctctgcctacaaagagaggagtgacagccgtggcggagttgggacgggctccgagggctcttcctcacccgcaccttgctcacccctctgtgcctcatgacagctggtgtagggtcctgtggagacgcaggaccaagaggatgtgtggggagcggggagagagagggaacgagatctgtgttaaggaactggatcatgagatcacggaggctgacaaaccctgagatctgcagggtgaggcggcaggccggagactggagagccagcagttcaagccccaaggcaggaaattccacctttggttctattcaggccttcaactgcttgggtgaggccctccacagtagcacacgttatctgcctcttgactcttgtgctaatccggaatcccctcacacatgcccagaacgacgtgtgaccaatgcctgggctcccacggccccgttaatctgtattaaaattaaccatcacaacagccctgtctgggtatgtggcatgggagcctcggccagcattaacaccgggtctacgcttgccaggagaaagcaggaggggtgaagacagaatcaggccagagatggaagctgtgtgctgcccatggtggcaaggggtttttgtctgtttttagagacagggtcttgctctgttgccgactggagtgcagtagtgccatcatagctcgctgcagcctcgacctgctgtgctcaactgatccttctgcctcagtctcccaagtagctgggaccacaagcgtgtgccaccatgctcgactaatttatttttaaaaatattctgtagagacagggtctcaatatgttgcccaggctggtcccagacttccgggcttaaatgatcctcccaccttggcctcccacagcgctgggatcacaggtgtgagccactgtgcccggccctgtaagcgggtttgaatttcatgcccacaccggctctgaagtcatgagtgcctcaggagctcagccggtgggccagggaagggtgtgtcctgacctgcggtgggtggagcctggcctggggcccaggggactcacgtggtgggtagaacctggcctgggggctcatggggctcatgtcagaagaacactggcttggccaggcacagtggctcacgcctgtaatcccagcactttgggagccgaggcaagtggatcacttgaggtcaggagttcaaggccagcctggccaacatggcaaaaccccatctctactaaaaatacaaaaattagctgggtgtggtgatgtgcacctgaagtcccagatactcgggagtctgaggcacgagaatcacttgaacccaggaggtggaggttgcagtgagccaagactgcaccactgcactccagcctaggggacagagtgaggccctgtctcagaaaaaaaaaaaggaacacagccttcgccgctgggctccagccaccctgggcccccatggtgcacaggtgccccaggccctcaggagcctcctgccccgcagcagcccacccagcctcccacggcacctgcaaacccactgcctcgttctcccctcagaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaattgtggcctcgtgtctaacttatttcactttgcatggtattttcaggcatgtcagagcacgtgtacttggtttctttttgtggccgaataataagccattgtgtggatagaccacattttggttcctcatttatcggtgatggacacctggttgtttctgcttttcagcccttgtgagtaacctgctgtgcaccttcatggccgagtatgtctggacacctcttttcacttttcttgggtgtgtacccaggagtggcattgctggttaatgtggtaactccatgtttaatttttttttttttttttttttgagatggagtcttgctctgttgccaggctggagtacaatggcacaatctcggctcactgcaacctccacctcctgggttcaagcgattctcctgcctcagcctcccgagtagccaggattacaagtgtgcaccactgtgcctggctaatttttgtatttttgtagagacagggttttaccatgttggccaggctggtcttgaactcctgacctcaggtgatccacctgcctcagcctcccaaagtgctgggatgacaggcgtgagccactgcgcccggcgtccatgtttattttttgaggaaccatcaagctgtgttccatactggtcacaccgatttccattctcaccaacagtgcccgagggttccagtttctccaggtccttatcaacacttgctattttcttgttttaaattattatagccatgctagtgtgtatgaagaggtgtctcattatggttttgatttgcctttctgtaatcattggtgatgttgagtgaccatcttttcatatgcctgttggttattttttgggagaatccatctcctgtttttaaattgggttgtctttttgttgagttgtaggagctctttatatgttcaggatactaagcccttatcataagacttgcaaatattttctcccattctgtaggttatctttttactttttttttttttgagatggagtcttgctctgttgcccaggctggagtgcaatggtgtgatcttggctcactgcaaccttcacctcctgggttcaagctattctcctgcctcagcttcccaagtagctgggattacaagttcccaacaccacgcccagctaatttttgtgtttcgtattttttattgttttgagacagagtctttctctgtcgcccaggctggaatgcagtagcgtgatctcagctcactgcaacctccgcctctcaggttcaagcagttctcctgcctcagcctccccaggagctgggattacaggcacgtaccaccatgcctggctaatttttgtatttttaccagagacggggtttcacaatgttggtcaggctggtctcaaactcctgaccttgtgatctgcctgcctcggcctcccaaagtgctgggattacaggtgtgagccactgcgcctcgtctamtttttaatatttttagtggagacagggtttcaccatgttggccaggctggtcttgaattcctgacctcaagtgatctgcccacctcggcctcccaaagtgctgggatgacaggtgtgagccactgcgcctcgtctaatttttaatatttttagtggagacagggtttcaccatgttggccaggctggtctcgaattcctgacctcaagtgatctgcccacctcggcctcccaaagtgctgggatgacaggtgtgagccactgcgcctcgtctaatttttaatatttttagtggagacagggtttcaccatgttggccaggctggtcttgaattcctgacctcaagtgatctgcccacctcggcctcccaaagtgctggggtgacaggcgtgagccattggtcccggtctctttactttcttaatgttctttgatgcacggcagtttttagttttggtggagtcaaaatttgtttgtttgttttttcctgttgctcatgctttgggtgtcatatccattggcaaatccaaggttcatggaaatgtacccctatgtcttcttctaagatctgtacagatttagctcattgttcgattttgagtcaatttttgtagatggtttaacatgggagtttgtggatgtctgtctgtctcagcgtctcttgttgaagagacgatgctccccccatggaatggcctggcaccgttgctcacagatgtatgggctcatttctagactcagtgctattccattgatctgtgtgtctggccttatggtggtaccacactgttttgattactatagttctgtagtaagttttgaaattgaaagtatggatcctacagctttgttcttttacaatyttgttttggaaattatgatgtatcctgatgtatttgtccttaygtttttgtgtgtgaaattctttgagcttattggatcccagcacgtggcaagtaagagttccaaaaagaaaacaaggaaggatctcagtaatgaagtaattcacaaaactgccccagaactcaaagacatgactttgcagaccgagaggcccacccagtgcccagcaaaatggaccgcgaaagatctacacagtgaacatcactgtgaaatgtgaggtcactcaagacatgagaagtctaaaacactcccaaaaaaggatgaaaagcccagctcacacagggaggcttgggatgagaaaggcatcaacttcagcctccagcacacatggaaaccaggagatgaaccctgacggaattcagaagaggaaggaatgcaggctggaagccctgaggccagcaccctctcccttagcaccggaggcaggagacccacttccatcatgcagggcaggctttctgcccaggaacacacgccaccaaaaggagggaatgaaaacaggagaggaaatggtgtcacaggaggtcccagggccactgtgagtccagcagcagtaggacagaggagacctaggcgagaagattgcttgaggccaggagttcgagaccagcctgggcaacacagtgagaccctgtctctacaagaaaaaagaaaggaaaacaactcctcaggaggctgaggcattaggatcacttgggcccaggagttggaggctgcagtgagccatgattgcactactgcattctagcctggatgactcagtgataccctgtctcaaaaaaaaaaaaaaaaaagacaggagtgatgcttcaggggagataaggaaatcaagaggtcgccagagtgctgtgagcctatcargagatctgcatgcctggtggagagttgggagttgcatcagaacctagaaaacaaagaggccgggcacggtggctcatgcctgtaatcccagcactttgggaggccaaagcagacacactttgggaggactcgactcaacacacacacttgagtccaggagttcaggacctcatctctattaaaaatagctgggcatggtggtgggtgcctgtggtcccagctacttgggaggctgaggcaggaggattgatggagccagggagattgaggctgcggtgagctgtgattataccactgcactccagcctgggtgacagagcaagaccttgtctcaaaaaaaggggagaaaatrttggagctctgtaagaaatgtaattacatracatgactaggctaggaataatagttgcttcatcataatcgtgtaaacactggatattaatcyattctcaattataaaactgtcctgaaggaatccgagaatggaattatatttcctactagtggggaggagcatgggagaggaagaatcttcatttttccacagaaggatgttgatagataacatctatacttacaaaaagaaaaaagcagctgggcgcagtggctcacacctataatcccagcattttgggaggccaagatgggtggattgtttgagctcaggagttcaagaccagcgtggacaacatgaggaaacaccgtatctactaaaaatacgaaaattagccaggcgtggcagtgtgccctgtagtcctagctacttgcgaggctgaggtgggaaaattgcgtaagtttaggaggtcgacactacagtgagccgagattgcatcaccgtgctccagcctaggtgacagagccagaccctgtctcaaaaaaaaaaaaaaaaaaaaaaaaaaggaaggaaggaagaaaaggagggagacaggaaaggagcacaagcaagtttctggacatatggatgcaagtaagtttataggtgagcgccactccagcctgactggcagacggagaccctgtccgcccctcccctctaaaaacagtagagctctggtgagctgaacagtggtccttcaaagctaccaggccctaatctctgaaacctgtgaatgggccctctttggaaaaagagtccagcaggtgtgaagctgaggctcctgagatgcagagacactcctggatcatccaggtgggccctaaatgccctcgagcttccccttcggttttccccgtgtggcccagtgtgagtccgccagggctgctgtagcaaagggccccacagtgggtgcttcgacaacttactgtctcacagacttggaggccagaagtccagggtcaaggtgttggcagggatggttccatcaaccctgaataatgagattcataaaatacagtgaagtccagggtttattcaagcttaaagcttgggaaccatcactcgggaaacagactcgaaaagaatgggccagcgctccagagtgggaagggaaggtctcgcttacatagaggcagagacaagagaagtctgacagggttgcaacgttttccgtacaaggtagtgcatagcttatagtgtttcttttttacgagacagggtctcgcactttgcagtggtgtggacatggctcactggggccttgatctgggctcaagtgatcctcctgcctcagtttcttgaatcactgggaccacaggtgtacaccaccacaccagctaatttttgtagagacagggttttacatgttgcctaggctggtctctaactcctgggctcaagtgatcctcctgccttggcctcccaaagtgctgggattacaggcgtgagccactgcacccagcgagtttgaactctttaatgccacagctccttctggggctgagggaacctccgtcccaggcctctccggcttctgcgggttgctggccctgcttggtggtccttagcttggagaagcacccccttgttctccactttcatcctagcagggcattctccctccgcatctgcatccacattaccctttgtgtaaggacaccagtcactgggttagggtctaatggcctcatttagctttaatcacctctttaaagaccctgtctccaaataaggttatattctgaggtagtgggggttaggtctgcaacatgtcagttttgaggggacacaatctagcccatagcactccccacccccaacacacacacaccgtgcacagagtgcctgttaggccggatgtgatggctcacgcctgtaatcctagcactttgggaggccgaggcaggtggatcacctgagtcaggagttcgagaccagcctggccaacatggagtgcctgttgacgagcacctcccagccttggcacttgctggacgagcctggaaaaaagccacaactctggacccagtttgatctgggtttgaatccaaactctgccacttatcagttgggggttcttgggcaatatgtcccaatttccatgtctacaaaatggagataagatctagacatggagataagatctacctcatgcagatgaatggagaagcaaaatgtggactatccgggcaacggacaatgattcagcttaaaaaggaatgaaaccacgccacgtgctacaacagcacaaaccctgcatgaccccacgaatcctgcgtgaccccacttatgtaaagaatctagaacagctgaactcagagaggcaacgagaacagtggttgccaggggctgaggagggggatgaggaatcattgttggctgagaacagtttcagttcgggaaagtgagaaagttctggagatggatggtggtgatggttacacaacatgaacgtacttaaccctactcaactatgcatttacaaatggttaagatggggccgggcgcggctgctcacgcctggaatcccagcactttgggaggccgaggtgggcggatcacaaggtcaggagatcgagaccatgctggctaacacgatgaaaccccatctctactaaaaatagaaaaaaattagctgggcgtggtggcgggcgcctgtagtcccagctactccagaggctgaggcaggagaatggcgtgaacccaggaggcagagcttgcagtgagccgagatcccgccactgcactccagcctgggcgacagagtgagactccgtctcaaaaaaaaaaaaatggttaagatggtacattttaccacagtgcgtaggtgggggcagccctcactgaagacgtggtatctgagcggaggctgggcagaggctcaggggtgcccagcgggccctggggaaaagcatgcctggctgaaggcacaggtgggcaaacgcctgagtcaggagtgtggctggtgcagtccaggtgcaggtgggagggctggggaggtgtggagggtgaggacgggggtgcaggggcctgctgaggacggaggggagcagatcagactgcagatgggggtgagggctgctctttgtgcaggatctgctcgtcctgcccagccaggaacactgaaaacggaggggagctgagaagtccacacggggtgctgcacgtgcccatccaggcgtagactctgagggcatggaggcatggagttgtgccgttcacaacctgcacacctgtccacagcagccccgactgcagatgggtggctgttcatatgtcctccacaaacctctgcagctgcttatgacacctcttggctgtggctcatgaaacgatgactgcagccccaccctgaaggatccagccagccagccagccagctgtagcagctgtgagggggcaggtcttggtgcccagggctttcctaatgaccaagcctggccagcttcatgttcttggtctctgggcatctcagcaatggcttgaattatgccctggtatcaagctacctaaaggatggagacagagccgctgtggacacgaacaaaggcttttctccacaggttggtggcatctgtgctgggctgtagtgctggcttgggaggtccccgactctcgggcccccatgacggtgttgttcctgcaggtctgctgggggaggacactggcagggaggcaggtgggaggaggagagggcagggcttcccagagcgactgggaaggcactcccgctacagggccccacgggagcctccggctttccccgcacccaactctcctcaggcacttggttttctgccagtctctggagagtaggctttgcttagggccagtggaaaagttcctgtttcccactatgcagccaagtgagccagggcaggccagcgggtagaggaaggggataggcatgacctctcctgaacgggtttcaaaagcaagtcagtcaatcataggccagaggcgtggaaacttcttggcagaaacatttcctcttccaggaaacggcacttggtgttctcagggtgcccggggctagggtgccagcatgctgcctgggggtgggggtggagagggtttggagttgaggtaaccacagagccttcctgaaccagaagcccttgtgggcctcggaggctggcggggcccctacatagcacctgcagagggcaggggtacacgtcaggaactgaagggggagcttgtgcgggatgcggaggagccccaagcagggagctgtgagggtctctgtggctccagggagtgatgatattcggggagcccctaggaacttgctgatcagggaggcaggagagaagccaggagaggggcacagtgagtgagcctcagggagggcagggcacggccccatccaccccagtgtggggtggcacaaacagctgaggctccggagctgtagcattgacaactcaatctatttgaggccacactaaaaaccccaaacacccaaattctcaaaaacgatcttcaagagtgacgctaaatgccaactgtccctgctgcagcagtctcaggctgccacctcccctggctgtctgcaagggtctcacgctccgtcacaatcggagtgagctgggccctgggctccatgcaaaatgcaggggaagtggccaaggctagtcattctcaatgcagtcaaaatggtcattgttacggaagtgtcctgagagtcacaattccgcacagtcagcaggtacacacctgtgcatggggctgctcacccatcggggcaccataatgtctgtttgctgagcccggcaggctctggagccgctggtgagcgcacagacacagcccctctccggggcaggcactcacagcagccacaagcaccgccacctcgtggcctgtgagtcctccccggaggccaagctgtggttcagctggtgctgtctcctgcaggagcaccctggctggctcaggacttcctagccggggacacatgcccgtgacgtagggcctgggtcagcccctgggtcggggcgctaatgctctggacccactgagcccccagctgtggaggtcttcactgtctcctgacggatgttctcacagcagaggccacaacattggaggacagaggagctttacaggccagcaggagttgctcatagctgcgtcaccaaacccttgaccatgagaagaaagtatggggggcttgccatggatgggatggggactgcagagaggctggctcagctgtgcagatcggtccccattagggtcaaaattgcaggctccctgggcccacgcccaggagcacacacctggccctcatgaggccagcatcaatggtcaagatgggccaggagtggtctgtgggctatctcctcaggatttttaaaggttccctacattatttttttatttttatttatttaacattattattattattttgagacggagtcttgctttgtcacccaggctggaggcacgacctcagctcactgcaacctccacctcccgggttcaggcgattctcctgcctcagcctcccgagtcgctgggactacaggcatgcaccaccatgcctggctaatttttgtatttttaaaaaagatgggggtttcaccatgctggccaggctggtctcgaactccagaccttgtgaccgcctgcctcagcctcccaaagtgggattacaggcgtgattacaggcgtgagccaccgtgcccagctacattattttttacgtttagaaataacgtagaatttatgtaacgtggaataacaacaaagacatgtcagctagtcttgatttagtgaatgaaatagagaatcgcatctcaccgaacacgtattgacttaactaaaggtttaagacttcacagacacaggaggatgacaggagcgtgtgaacagatgggctcgaacagacgctgagctgcaagcagaccccacagcaccgagatgggggagcactgcaaactgggagagaaaatgccgctgtgttacgagatcttcaggctgtcgtttttctggccaaaacctctgtggctggggcacctttgctcaggcctgctgggctcatctcacccacttggcctggcaggctgcactaggctcacactacaggcctga

SEQ ID NO: 10862 - DNA, 13607 bp, Homo sapiens
  misc_feature (1)...(13607): n = A,T,C or G, or insertion/deletion polymorphism (see Tables 1-2)
tgctctttctcccccttaacctcagagtcctcagttggccctacacccccaaccctcagcatcagtacatggggtctaggcctcccccacatctggcacccaccctcccctccatctcatcccccactacccctaaaaacctcggccttcctgcctgtatccaagtcacccgccacccaggaccgtctccccactcctctcctgcagcactatagcctctgctggctcctggactccctaattggacttgtgtgaccatctgggagacaggtagggtactggactttatgccacagggtcctgacgttgaacacactgccctgcacaaaaccattctggcccattgtgatggcagccagccaagatacactgttatgaataactcagccatacattaactgagattttgtgattggaagagtattggcttactatgttataattaatattataacttctgacctcagtttccattgctgccttcatgaagtaagacacttatttaagcttttgtcagagaagaaatctctgggtagtggctaaatcttgcaccctttaagatacaaagccatctggagaatcaaaaatcccaactgttaccagaagagctttatatgttagtgtggcataataagaaatattggtctttattcatggttcccagcacagagctcctaaaacccttgacatttcctgactgatagaaatgtttttgttattcaaaatgagactcttttgaccacacctgaacttatgcaaatgaggcccaggatggcctcaagatgggactgaacaccagaaagaccaagtgataagaaggatagaacctccagccccacccaccaactctggtaaagaagaaggaaggggccagagattaagctctgtaaaaactcttgagcaagatttgttgagcttctggggtgataaacatatcatgtgccaggagggtggtgcactccacctccacaaggacagaagctcctgtgcttgggaaccttccaggccttgccctctgtacctctgaatctggctgttcatccatattctttataatatcctttacagtaaacatgagtaaagtgctttcctgagtcctatgagccgctatggcacattatcaaacctgagtagggtgttgtaggaacccccaatttgtagccgagtcaggtagaactgtgggtaccctccggatccacaacttgaggttgacatctgaagtggggcagtcttggaaactgagcccttaacctgtggggtctgtgctaactctgggtggtgtcagaatggagttgcatcattggaaactcagttggtgttcacagaagactggagaagtacatagcatggaaaatccatgcatttggtgtcagagaaacagttacccatttttaaccttcatattcaaaattccttaaatcccttatcctaaatatcttcgtgtgtgtgtgtgttgttcaaattgtatcaacatctacactaaaatcaaaagtgacaagaatgagattaggtgcataaggatttggaaagaattaaattaagccccaaattaaattgtttaaagttgatttaaaaagcagatggtgcttcttatagagcaagccttctgggatttatgaaacaaaacaaaacaatttctatctaacagggatggtattaaaaccctccatcttggtctcagaattggacagaatcatcactgacatctattaaaataagaaccacctactggttcttattttatctaggagcaaagcaagcaactatagctcgcactttgtaagaatatgtcctcctcactaagaagtgatgctgtcacaagtggtacatcacagtcctagccccagttactgagtgctcactatggatcaggcaaggttgcaggtgtctccctgtgtttatccattgaatcttcatgctacagatgagaaactgaggcaaggagatgtgaagtcacctatgcaagctcacacctattgtcaccagagtccaaggttagggtcacagatctttttggaaatctgaagaaaactagacaatttctttcttcctagggaaaaaacaaaaagcccagaacacagaattttatatacactttctgaagactcacaacacgctccctgccggtccccctgcccaggtttgggatatcactaatgtggtcacaccaggtgacaacggcacaaggggcggcagggaggttcttggaaataaaggaaaaagaatcctcctcaaacataacattggcctgtaaggacttatggcacaggtaggaaaagtcagtttaacaaggcaggaagactcccagacaggaagccctgatgtaaggaaacactcgatctgaagaaataacacatccgtcagatggcggggttggtcagaaatggaaaatgcaaagacaggttcaggaagatgaatgccgcagagcagctgaagccgtgggtccaccagctgcgaggcctgcgtccactcaggagcctcccttttgtctgctcccaggacatggacatgctggccacagggacagatttcccactacagattcattagtgagttaattaattacaaggctttcctatttctgcatcaacactgtgaatatagtaacacgatctgtgttcgttgaatgagtaactggagaactttaagctttctcatacatgtcagtattcacagacaagttcagtcataaagaaagaaaaacttctgtaacacgaaaatctgcttagtgataacattttaccttcatatctggatccatctggatatataaaagtgccttgaccgtgctttttatttctaacatattctccgatatatcgagcaccatttttaaatttgtagatcccctgaaacacattgattatatcattcatatcattgctgaatgtagcatttgctaacagagtattaaatagagaaaaccatccagtcaagtcaacggttctgacctggccatgtcttttaccgaattcgtagctcccttcgtaggtgtccccgttgggtagccgtgccctcccacgtccgtgcctttcgcctgcctcattccgacccccctcatattcctgggtaatgaaaattgacacaattacagctaccattcattaagcgctaaccaggtgctaagcattttgtaaatatcatacccttgagtcatcccactatgctaaacccccggcactatactcaattgtcccacctttcccaccttaaagttgaggtaggtaacaacgcctgggctagatgaggcactggaccaaggccacaccccagcacatgtccagggcggaagcctcgttccctccctccaacacagagcttgcaattcattgtgataatcctttaccctgtaagcaaggttaaccaatttgtgaaaaatgctagatactctaagctgtgttcttagtaggaacatgcttgaaatagtacatgcgggtagaacagttcaagtccacacaaatacctccccgtttgcttccttcagtaatccaggatttcaaaggcaaatgcccagagagaagcaactcttccctcaaatgatccctggggcggggtgtggcctgaagagacctttgccctgcaaggaatttccgatggaagggacaggttggagggcactgaggagtacacagggctcccttgctgattaagtttatcttatttttaagacccctagcaagagacttaaggttcgaacactcatgacccaatgctgcaataattatgtatctatctgtggtttgtttttgtttttgagacagggcctcactctgttgccaaggctagagtgcagtggcacaatctcagctcactgcaacctccgcctcccaggctccagtgatccttccacctcagactcctgagtagctgagactataggcatgcgccaccattcccagctaatttcaaaatttttttgtagagacaaggtctcactatattgccctggctggtctcaaagtcctggactcaagcgatccttggcctcccaaagtgctggaattacaggtatgagccaccatgcctgctcaattatgtgtctatcttaaaagtaaataaataaaaaatgtgatcaaagcttgcaattttcctatccttcagaaaataaatgttccttagcacctaatacatgggtatagagtgaatatagtaaataataaaatgctgaaagcatccagtaatgatttaacatgggtatctcataacatcacactgtatttcttaaatatacataataaaatttattaaaaattaaaattaagaaattgaattggatgtatatagacttattataacacaagtactgacacactacattgaggacttcagaaataaacgtctgtgcaattcttgcccttttctagcactgtttggaccactaattcctgcctagaatataaggtaaaaatctgcgacctcacagatttgtttcagggttagtttacatcaaaatgtacaaaagtcccctccttctatccaagaggcttcccaatacacccaacactgagccgctggggtggctgaataagacagaaatcctttaaaatgaccccaaatgtgatctgaacctaaaaattataggcactaaaaagttacaaatcagtggggccatttgaggagacaaactagaaatcttgctggtcaagtgttgcaggttgggttcacctagaaacagaccctgaacaagtgatttttttttttttttgagacagagtcgctctgttgcccaggctggagtgcagtggcgtgatctcggctcactgcaacctctgcctcccgggttcaagccattctcctgcctcagcctcccgagtagctgggattacaggtgcccgccaccatgcccggctaattttttgtattttagtagagacagggtttcaccgtgttgcccaggctggtctcaaactcctgagctcaggcaatctgcccacctcggcctcccaaagtgctgggattacaggtgtgagccaccgcgcctggcctgatttttttaagtgctctcctgggagaaagtagtaaagagggcagggaagtagacatgaaagggcaggcagctaaggaaggatgcctttgcaggtgaagtcccagacttggcctaatccaacagggactctgggggcatcaatcgcactgcagactttgtcctgcttcttgcactagctactggctgtctggccggatgtgaatttcaggcacttctggctctccatactgggcaggtagttccagcgcacagaggtgatagcttgagtagcaaatcaggcggaagctgggagatgagtgcccagagctagcaaaaaggtctgggcaggcactgacagcaccactgcagagtcgctagatttttcagttaattctgaaagtacctcaactctgtactgtgcatgcagaccatagtggctgaggttccctatctgtcagccatggagaggtcactctctggagtagggaggaactactctctgggtgatagaaatattcccacacagaacccagctcacaggctggatgtgccctctttctcctctctgctgcctaactcaggaaataactccaaagacctgggtcagttcagatggggactgaagaaagcacatgtgaggatacgcctataaggtaatatcttcaggaaccctctcctgagcccagggcctcctcagcatttcttggaggctgccaggaagcaactatcctccatgcatctaaatgccgggggagcaaatctcagctacagaaatgacttattcaagggcagtatggcagcgtgggatgatctgctcatccgagaaaactgcctcgatgggaattaacacagggaggaggaaacttccaaagccttccgctgggaaatctttgcctttaatgggaggcaggatgggggtgggggaagaacgaggcggcatgtggtaaccagacgtcacagcgtttcacttttcaccatcaacttccaggacgcacgcaggtgtgtctggcgtggccttcgtccctgccggggatcctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcargtgggtagcaaccgcctccaccgccgcgtcccgcgtcgccatggagacgcggccggtcccgcctccctcccagcccggaagatggggagcggggacaggcgacgcggacgaagcgggaggagccactggcagcctttgcgtactgtcatagcaacgggaagggcacctcgaccaatcaccgcccgggaatacggaggggcggggcggaagggacgaggtggagccagtggcagcactctggtgccgtcatagcaacgaggggscgcttcggccaatcactgctcgggaagcgagggggcggggactgggcagggcctgagcgggttctgtgcctggctgcccaccggctctctgacctggacctcgccgtcgctggcccctgaaatccatcacttttgtcggctgttctgtgacgccacaacgaggagccacctgggtactgggccctcaagaggaaggacgcgggaaacgcgtccgggccaactctcgagagggtttcacccctgcccagtgcgggcactgcccgctcccttccgcccccaggcctcgcaggcccctccggggntgctgcccacccccacttacctttctaggctctgctgacccttcgggattcgcggctagctgtgatgtgtccgccaagatctcttctcttgtctgtaaacaacttcactctcaaggaggcagctctggcctctcagcaggtgcggcctacagygatgtccgtccgggttttacatccttcccmgacctcgacatgagtcccagccccctcgggcctctgactctcaggtgtcccctacgatcgccgtcctctcctctcgctcctggctcccctacactgtcacacacccacacaatcacagacgcacacgcatgtacacgtgcaggcttggaaatctgctttacctgacgcactccgcctgccgaaggcccctcacatctcccatttcctctgccatcatcccagactgcaaagctgtgttatttgttgttgctgcaggagctggggaggagtgactgaataactataggatttggtcttgatgggagaatcccagaagccaaatccacgcggtgaataagctgctgatcttccagagcacacatcccctagagattcttcccaatgctaatatgaaaggttacaaccataacccatcatcaggcccaaatatattacttactgaataaatacacaagttacaacaacacacgagattccaaaattatgtcgttttttagatgcaaagataaaaatgttgtaaacaccaaaatttaacagcttttcttatggggaaaagtggggagttagggataacagatgattattattttcttctctacatattggcagttacccagttactacaattaagcatgtcctatttttataataaaatgccagaagcattttaaatgttagaaatctagaatggtaacataagtatatgcaaataaatactcgttttttacatttaaaatgtcagaaatttagctttcaaatttgtcctaacaatgacagtaaccagtgtttactaagttctgacactgtgtgtgggcactgttttaagaattttatgagttatcttattaaatcctcactatcattcctccattgaacatctaaggaaagggagttatagggggttataaactaaaaataacctcctaagccccaccacagccaactgaatggacccctcttggccaagagggccccagaaaccttaaaaactgcgttctcagccatgatgggaagggaggtcgaacatgcctcactaatacccttgtgcagtttagacacaacaactaacaagcattaatgttaaaatagagatcataagactgacagaatggacgctgtggcagtaagataccaacttacaaacaggacctaaggccatgccaggcatgagttaagtcatgcatccctacacttaaaagaataaactatattttaactacctggagaaggtcttatgactcgtgttttacatcctgtacttgagcaaacaatcttactgtgaatctctcaaatcgtatcatgagttcctcagactgttgatgtactaattaatacgtaaactactgacactgaaaaggatactgatttgtttctgaatcatgacgtttcactgattgtcttgtgcatatgcagaaaacattttagcctgtatgttgtcatctgtagccaatgactgtaacctctatattgtccctccaatgaaaaaagacaactgcaatatgaggagtccccttcccattcctcaactttcttataaaagcactgcaacttgtaacagactttggaacacacccaactttgttggtgtgtcttccccattcaatcttcaaatttggctttcaataagcctttatcaatttccgcctcaacagccttaactttggtcgacagcagttaagatccttacccaagatcatacagctagtgggattcaaatcaagccagctgacccaagagcaactgttgcccatcactatactgcctcccagatctgtgatataaagaaataactatagttttctggcagtgactaaaccatctaccaagcagaggaccactagttcaaatgccttggattgcaaacaccagagagtggcttaagcaaaccacatggttaagcaaaccctgttctggatcacatcattagcagctagacgtctagctatagctattaaatcctaaggtttacaatttgatttctatcccatacgaattagccagggtcttccctcccaaatctttcagtcaatctatagtaatttcaccacactgtgggtttggcaattatccaaataattgacaccaaaggcaagaaggggtgaacaacaggatgggcctcccggcatctcctgcagcagcacctggactggattctaaattcctccttccagaaagaagctgcatcccagcccagatccagctgagagccacagctgccaagaggcagtcggagctctgggcacctctctgtgcacccaggaagccccaggaggacttcatcaagccaagtcgatgcctcactcagagccccaggatccctgactcctaaccccacagtgacctggaaatgcctggtgatgccagaagcagcgctttccaattctgaaggccctcaaaatgcttgttcagcccaccttcctcctttcctggggcgtgggagtggtggggagatgagaggcagaaagatgaggacatcatcaggaggtttttccttactggaaaatgagaggaaatcctctttcactacttaaaaatcaaaaggggctgtccatattcctctggcaggggtctcccatcatcccccgcgaggcattcccattatcccctgcggagctttcccatcatccacagaggcccttcccataacccccaagtgggaagttcgcgcaagtgcggctctgcagggaggagggagggccgaggggaaggccctcgagagagtggagggcaacagtggccacggttcctctgtacttcgtttcttccgtaagaaatgatcttcttgtccttcttaagtataaatggagcgatccatttccttttacccattaaccccttcaaaaagaagaaaaacagtcccaggctggccatggttgatctctgcaggggcgctggtcagggtgccttctgcttcctggtgggatggcctaggccggggaaactgttgaaaccaccctggggctgccttctgtattttccacaaccttccaggcccacctcccagctggaggccctgcagcttggcagttgccatggcgactgagtccctaagtgtgtctcttctgagctctcctggacagtgtggagaaaaggccttaagaactgaggggcttcagtaaaatgcaaacagattttttttttgtaggcactgttcagataaaaagcagggactttcaacaaaatgagttcaggtccatcttaactatagaactatgaggttgtttattagaataattgtactctggtaaatttaccaatttcatatatatgcatatttataaacaaacatattagagtatatagatagaaaaagttctatctacatgtagaatcgaaaactttttaaaatagtgttggtagtatcacacattgccatttagtggatagagacagacccgagattggagccctagctccgtatacttctttctgaagtcagtctactcatctgtaaaatgggctgttgtgaggtcaaaattagatattcataatgagagtagcatagtgcctagcacaaagtaaagcacttagtaaatgggagctattactattaattgtactgctgttaatcttacaataggttaagcaccttttgtctatcagtatgtttgggggggaattttaactcaagtttatcttaatcgttttcagtcgtgtttttttcttgaaaagaatcaaactgccaaagatgattctgtcagttgtttgtgacaatcagaagttagtctgtgacgaacagattagttttaatgctcatattcattagcactaatatacataagggtggggagagactgaagcttctggaaatatatagacaggtagattcttaagcgtaagtaggtatttgaactgtttgtggattatgtctcataaaattggcacccagcaaggaggaaaatgccagatacacacacgcccatacctgaggtatgtaggtcaatggaaggctattgaaacacagttgtcaagagagaaatgtaaagtatttttcacccaggaagtgagattattcagtgatgcatcaaaaccagtagggaaaacagtttagtggacaccagtgtggagacgagatgtcagaaaattggatagactcgaatttcacgttgggtagcaactcaaggacatagctcagtgcttggcacatagtaagtgctcaaccaacacaggtttatcaaattaaatgttagatattattttgcaacagagctgtgctttatgcagcagtaggaaaagagaaaaattgacgtgaaattttttctttttcttgtttttttattcttaaatcacactccattttccgagggctctctcaggatatcagttgcttaactacgtctgagtgtcttctaggtcgagtactaggggattacaaggaaatgagaaagaaattacagacccattggggggcaaattctacattaatctacactgttaaaaaaatttaccagggccgggagcggtggctcacgcctgtaatcccagcactttgggaggccaaggtgggtggattgcctgagctcaggagttcaagaccagcttggccaacatggtgaaaccctgtctctactaaaaatacaaaaaattagctgggcatggtggcgggcgcctgtaatcccagccactcaggaggttgaggcaggagaatcgcttgaacccgggaggcagaggttgcagtgagccgagattgcaccattgcactctggcctgggcgacaagagacaagagtgaaactctatctcaaaaaacaaaaacaaaaacaaaactattatgccttctggctacatgttaatccttcattccaaagtggaggtcactctttcctactggtggatatgtaaggctggttctagttttgatgctgcagatagcctcactctaaccagcagttgtggtgggagatcctgtgctacatggggctgtacttttcaaggtctaagggtggatcagattttctagaaaagggacagggaaaaaggtggcatgctgaaccacgtgtccatgattttcccagaataaggctccccctacccaacttacaggaaggtcatgatcaaataagataacgaggatgaaatgatttggaagtgctatagaaatgtaacgtgtatatttagctcaggttttaaaatcttttaattatgtaacatttgatgcatgcaaaagaacacatattcacgtatgccagcaaagtaatacagtgaacacctgtgaacccctgcccaaagtaaatagatgaatgagtaaatgaaataaatattaacatctgaatgcatagatctttgtccacatctcaaattcagctctttggattgcagctttatagaattgagagattgctgagcctaaatacatgttgctgcattgcctccgagaatggccggacctatccccactctcaccaaaacagagtgtgggactcactgctccctcgcctactgtaagtcctatttttcttctttgctaatctgatggacaggcagtgtctcatagtgactttagtttgtattcatattttctcgattatttgagaagataagcatttttccccaaatgtttattcttcacctatgataacccttgttaattatttagattagttttttgcaggccactttcatatatctgtatatgttgttttctctttctgaaatgtgatgcccatgtttctctacctggtgaacaatttgtcaactttaatatcttaccagatgtaaccttcctagggatgctgtttctaactgctgccggccccttcttaccatctctctggttgtgcttctgacgcattccctacacaactggaacgtgtttccaggtcagcctccctaagcacctcccaaggcctccaccccacagtgtcgcacagaacttgacacataccagatgctccaattattaaatattactgagtacttttagaaaattgggaacatacaataaagtataatgaagaaaataaagaaaaccaataatctcacttcccaaagataataactactgccattttggtgtgaatcctttcatgcttttaaaatgcatatatatgtctatttaattgaaatcattctatttgtcacttacattatcacatgtcattatatggtgcacatgtcaaaaaaaatttccaaagtgttttaaagacaatagtatttcaccttaaggatataccaaaattattatgtcacaaatgttggataagagaatgaatgaaaatctttaatatgaagttgaacaaggtaaggggtattacttaaggaaattatactcctttttttttttttttttttgagacaaggtctggctctgtcatccaggctggagtgcagtggcatgatcacagctcactgcagcctagacctcccaggttcacgtgatcctcctgcctcagcctcccgagtacctgggaatacaggtgcctaccaccacacctggctgattttttgtattttttttgtagagacagggttttgccatgtcgcccaggctcaacaacatgtggatcaagagatccactcacctcagcctcccaaagtgctggaattacaggtgtgagccaccacacccagcctccattttgtttttaagaaaacaatgtgtcgggtgtcttttctcagtatgtcattcactcatgtttcttgggt

SEQ ID NO: 10863 - DNA, 13649 bp, Homo sapiens
cttgcccttggcctggtgtggtggttcatggctgcaatcccagcacattgcggggcggaggcgggaggattgcttgagcccaggagttcaagaccagcctggacaacaaagtaagaatcagtctctaaattaaaaaataaaagtaatttttttttgtttttttgttttgagacagagtcttgcactatcacccaggctggagtgcagtggcaccgatctcggcttactgcaacgtccggctcccgggttcagacgattctcctgcctcagcttcccgagtagctgggattacgggtgcctgccaccatgcccagctaatttttgtatttttagtagagatagggtttcaccatgttggccaggctggtctcgaactcctgacctcatgatctgcccacctcagcctcccaaagtgccgggattacaggcatgagccactgtgcctggccataaaaataaatttttaaaaatagaagcaggtcttccctgactaccctgtctcacttttagtactgtcatttgacactattttaattctctccaattgcataagttttatttttgtctgttgattttctatttttctcatcagcgttattactggagaacagcagagtccacccatcttgtttactcttacatgctcagcagagaggcaatgccagaattactaacagtgctaaagttactaagataagtaaggtgctggatataagaggaatatatgaaaattatttttttctgcactaacaactactagttagatacagaaatgaaaaagtaggccaggtgcagtggctcatgcctgtaatctcagtactttgggaggccgaggcgggcagatcacgaggtcaggagatcaagaccatcctggctaacacggtgaaaccccatctctactaaaaatacaaaaaattagccgggcgtggtggcgagcgcctgtagtcccagctactcaggaggctgaggcaggagaatggcgggaatccggcaggcagagcttgcagtgagccgagattgcgccactgcactccagcctgggcaacagagcgagactctgtctcaaaaaaccaaaaaaaaaaagaaaagtaatccctaaaatgaaaagatacctaggtacaaaatttaaatggtaacataaaaataaaagataatttgaagtaaattaaatctgaataaatggtggataacctattttctggttggaagacttaatattataaaaacaatatcacaaaggagtatcgcaaatgagtttataaatgtcatgttattcccatcagaacctcagtgggtcattgtttttgttttttggaactggaaaataatgtggcaaaaatcttagaagttcaataacacattgtgttgatgagaccgaagaaaaatgaatcctacacatattgctggtaggactaaaaattgattgaacccctagggaagacaatttggcaatatctgtaaaaattaaggcatttactctttgactcagctatcataattctgggaatttatgttacagatacaattacacattgaaaggaaaataaatcttggggccccaaaatcactaagccaaagggaaaagtcaagctgggaactgcttagggcaaacctatctcccattctatacctgaaaaagccactaagataaaaaagctacctaccttcctcacagggaatgtccttgtggacaaaggacagagagaggcaggcggatcacctgaggtcaggaattcaagaccagcctggcctacacggtgaaaccccgtctctactaaaaatacaaaaattagccgggcatggtggtgcgcagctgtattcccagctactaaggaggctgaggtgggagaactgctagaacctgggaggcagaggttgcagtgagccaagatcgctccactgcactccagcctgggcaacaaagggagactccatctcaaaaaaaaaaagccatcatctgttttgggggtgtaataagatatatgtacttctgaaccatgtaagtatttcggccgggcgccttggctcacacatgtaatcccagcactttgtaaggccgaggcaggcagatcacctgaggtcaggagttcgaggccagcctggtcaacatggcaaaaccccgtctctacaaaaaataaaaaaataaaaaaatttagcctggcgtggtggcgggcacctgtaattccagctactctggaggctgaggcaggagaattgcttgaaccggggaggtggaggttgcagtaagccgagatcacgccattgcactccagcctgggcaacaagagtgaaactccgtctcaaaaaataaataaaaaataagtgtgtcaattctaaaattaaaaaaaatttaaaagtttgcatggaaaaactaagaatagtcaacagtatttctgaataaaaaatagaatcgcggctgggcgcggtggttcacacctgtaatcccagcactttgggaggccaaggcgggtggatcacgaggtcaggagatcaagactatcctggctaacatggtgaaacctcgtctctactaaaaaattagctgggcatggtggcgggcgcctgtagtcccagctactcaggaggctgaggcaggagaatggcgtgaacccgggaggcggagcttgcagtgagcccagattgtgccactgcactcctgggagacacagattccgtctcaaaaaaaaaaaaaaaaaaaccacacaattacatgtggttttgtgcctcttggatttcagttattggggaagagtagtgcttacatccttcttattttactgttattaagaatcctggctggcacggtggctcaagcctgtaatcccagcactttgggaggccaaggcaggagaatcctttgagcgcaggagtccaagaccagccctggcaacatagcgagacctcatctctacgcatggtagcctgcccccgtagtcccagctactcgagaggctgaggtgagaggattgcttgagcctgggaggtcaaggctgcagtgagccctgatcacaccactgcacttcagcctgggtgacagagcgagaccctgtcttgaaaaaaaaaaaaaaaaatcctattcctgccagtaaaattgggctctatattaccaatttgtttatattgcaaattaaaatctgcaagtctggacttaaaaaaatggaaatgtttgtaattaactaaagtttctggaagtgataagcagtatagaaaggaaagatgtgtggtaaaaattgctcaactgattttgtaaggatttattaagagtattcacaggattttcaacattgcttttctgtgcaatatgataatttgtgtgatttttaaaaactgggctggctacagtggctcacgcctgtaatcccagcactttgggaggccgaggtgggtgatttgcctgagctcaggagtttcacaccagcctggtcaacacagtgaaaccccgtctctactaaaaatacaaaaaattagccaggcgtgactgcgtgcgcctgtagtcccagctactcgggagggtgaggcaggagaatcacttgaatccagaaggcggaggttgcagtgagctcagatggcgccactgcactccagcctgggcgacacagcaagagtccggctcaaaataaaacaaacaaacaaaaaaaaaactgttatgaactgtatcatttctctattgtggcataacaaatcatcccaaaacttggtaccttagcacaaatattattttattattatctctcataggtctgagaattggtgtggttctcacacagggtctctcatgcagttgcagtcagattaggggctggggctggaatcattgtaaaggtttcctcactcagaagtcttgtggttgatgttggctgtaggcctgaacgcccacacctggcctctccattggcctggacttcctcaaagcatgggggctgggttttaagaacaagtatcccaagagaactaggtggaatctgtttcactttttatgacttagtctcagaattcacagtgtcactccctccatagtcacagattcaaggattagggatacagactctacttctagatagaaggagtgccaatgttacattgtaagactagcacatagaatggaagatcttccagcatctagaaaaattcaattagacacatcacttgttctgttctttgttaataaatatgtataaatataatttgaacagacttcttataagactccaattttttaaattgttgccatgtcctgttgaaaaagaatttgtgctacatattttctgtctgccctgttagaactactctccattggtctccatgttctgtgtccctgagtgctagcctgaatgaactgcatcagtaaactctcttgccctctaccttcttgggtcctgccaatgcacagtacctacataagatcagaggtttggaagaaatgaggtcaaggtatttattccctggctggattacggatttggtatatttccgtagtcaccgcttatgtctgaagactatcttctatccctcctgtctcagcctcccgagtagctgggactacaggcacctgccaacatgcccggctcatttttgtatttttagtagagacagtttcaccttgttgatcaggctggtctcaaacacctgacctcaggtgatccacccgcctcggtctcctaaagtgttgagattacaggcgtgagccaccgcgcccggcctaaccctatactttctggattcccattgctgctcccttcttttgcctcttttggggtagtagtagtgagggatccccctgttgatagcgctggtatgcttcactctggttggtttttcttacccagtctacaactttgtaaacagtccctttattaagctctccttaattacttagcatatgtaagcctagtaacataactttcaaaacctgtaattctgataagtgatcttactgaaaataattttataattgactttatttttaaaagacagggtctcattatgttatttaggctggttttgaaatcccagcctcaagtgatcctccatcctcagactcttcctctgagtagttgggattacaggcatgagccaccatgcctggtttataattgacatttttgtattcttaaagaatgtaaatacctgtaatattgctctatcaaatcatctataacatagagaaaattcctgttactctgctatatttgcttttttttttttttttttttttttttttgagacaaggtcttgctctgttggctaggctggagggcagtggcacaatcttggctcactgcaacctctgcctcctagaggatactcccatctcagcctcccgagtagctgcgactacaggcacctgcaactatgtccggctaatacttcaattttgaggggctggcagggtcagaggtaggggacggggtcttgctctgttgcccaggctggtcttgaactcctgggctcaggtaatcctcccacctcagcctcccaaagtgctgggattacaggagtaagccacagtgcctggccaaatatttgctattttaatagaggttaagaaatgtctcatttaaattaactacattaggccgggctcagtggcttatgcctgtaatcccagcactttgtaaggcctaggtgggcggatcacttgaggtcaggaattccaggccagcctgaccaacatggtgaaaccccgtctctactaaaaatacaaaatttagccgggcgtggtggcgggcgcctgtaattctagctgctcgggaggctgagacaggagaatcacttgaacccaagcggcagaggttgccgtgagctgagatcgcgccactgcactccaacctgggcgatagagcgagatccgttcaaaatttggggttcaaaaaaaccccaaattaactacattaaacaagcaactccacacttatgtaattacatgtatgtaagtgctgcaaagaagaaaatgtaaaaatgtatgaagagctgtaacagaggaaactgacttttaaagtggtgagctggcttccctaaagaaaggcatttaaggaaatctgaggaaggagagggatagtctgccttcagagttttgtttttgagataggtctcactgtcacccaggctgagaggctgagatcatagctcactkcgtcctcgcgtctccagcacaggtccgggtttctccacccaatgcgcctgcgcacaggcctagcccagtcggacgcagcccagsactgccaggggtggggattrcctgggtcccccaggaagggccgggttacgtccggaaaagtgaggcccggggttccagttaattgttaccggaagtggagggaagmgttgccaggggagggcggagactgtggctgacaagatgggtggcaggcccttccctgggggtatcgaggtagggacgtttgtggctacgtctgtcctagaggaggagacgatgccaggggagagggagacgcagacactgggactgggtcgccagcagagggcctcggaagccaagccaccccgtctgaagacgcttctccttacggagcccagaagcgcgaacggagactgcgcagatcccgtgcgctgcgccggaaacggatgcatagtctcggacaccagctcagacctgccgcctggccaggtccgtgcgcgtttgtagtttgtaaagaaatgttctaatgtgtatatttccacgtttatctgtatattattcacttgggttgtcttctgtttgtgtttaatgtgaagcctagagttgaccttgggagcttcagaggtagggtgctaatttttcttgcaagctatgtaggtagtgaaaggaaggtgacaatgactacaggaaattcaccctagtccctcttcttccccagaagtggtcacaattacaggtgctttcctgttccacgctctattgcatagcccaggtgcatttatgggaacaaaaccatggagatagacactgatctttaataacattctgtaaaatgccatccttcaaaaaccaaatatccttgtaagaaagttaaaacatttggtgaaactattattttaggccaggcacagtggctcacgcctgtaatgcctacactttgggggcgccgaagcaggaggactgcttgaagaccagcctagggtaacagaaatcccactcatctttacccccaaaaaattagccaggtgcgatggcataagcctgtatggtagaggctgtggcaggattccctgagccctggagttcaaggttgcagcaagctgtgactgtgcactacagcctgggtgatggagcaagaaaccccttctctaaaaaataaagtgtctataaaaatcagtcttacttagaccagctgtcaagattctccagttcataaagtgtaatacccacttaaaattttatgtgcytaacggtcaggcgcagtggctcacgcctgtaatcccagcactttcggaggccgaggctggtgaatcccctgaagtcaggagttccagaccagcctgaccaacatggacaaaccccatctctactaaaaatacaagcctgtaatcccagctacttgggaggctgaggcaggataatcgcttgaacccaggaggtggaggttgcgatgagccaggattgtgccattgcactgcagcctgggcaacaagagcaaaactccgtctcaaaaaaaaaaaaaaaaaaaaaaacgtgcttcatattcttcccagccgggtgcagtggctcacacctgtaatcccagcacttcgggaggctgagcagggtggatcacccgaggtcaggagttctagaccagccaggccaagatggcaaaaccccgtctctactaaaaatacaaaaactagctgggtatgggggcacatgcctgtagtcccagctactcaggaggctgaggcaggagaatcgcttgaacccgggaggtggaagttgcagtgagtggagactgtgccactgcactccagcctgggtgacagagagagactcggtctccaaaaaaaaatcattcccagttacagtagcaccaatacatttcaaattaagagtttatttagaatactttggccgggtgcagtggctcacacgtgtaatcccagctctttgggaggccaaggcgggtggatcacaaggtcaggagatcgagaccatcctaacacggtgaaaccccatctctactaaaaatacaaaaaaattagccaggcatggtggcaggcgcctgtagtcccagctactcgggaggctgaggcaggagaatggcgtgaacccaggaggtggagcttgcagtgagcccagatcgcaccactgcactccatctcaaaaaaaaagtttacttagaatgcttttttaaaagcataataattttaactatacctcagattttacagcttaatgaggcattctattcctcctctttctggcttagtttcttgccttgaagcccagtattccataaattttttagggcaatttttcaagttgaagtattgacctcagttgggaatattgttaaaattcagtttctaattcagcaggtctagggtagggacttgagattcagcatttctcaaaatctcaggtagggccagtcagccttggacttgggattaacagggctttaatcaacacacaccaccttatatctctacattaaataaagatccattaggttatatatatacaataaagactaagaatgaaaacaagaaatttattaaatatacaaaacaggaatacagttcaattactgtgtctaaaaaatttcatttttacataaccaagacaatatttacaactatatacaaaagactcccacctgtgcataacctttggtccatctgtgctatctctcatatctgcaagagaaacctaaaatgttaatatttgagtgttaagtatttacatctttttgtgttggtttttaaatgcacaagtacccctgaatggctcaaagggatgggataatgctagaaacactaacttgcaataaagtgcagttttcatgcaaacttagccatcagttttcttcttttagataggtatccacagtccatatggactttttttctgatctatttttggtgatcttgaagatgcctcttctgtggcagctttagctgatttttgtattggctttgctacagaattctgtaaaagaacaaattcagtcagcttcccaaacatacattgtacacttttttcacaaaaaaaagtacattaaataatcccatgtatgagccttagagatattatcaattgctgggcgcggtggctcacgcctgtaatcccagcactttggaaggctgacacgggcggatcacgaggtcagatgtagaccatcctggccaacatggtgaaaccctgtctcctaaaaatacaaaaattagccgggcgtggtggcatgcgccagtagtctcagctactcgggaggctgaggcaggagaatcgcttgaacccaggaggcaggcagaagctgcagtgagccaagattgcaccactacactccagcctgggcaacagagcaagactctgtctcaaaacaaaaaaaaaaggattatcaaccaaacacatagtgtgaaccttaattgtagcttgattcaaaaagtgaagtgaagatactggggcagcagggagacactggacatacacaagatacacaaggtataatgattttgaggcttcgtttttgaaactcttattttaaaacattgtgattaaggagtattctaaagatttccctttaaaatatttcaataaaaaaggggggacacttaaaagaatggcaaaatatcggaactaacgtgaatgttatatatattacaaacccattataatggccacttataaaagtggctcaaaaacaaatgattttaattctatttaaaaagtgtgtcagtaggcccccaactatcaccacaaagataaaaacacaaagatgcaaaaatacatcctaaatccaatttttgagtgttcaatgcctggatatacttacattagagctaaaagctatgcttctttgctgggtaggtttttcattgggatttcgagttccatcttctgttaccttttccgacagctagacaggttaagaaaaagtgtaattttaaaacacatacccttggtttctaaatcctatattaaaaaatagcctaattgtaaacaaaatttagctgtagacacaaaaatcaacttggatctaacagcctaagtaacagaactattgagttttccccttaacaaaactgatttaatattaggcttaagacactcttcccataattattttacttccctgctggcaaatttaaactaattttttaatcagttttctcaggttgaatcaagttcacttttgaaatgtaaagccacatcagaaaatacgttttaagaaactaaggcatttgccagttaggcacctaatcgtctgaacaaagaccttgtctactaatactgagcaaacccacatctgggcccaattacacagattcatttagatacagcatttttttttttttaagcccccgagacgggagtcttgctctgtcacccaggctggagtgaaaagtacagtgcaatttgctaatgcacatcctgcacatttctggagaattataataaacttatctgcaagtgaagcaggcctcctcttctgtaatctctcaaaacatctggaatatattgcatatattatgaaagggacatctttttcacagatgccccaccgttacaacgtgtacctttgcttagtttaaaaattgactttaatactttatgcaaatagtgcctgtcccaaattctagcatgcacatggatctaccaacaaaaaaactaagttttcagtgtgtgaacataaacttcaaattaaacctctgatgctttagcccatgtatcaattaccaacagattttcttcatcaatgtctgcagaccacattcatgatttctataagacagaaatagagcagataaactatactgtatatgctgagtacagaatttgtgggaacataatgctgcaaatgaaagctacaaacactctgtaaatagcttagaaaaactagtaatagaaatcaccaaagtaccagctaataacggtgttataagagtacactgttaactgaaaatgaaaaaaataaatgtattttttgagacagggtctcgctctgctgcccaggctagagtgcaatggtgccatcttggctcactgcaaccttagcatcctaggctcaaagatcctcctgcctcagcctcccaaacagctgggactacaggcatgcaccaccatgcctggctaatttttgtattttttgtaaacacgcggttttgccacattgcccaggctagtcttgaactcctggactcaagccatctgcctcattacaggcatgaggcaccatgcacggccaaataaagctcattaatctcccattttcatgggtttgacattgcctatcttcagatttgctactttgaatttagcacattatatacatctctagacttcccaaaaagtatagtctaagatataagtggctaatcagatttgacagttggctttctgaaagttttgttccgacaaacctagaatacttacttcaggctttgcaccattacttgatacacctattccacggcttgtttctttggctgaaggaacagttctgagactagctggcaagtcaatgttggttgttcctagagctttcgctgcattggtttttgctatttctaacagctccattcgatctaaaaaaaaaagagagagattttaaaatactcattaatctggtagttatttcccaagagaactcagaattacacaataaatatgttattttgtggtattaaatatattaagtcacttgttttataataggtaaactaaggttgcccttgaacactagtagctgcgctggtccactttatacttgttttttctcccccttactaaatgcagatagaaagtaccacagtgtttgagagactgtaaaccccaagtgtgcgcgagggttccatatgcatcctggcaccaatcccccgagtgaacagagggacaactgtgtaactttattcactgaaaattctattctccagctcatttcttgctgaaaagaataaaattcttaaattatctcaacaattagttttgttttcttgactaaaggcctgagcgtcctattattttgtctttttgttgtacttaattttctctagctaatagtgatattattttgctttctcttcaaagatgtatttctgaaaaccaggtttttctgctgtagattctttatataattatcacaaccactgaaccaatactgatacactactaaagtgtatttctaccaccacccccggctaatttttgtacttttactagatagtgagctatgttggccaggctggtatggaacgcctggcctcaagtgacccacccgcctccgcctccgcctccccaagtgctgggattacagaggtgagccgccgcgcccggcctcctaggtcacttaggatactcgacaatccaattttattcagtaataatgtcaactaaaagaaggcgtgttttgatattgttcttcccaatcacgttaacttagaacctttaacttaatcataacatttaaaaggctccacccactaagaacagtcagccaataggaaaaaaagttccctacatcctgagccatttaacatccagttgacctttaaccctaaagagaatgctgtccacttaaatacaggtaatgtcctccctctttcctccaaaaagatttcgggcactaaaggaactaatattgaaactacacagcaacgttggttccctagcctactcatatactgccaccatacattaccacaaatggaaaggtaaatgacccacccacctttttcacttaagcgaaagggggttctgctccgcgacctcgtcctggatctgtccctccatctgctgtgctcctccgggtacactgtgcgaccaaagccgtagtagcgctgtccccgcgcgatcgcgtacgcccttccgcagtacgaccttccccgagagcgcgacctgctacgggaccgggaccggtaccgcgaaggagaccggtagtatctcctggtgaacccgtagcgcctctctcggtaacggcggctgcgggatcgcgaccggctccgcgagtatgaccgcgagtagcgcctgtacttccgctggtggcgccttcgggaacgggacctggacttgctcctccgactcctggacgaaaaccggctcgagacgcgggaatgggaccgagagcttctggaaaaagagcggctcctagaccgcgacgacagccggctggacccgcccgaccgcgaggtcgagggcgaatccttctcctgcggcgagcccggccacatgtcgttcacgtagttggacatcttcacctgcggctttagcctgcgctttctccggaaaggatcccgcaagcctcaactcaggacttcctaaaaaaccaagagagaaaaaacaagtcgagtcgcggaagccggcgcctggccacccggaagccacagtcggggaacctccgggaggcggagccacggcgcgggcggcgaccgccgcgacaggaaccgagccctagaaaccccgctcggcgccctgaggccgcggccttgaagcgaaacgctgcgttccccaaacgcgg

SEQ ID NO: 10864 - DNA, 22350 bp, Homo sapiens
tctgcactaacctaaaaattagcaaagacaaaagtgggagagagtgtccaagattaaaaaagactgcataggcatgaaccttgtttgtatcttaattcaaacaaatcatagaaacaaataatttatgagacaatgggggaaatttgcacacattagatatttgatgacatttttcttttatacacacttgatgtaaatggaagaaatgatgtgctgtctgagatctacttttttttgttttgttttttgaaataaaactttatttattaacactgaaatttgaatgttttataattatcaggtgtcacaaaatatttttctaattttttccagtcatatacaaatgtgaaaaaaaaaatcttggcacatgggacataaaaaacagatagtgaatcagctttggcctgcaagctacaactaaatgaatcctaatctttttttaattttattatttatttattttttaattatactttaagttttagggtacatgtgcacaacgtgcaggttagttacatatgtatacatgtgccatgttggtgtgctgcacccattaacttgtcatttaacattaggtatacctcctaatgctatccctccccccttcccccaccccataacaggccccagtgtatgatgttccccttcctgtgtccatgtgttctccgagatctactttaaaataatctagtgtaagagctggggtggaggaaagcagatgggttttcaagactagacatgagctgataagttttaaagttaggtgttgggcacatggtactcatagtattctttgtgcttatatacatgtttgtaattgatttactaaaggtagaaattaaaaatattttaacatcaaaagctggtgaggctaaaaaaaaaaaaaaagctccttcatttatactgcttgatgggggttaaatcacttgaaggaggagagttacttggcaatatatatttcaaattttgcataatgggcatttatcttgagccagaaattttacttctaagaatttattgtagggatagtcagatatgagcacaaagataaatatacatatttgcttactaaaacattattggcaataatagtgaaaatttattaaacaacccaaatgcccaacaatatagactatattcattatagttaatctcatcagattttttttttttttttgagacagagtcttgctttgttgcctaggctgaagtgcaatggtgcaatctcggctcactgcagcctcaacttcccaagctgaagtgttcctcccagttcagcctcccaagtagctaggattacaggcatgggccacaatgccttgccaagttttgtattttttgtagagacagggtttcgccctgttgctcaggctggtcttgaactcctgactcaagcgatcggcctgcgtcagtctcccaaaatactgggattgcaggcgtaagccactgtccctggcccagattcttaaaagcactgcatgtgtgtgtatttaagtaaaaagaatatagttaatctagtaaatacttttaaaggtccctaaggcacttgaactcacttataaacaccgttcctattattcctccttgacactattagtcatgtatacaacatacataattcatgaaatggaaaatacataataaataaatagttgatctctaaaatcatttgaatgaaatagtaaagtaacgaaccaagaacaaaacattataaaaacaaaactcaccttctaatatgtgttcaagagaaaacacgttaattataaaatgtaacatggcttcaagtctttccttcaaaaatatcatgagaaggaattaagagtcaagtaaattcttttgttttattgttgacaagtatagtctgtgcaattatactgtatgtgaaatatagatttttaaataaggaataatgagcatcatatagcaggtggtcagtatttctcaatcttggtgttaaaatcctatttcctttctaacatcttgagtacattataaaaaatgaatcatgcccgaaaggtatgagagaatctgaaaaaaacttaagttttgctttccagagatcacaactaggtcaggtctaatgctttattaaaagaaaaagaatacatatgtgtatatacaatatatatgttttaagataatctatccaacttccgtattttcttaatgtaaaggtataatatagggaacttctgctaataataaagatggagataactcagaccaacctttcttctgaaggcaactaaaagtctggacaaaatataaaaaacatctgtttgaaggcactggattattaataagatggtgaaaaattacaggtgagtatcaggaggaagctggaggctcaggaaagtaatttctgcaatttcagctaatttccccttgaggttgtttgcttatgctggaagagctggcagaaaagcatagcaacagtgctaagagctttgggggaatagggtgctggaactggaatttaggatctttgtaaatcttccttgctttgagttgggactctgaacagctatactgtagagggcaaatcagaaataggcaggacctcaggaaactacagtttagtatcaaattacctcagtctctgaaataggactgaggtgattctgaattgctaatgctacctagaatatgaaagaaggaactgtaaatattctctgagatatttaatatcatgatcagatgcatcaaaatattctgcaaataattttgcaaatacctgactggcacacaaaaaatttgcatgcatatgaggaattaagaccacatgcaagaaaatcagtctaaacagatccagtggttacagactttggaattctcagacacagactttaaattatagttgtctctcagtatctgtgagggataggttgcatgaccatactaaaattcatggatgctcatatcctttatatataaaataatacagcatttgcacacaacctatacaatcctcccatatgctttaataatctctagattacttacaatacctaatactatatatatatactatgtaaatagttatgatgcattgttcagggaataatgaccaaaaaaagtctatatgttcagtacagatgaaaccatccatgttttttttttttttgattagttggttgaatccatggatgcagaacccatggaatatggatggctgactataattataccctttgtgcttaataacaatttttgcaaagatatgaaactataaaaaagaataaaatggaaattccagaattggaaatatagcgactgaaattaaaaattttatggatttaaggatcatttgataaagctgaaaaaagaaagtaaactgaagaatgtgagaaacaaaattatccaggaagagaaaaaaacattaaaagcaaaagagtaaagggcatagacaatacaatgggaaagtgccatgcaatataattggagtcccagaagtagaggagagagcaaaagtgacaaaagcaataggtgaggagataatggttaagaattttccaaaacaaacaaaagataatgcagaaacaaattcagaaagtcaggaacccacttaagagaagtaaaaataaagtcaactaggcataacataataaaactattacaagccaaagactgaggaaatatttcaataagccagaagacagattgtattcagaggggcaacacttaacataaaatctgacttcaacagactattattctctgtgaataaggtcttacatattagcccttcactcccaactatttgtctatttgtcttaggtgagctaaatgtgtgctgggacacatttgagccaaatgtcccagcacacatttagctcacataaggaaatggactctagttgggagtgaggggctaataaacaccagatcccaagaaaattccccataatggaaaatataggcagatttgactatataaaagttaaaagtccaataaattgatcaattattgctcaacatatatataaaaaaaagcagcaccaaatgaacaaagagttattagatacgaagtgccaagtaaaaaaccaagcaaacaaaaagcccctcaaacccataacaaataaacaaaaatttccactagtgtgaatgagcaaaggatacctgacaggggatgaattggcctcatcgataatctgagagttacacattttaaaagactatgcagctgggcgcggtggctcacgcctgtaatcccagcactttgggaggccgaggtggatggatcacgaggtcaggagattgagaccatcctggctaacatggtgaaactctgtctctactaaaaatgcaaaaaattagccaggcatgatggcgggcacctgtagtcccagcttctttggaggctgaggcaggagaatggtgtgaacccaggagacggagcttgcagtgagcagagatcgcgccactgcactccagcctgggtgatagagcgagactcggtctcaaaacaaaacaaaacaaaaaaaacaaaacaaaaaagactatgcattattattgctgttgttactatttttggtttaggtaaagatgaaacagttactctcatgggtactaagtacagaaaaaaattatgaaaagcagtttaacatgatgcattaaaaaaaaaatgatatgtcctttaacctggcaaatcagcttctaggattctgctatgcacgcacaaatgtgaatacacagatgtgttctctgatgtactgttcactaatagaaaaaaggttaattaaattatggtacatctattctctggattctcaaaaacaataaaaaaatgaggtagattcttcatgtatgcaccctaaaaatgttcataataaacaaataaaaccaataaacataataaactaaacaaaaaagttgcaggtcactatgtgtaatgtgctagcattcacgtgaaacctaacaaaaagctttatgtaatacatgtgtattacacacatactgcaaagataaatatttaacagcatttaatctctgagatagggcataaaattgaggttctgagaagagttgaaggtggcagtctacttcttttcttctacattgtctgaatttttttcttaactaagattatatgttagctttgcaattaaaatgtctcacacatacttttatgagagaaagagaaatatcaagtgatttgtcaatagaaaaatagtaaactctacactgttagttgatcttaagaacagattattattataaaatatgatatgattaattataatttcctgcccttaatagaggttacattttaaagaaggatgggaagcaaaattgttccatcaaaaatagataaaatgggttaggcacagcagctcatgcctataatctcagcaatttgggaggccaggggagacaactgcttgagcccaggagtttgaggtcagcctgggtaacagtgatactttgtttctacaggaaaaaaaaaaaaaaaaaaaaaaaaagccaggagtggtggtgcatgcctgtaattcctagctacttgtggggctgaagtggaaggattgctagagcccaggaggtggaggctgcagcaagctttgattgcaccactggactccaggctgggcaacagggtgagaccctgtcaccaaaaaaaaaaaaaaaaaaaaaaaaaaaaaaaagaaaagagttgtaaaatgaattttactgctagagttatatagaacatcaatgcatacttgttctagatctttggaagatactggttaattgaaatgactataaagctaattttcccattaattttcataaaatagacaaacctattaaaattaactgttctatagattgatatacaaaggttctctttagaaataatgttactatttacttaaaacgaaagttatacttacaacaaggaataggctgaactggtccaagttgtggaaaggtcataagaacagaaatccctggtagatcgttttgctttggttgttcggcagtttggtcagcccaaactaccacttttttcctctctaccaaatgttcgatctctttgaagtcagattcaaaagcagcatttgacaggccggcttcttttaatgtgcaatattgttttcttagggttggaagtaaagcattcaatactctatatacagaagatgagaagaaaggagagataaatatgacattttaaacacattattttagttcttttatgtaacacccaaagcattagcatatcattaaaataatttcccatgtatgaactgagttctagtctcagattgtcttcacttgcttccatatgaccttggacaaggcaaaaactgaagtttttcctctgtaatgtgagggacagataaatagccactacttataataggagattgctttgaggactaaatgagttaagtatatttgtttatttattttttagagacagggtctcactctgtggcccaggctggagtgtagtggcatgatcatctcattgcagcctcgaactcctggcctcacttgatcctcccaccttaggctcccaagttgctgggaccacagatgtgtgccactacactgactaatttttttattttttggtagagatggggtcttgctatgttgtccaggttggtctcaaacacytagcctcaagagatcttcttgcctccacctcccaaagtgctgggattacagggatgagccactgtccctagctaaatgaattaaatgtacataaaagctttttgcaaaacataatgtgatttccaaactacagatgttgttactgctactaattatcataaaattgaaatgaaaaattaatatactatgtgaaatgatgagacatattttaggtatacaacattaaaacacacacacacacacaaacacataacaaaataacaaaacctacctctcctttaagttaaatgacctaaagaaatggcttttggaatggcacttaaagggattttaaggagaaaagttgtggataaggatggggagtataaataatcgttagggcactggattcacggctttaactcaaaatctcccttattagcaacaattacagcagcaccgaatgtaattttttgtgtatcagacctctgtgtaagtgttcattgaagaaatgtcacagctaaacagttataaatttatacactcaatcagtggttcccaaattttctataaagaaatatgtctaacaacatgaatgatcttgaaatgattcagtcctggaatcctgagtccatcaatagatgatgttccagttgactcataacatcgaggagaagagaaccattagaagtatggatagggtagtgggaaaagactaatcgggcattcactttcatacacaaagaaataccaccttttaacctacaagtcttaaatatttcaatagcagcacaagaaattgtgacctttttccttttggtgggggtggctggagggtgctgcatttaagtcaagtaggtaacaagtacaagaaaaagttattaatcaaagtcatttaaacaattacttatttagcatctacactaatcaggtactgtgcaggaaagttatcatagtaggtctgacactgctaagaaaggcttggttataaggttgatacctggctggtattttaaaatatggattttaggagggttcccagcatttccagaactcatatgacaagagtggctcactgtgcttaaactgtttgcacaaacaatgtggtttatgctaaaacaccttctctccttttgaaaagtctggaattttgatacatcctggcagaaagtgcctatgcaaccagctcccaataaaaacctgggacatggaactcaaaagagcttccaaagcagasaacatttcacatgtgctgccacaactttttgctggaggaattgtgcacattctgtgtgattccactggaggaagactcttgaaactctgtgtcagggttcctgcagactttgcgccctgtaccttttccctttgccgaatgtgctttgtagcctcttgctgaaataaagcacagctaagaatacaactatctgatgagtcctgtgagtcctcctaatgaatcactgaacctgaaagtagtcctaggcacctataacacaggaattatatcatgttatttatttttatgtttaatcttttcaaaaactttatatgaaatgtattataatctattcataacctttatatgaactgtattataatctatttttatataagaaaactatagcttagcaaagctaaataatcagcgtaaggttatattgctcatataagctagaattcaagattgattccaaaactcatcctctttcttctatgctacatttcctctgtgatcctctggttcaccagttttctaaattgttgagttagtctttttccccccattttaaggtaaatgtttatcttaagatagtatattcatctggggtctgatatagcaaatgtaatatggttaaaagaaattattgtttcttgatgacttcagctcttgtaagtggtttgagtgttagtaaatgaatattcaatatctgctctaggaatagacacagaaagtataaagagattagtctgaacttccatccacataagagtaactccctgaagtttttcatttttcttttttaaaaaaagctatactaatatgatttcctctaaatcaagataattatcagttatttgagcataccagtagaacatgaatagattcttagagtagcagaaagcacttagagaaataaatatcccatttgcatggaacatcaaagtgatgcctaaggagttgactgacgtatccaatgtgacaaaaaaaagattaagccatactttttattattatgttttaaaaactaaatgactaatgttactactgagctagaagagagaacataaaaggtctgttatagcatcacataaaaatcaggacacctgatatttagcaacttcactgtaatgacagcaaaaaattctggaattatgaataattaacaattgcctacttaaaaattcaagtgatgttaacagcaattgcttctaagtggagaaatggatggctagaagatagaggtagaaggcagatttcttttcaatgtgtgtaggtacttatgaaattttgtattacatagcatatattaagtaaaagtaacatacttttaaagaaaaacactttcaaatttataaaccaatgtaaaaactttgttggaaggaaataactctcttaatgttttctggttcagacagacacttaaaaataatgtatcctgtaacacataaaactcaactttctggcagtggaaaattgaacttctgtgcttcagatatagtgttaaaattggaaaataggtaaatgtatgtactcacgcttcagtctgcctgtgttgctgttcctgaagacaagctagatccatcatatgtctaatttgtgctttcaaatctttgttctggaggtgcaaatggtgacaatgaagatctttcttgagttcctagggcaaacaatacaaaatgtacttcagatcactctaagaatattgaaattaaatcagtttaataattttatattgttgccaatagttttaattctttttagatattaaataatatgtttagaaacaatttgaaaaataagagttctggaaaaggtggtctataatttacaagcaagataagttttcatgtttcctcagaaactgaatgttaggaattcagaagaaattttactatgatgacagcttcttggtctatccaacttgttcacaatgttgtaaaaatacataaatatgaccagtttttgcttaaatgtcacttcctcagaaaggctttccttgagcattgtatttggatagacactctccacccctcaatattgtcatagcatttactctattgatgagtaacaatttcattgatgtattcatttatttataatttctctgttcacaccagaacatatagtttaccaccaggacaggcaccgagtcaggttagttcagtgttaaagccccagtgtacaaagtcttgagttgtgtgcaataaaaatttctgtttttgcatgaaacaaaagatcatatggttgatatcacctttggttggatgacatggttagagcactggcctatgagtcatgtgattttagagatgggcttataaggccttgaaacaaatgctaccttaagttgaatatacagcctttatggagatcagtttactggactaaaatttaagagctggatcagatgatctcttcagtcctttccagttagaaaattaaatgatcctaatagtgtgaacatgtttgccaaatattacgtctgttctcctttaaaagaaaaatatcctttatatacatcctctcataatctcctttatcttcttgaatctttcttcttttaaagagacaagacttgagacccactcttgatattagctccatcctaggcaaaagtgtgaaaatgtttttttgcaggctccattttcctaagcctcatctgtctagggccaggtgtcctgtaatctaccacctaaagttacttgtctttccttaaacctactaaaccttatctacagaatatatcagcgaagggattacaccaaagtataaatggtgataatctagtaacattctcagaaattttattggaaaaatttcaaacaatacaatgaaaaaaatttaaattctttggacattttgaatggctaagacaggaaccccatatgcaggggagctatgcctggaaactggaaacttcctcctagggacaattctcataatccatcttagctttagcgagtggaaacaatgcaaagtattcttcagattcttttaaagaatattaagattaaatcaattttaataaaataattttaataaatcaaatttaataaaactcctttccaatctgcagttgaccaataattttctaaaatgtcaaagttatttttctcctttttagaaagtacttccaatgccagttattgagactatgacagagaacaatgtcactcatcctatttatatattaaagttaggagttatttatatatattaaagttaggatatattaaatttaggagttatttatataattcattatacttcaagaaatatagtatatttatatattaaagttaggagttatttatataattcattatacttcaagaaatatagcaaatgttttagaaaaaaatttatctttatggaggcaggacgatacggctagagtcatgtgattttagagacgggcttagccttgaaacaaatgtcaccttaagccaaatatatgccctttatggagatcagtttacttgactaaaatttaagagctggatcagatgatctcttcagttctttctattactagttagaaaattggatgatcataatagtgtgaacatgtttgccacatattgcatcttttttcctttaaaaaaatctctccttatagcattaggagaaatacctaatgtaaatgatgaattgatgggtgcagcaaaccaatatggtacatgtatacctatgtaacaaacctacatgttgtgctcatgtaccctaaaacttaaagtataaagaaaaaacaatccctcctttatatacatcctctgataatcttattcctttatcttcttgagtcattcttttaaagagacaagacttgattgtataattgtattagtaataatgggtctttggctagcctgttaactttggaaaatcaagtttacaatttaagtctttcttgacatactaatgactaaatctgattggaagaacatggcttattttgagaactataagtaggccagtaatggctaaagtatagagtataatgaaaggtgatatacaagccttgagaagtattcaggtgccagaccatgctaggcttggtaaatcacaatggagaatttattctagggagaaggcagtgaagaacaacaagatcagttttgcgttttaaaaactygctttggttgcagtggagagaatgaattgcagtagaacatgaacgaaagcagaaggaccaaacgtagcagtccaataatggggcataggagtctgcattaggatagcagcagaggggcataaagagaagtggatagattcagaatattgaagagtaaataatgcaggagagtacagagaaaacagcaccaatttgaaagtcagaagttctgggtatctgtccagagttgtgtgaccttggataagtccctttatcgtaaagttatgtctcaatttgcttatgtaaaaaataatggcttataactagataattttctcagctattttttcagctataaatatctgcacaaaaaagaattgagggttagatttgggtgatggcaatgaaaatggttttaattttatttgctcaagttatttgtgataaaatgcataaaaatcaaagatacaaaaatcaattccaggttcacattcaggtgtacaaaagttcttcgtaagagaaatctagaagacagattgctagaaaaattagatttgaccatattgaaaaagttttaatttattaaaaatccagacaatattgattaacttcataaacactactaagtagacaaaaaagcaaacacaaaatagcgataataatgatatcagaaacaataccataccatttttaaaattggaagcttacggtaatgtgggatagaaaaggcaaactagtaaatttctacaatcgacttttttgcctgcttaatacttcataagttcttagtacttctgtagttggaatgctgattacatggacaaacatataatacaagcataatgtaaattaagttaggatcttgagaggtgaaaatactctagcaatatcatttaaaacttatatacacaaacatatttaaaatttttaatgaatatacttaatgccactgaactgtatatgtacacatggttaagatggtaaattttattttatattttactacacacaaaaaattgtttcaagactcttcttgagaaaatttttgccaactataaggggtaaataatctatgagaatatcacagccataagtaaacaaacaaattaaggaagcttcagtagttaattttaaatgaggtcaaagtttaatactaaccaaaagacttagttttatgtagtttagaaaatgataatcttgagaatatgactgctttagatatacagtctccaaataaactattaaataataagtgaaataaactgaaaagtactgtcaacattccacacctgctaccaatccaagagaatcaactcttgtgtattaaatgagaaacactcatttggccagggttatccagctgttttctttgaagtgattttatcaacaacataaccatatttcagtattcctacaggcactgtgatagagcctgttgcattctatgatgagcctctatggctttatatggaatttcagaagttatatcctctgatcctagctaacttatattatagtttattaatgaatcttgtctttttttgcttactccttttgagtcattatatcatcttaagatggacacaacgtttaaaaaaaacgtgctatagtttccttctgaagtagatattcttaatcttgtgtcaatggaagggctttaggaaacccaatgacttaggaaatatgcaaaattgtataaatttgacctccccaatctcccagctggaagaaaatctacacagctttgaacagattctcaaaggcatctatgacccccaaaaaggtcagaatcattgttctggaagagaaattatattatattatattatattatattatatgatgcagttaactctgttgttaactatgtacacttttctttgtacaacttgcttggatattgatgtctatgctattgttgcttagaatagtattaaactattatttatcatccattattatttgttaagtgttgctaggttttgaatgtagcactccacttaagctcataatatcttaaatacatttacagatgacaaattaagacatcaatgttaaacacactgtccaaagtcatataattattgttagagttgttattcaaaacaactactatatgccagaattaccaaacactccaactccaaagtctatccttttcccaatgtttacattatttttgtggggaatattttaaagtgccttacaaactaagttatattattgcaaaatattactagaatgtgctgtattctatgtttaatgtcctaatctacttaactaactgactggtatgcttttatcaagatattttgaggtgcagattaaattgttggctcaataaatatccacaataaggaaatactgtctttggtttccttcttaggaaacaggatatctgctgcttgctcctttcactactttgaactgtcatcattaactactactgctagtcttttctctccagtcatgtctgagcttccatattaacagaataatcatttacagccattgctagcccatcagagaatccattccccagtcataatgcattgactagtatctttgaattataaaaaaattagtacttttgaacatttaaagatctctggcatttgttggtaaatatttcatattttccttcacctgtattttctgtctggtgcctttctaggaattcaaagattttagaagtttccatatcaattagctgatacagagttatagaatttcagaagagcatcaccaaagtagagactgtagatattttttcttttagaaaaagactgaaaagaagttgttcttttaaactattaagtatttgggtgaaaattagttatttcatagcagttgctcctagttgcttagcccacatttactttcttcttctttcttattaagagatctccaatcccattactgggtatatactcaaaggattataaattattctactataaagacacatgcacacatatgtttattgcagtgctatttacaatagcaaagacttgaaaccaacccaaatgcccatcaatgataggctggataaagaaaaggtatattgcacatatataccatgcaatactatgcagccataaaaaagaatgagttcacgtcctttgcagggacatggatgaagctggaagccatcattctcagcaaactaacacaggaacagaaaactaaacactgcacgttctcactcacaagtgggagttgaacaatgagaacacatggacacagggaggggaacatcacatgccagaggctgtcaggggtagggggcaagggragggagagcattaggacaaatacctaatgcatgccgggcttaaaacatagatgacgagttgataggtgcagcaaaccaccacagcacatctatacctatgtaacaaacctgcacattctgcatatgtatcccagaacttaaagttaaaaaaaaaaaaaagggagctccaatactgttcagagtaattatgcaaaaaaaaaaaaagacaatcttttcagagtgtcttctatctacagatagccatgtgacatatttctagccaatacattagtctgttaggaatttttggaaacatctttgctctcctgatatagacatccctcctcctttctttcctcttcttctggcttaggtgtgtaaacttgagactagatatgaaacagtaatattacaatcatgaaacgacaagcacgataatgacattttaaaggtactgcattagaaatgaactgcatacttccaagacttatygttaagagaacaaaagacagcccacactagttaaggcactaaagttagactactgcaaccttgtagcagaacataattctaatatgatactgtcattacccatcactacacttcaaaaataaaaccttttgccattctaaggtggaatatcttcagttacacacacacaccccctttcaaatcaactttctttaaccataacacatttaatgttgacctcatttaaactatttttgcataaaatatcaagatttcaaacaaattacctacataatgaatcctcaagtgcaggttgaaatagaattgtttattttaacctaaaagctaccttataaaaggatgcaatcacttagaaataacatttaaaagtaaatkaaatctcagagttatgaggcaataatagttgtcttatgaaagacatttactcaataagaaaaagaacacattttaggagctcagttcctacaaattaaatctgaacatacagagatatttgtacctttggaatatgaccgttttgacttaagagtcccatttctttttcgacacgatggagccaattagtattctcatcaaattgcttcaattcctcctccctccttttctccaggtaggagcgacgagttttcaacattgcaagtctatgatctcgttttccagtggcctgaaacacgattcatttaacagtaaatctaatttttatgatatttgatgtacatgatattagtaaactagtatattttcttatgtgtactattgtagtaaattaagttaggctacatttttgtatttaaagctatttcccccttgaaatctcagaatactactgcttgcaagaaaataggaaattgagctgtgagtcatttttataaaattacaggttgagagtttatggctttaagaaatacaacgaccaaatcaaagactataactttttttttttttggcgttaaagtacagtcccttcagtatgtttcatttgaaaagttcatacaaggtcagatacattccatgatctccttactcaaaatcaaagcagatgcatatattgctcttgtctttgatgtgaagaaataatgtgttctattgttctgtgtttgcctataaggcctcaaattggctgatataaatcacagaaaaaagagcttatatcagagtgcttatcagtatctgatcttgcctgtagcttggttcaggagccataatgagtattcaaaatatttttggtgttttacctaggcacaaattgaaattaaaattagtctttgatttcttaccctaagggtcttgcacactatcatgaaaacaatgggccagaacatcttgacgtctctggggtatttgcccacagacactaaagtcaataattatcagataggatgggtagacctgaaacagtggatccccaaaggttaaaataagcatttgcagctggttctggaagcaggaaatcaaaaaaaagaagagcagaaactagatttgaatttggtcgaagaactccccctctttgggagataaatatctcttaattttgacaaaagatgtactattgagacttgggcatataatagaaaaatatggttatcttcatctggatagaggatatgagcttataaatgatttaaggtcaggcaaaggtggctatcatgaagtcataaccaaatcttagatattcataaaattttacttaccttcccctcaagggaaatacaagagtcagagagaagcagattccatttcaggctagagtcatagataagggaaaaatagttgatagccaccgtcattctcactaaggttcctgactcttttttatggcttctctggttaattataatatcctagtctctgtctgtcacagtaagacagtaacaaaaacaaaacaaatgtctcaaagaaacaaaaacctggatagtcaagaagagaaaacaaaacaaaatgtaacccatcaaactgaccacagcgctaggatgagaattgtgacagaatgctacaatgcaggctgggatggtggctcatgccagtaattctagcactttgggaggctgaggcaggaggactgcttgaggccagaagtgcaagaccatcctggacaacatagagagaccgtgtctccacacaaaaattaaaaaataaatttaggctggtttcgtggcatgtgcctgtagttccagctacttggtggggtggaggggctgatgtgggagcatcacttgagtccgggaggttgaggctgcagtgcagtgagccatgactgcatgattgtgccactgcactctagcctaggcaacaaagtgagaccctgacagcaaaaactaaaaaaagaatgctatcatgcaaaggttacccaagcatggtacagggacccctaaggattcctgagatcctttcagagagttcacaaggttaaaactatcaaaaccatttttataatatcaggaaaatgttattagtcttttaaaattcttgtttgctcatacagttagttgcacagtagttttctagaggctaaatgatgtgtaacatcacaacagaataacaattcagcagttatgagaatagagctgatatgaaaagccaggcattaaagaaatttgcaaacatgtaaaacaacgccactcttctattttcactatttttgagaaaataaaattatttatgtaaccacacataatttttattttaattattatttaacatttaattatttataatttattgctatttattatattttattaatataatttttattatttacaattaagctattatttaatattatttattttaaaatgaatcaatgcataaatatatttttataaatctgttttaatttctaatatagaaatattggtagagggaatacatataaacaaaagctctttgaagtcctaaataatttttaaaagcagaaaggggtcctgaaacttgaagtttagagccactgctataacagaaggtgggaggtgtgacctattgacttttctctgctattcagcagatgtaaaaatttaggcaaacagattttagtgggtcttcagttacttcgtctgaaaaatgaagatgaaaatattgtacctaactgaaggcaggcagctaattaaatcatctttattttgctttagcatttacagtcgtagggactcttagaaaccagggcatgtgggtctggtggcagcaatatttaatatcagaaaatcctaaatgaaacctcaaaaagtccatttatgactttttacttctaatgtccatcaaatgtatcctctgtgatggttctcagaggacattttccatcagaatactaccaccacccattgctctaaaatggcaagtaagtgtttgggaatacattctaaaatatgcatgttaaaccctgacattagagtgaaatgtttcccattaagttttaaaaaagctttacatatttcattaacaaaatcccctgcacaccacaaaagtcttgcgagagaacaaacataattctacaattttagttgttactactgctttgtgtaaaataattgctaatatggtaaattcatatttttacattaaaaacaatcttacagattatttttatggggtcatgaaattacccaggagcttccctttaatagtaatttcaaaatccatactccagaactatttatagctgaatcgatgttatgagattctttcagcacttctgataacaaacctctattggagagaatccaaaacataaaattccttgccttagaaaagcagtttactcatactacagtttgacacttctgtgtaaaaacaaaacgaatcaacctctagatgtcttcctatgtttttcagtgggttaactacacccaataactcaagagtttttatctccactgcttacctagtctcataagaatagctatgataattgggaacctgaggattgaaatgaccaaaagtaagagatcagaaaaggcaattgggttgaaaaaagtctaagctactgtgcagaaaaataaggatgaaaacagaaaaaaaaaaaacaaaaccataaaaccagtcaaacccattctattactctatgtcttaatctttctagataaccacattcaaaattcaatggaggaattaagacagtaaaataacaattatctaaattactttgggattacatagtccaagctcattaattatactaaataataatattcaagtgtttaaaaaatggaactcaaagttttgataatgctactcccttgcttgaaagactgcattttggctacaaaaatagattttagactcctagcaaccaacaatttcacaatctataccaatatcctaccttcccaatctattgttaataattcctaacatggcaaatatgtttaacatcatgtgccaactccagtccattcattgtggttctggctactttcaaattctgagagaaggtatggccacagatcagtgaaatttgctgtgggtaagggagtgggaattggcacgaagttttgagtatagttatgcatttctacacgtattgtccaacaaatgtgacctgctctggtcaaactcagcagagcaagtcacatttgttggacaatatgtatagaaatgcaaggcccagtacaaatctcatctttccaccaggaagccttcttactaaaaataggaagtcactgcttacttttctgaatagctatagcattcacggtacttagaatatagcagagtgattaagagtgcaggctctgaagccagacagctggggtttaatattggttcagccacattaattaggtaagtaactccagacaacctacttgagttctcagtgcctctgttcctcacaaatggtgataatattagatctatctcataggcttgttataaatactaaattaattaatccatgcaaaaaactttgaaaaatgtctggcaaatagcgttcaatatcagctgtttttattattactatttatatgacaagcatatagtgccttatcatttttattatttttattgctccaactagtatgtaaataattgaaggacaaacacttctctttctttacctccattgtgtcaagcacaagggttttacatgtaaacaagtgttcaataagagtttcgttaaagttgagatgttaagtcaatatcagcttcctatggctgcatttcttgccttttgtcaaaaagtaaatcttagataactgcacattcaaataattgacacttatataatctacacaaaactgagaagaattattacccactgaagattactatgtaatataagtgctaataattgaaataaaccaggcatggtggtggacacctgtagtctcagctacttgggagtctgagctacttgggaggtttgtgtgagttgtggagtgagaccttatctccaaaaataaaataaaataaacataaaaaataaagaaaagaagaaaaacatcttaaaaatttgaaataaaatatataattcttatataatatggtactattccagaattctgttcagcaaccatatgaaagaagttcacaacaacaaattgataaattaatccaatgagatagttatttggaagtcattacatttatcaaagaatattggcaacaatttgaagttcatgaaagtgaaagtacaaatatagcagcaagatataaattcgaagaaataaattgtttcctttctgccttaaaagaatgcaaggaacatcttaaatgcatctcaaaacacaaaattgaaaagaaaatttcattaaggcataaaaagcacacactcaataaatatattactaattttgataatatagtttaatagctactgacaaactggtatcaatgatacattactgaatgctttatgattaatttccggtacagcgtatctttcccatttcataggctaacaaaaatctaaaatgttagctttgaaaagcactctttaaaatctgacagcttctggacattaagaaatgcaaaatttttctatataattattacttctgtgaaagtaggaaaagaagaaaacatgtttggggtggtagtttgagaggaatgggttgttacttataagataaagctttttaataagtagtatttgaacatcatatgtctatgtaattaaattacataaaatacataaaaatacaaataaactcatcaccaatgaatatcgaaactggggagaattgtcagtattttcaaaatatttatttttctgatctttggtgctccgtagtttcacacgtttaggtatatatttatcttatactgcttagaactcatgcttcttgaatttacatcttattagtcctagataattctcaaccacaaatttttgcatattgctctttttcactaaatatctccttctgaaatgcctattagatgcatgtatgacttttcttcttgttacatgaagtctatcctttatacaacatcttgtccacatgtgttatctttatcctgcatttggtgtaattttctcaaatctgtctcccagctcatgtaaaaaagcataaacataagagcacaggctctagatctggcatgctacagatcaaatcagaactcagcacctaggagctgtgtcaccttggacaaaatgacttgtattttggtttcctcattgattattaggataatattactaaatatttcatggggttttctgag

SEQ ID NO: 10865 - DNA, 14267 bp, Homo sapiens
  misc_feature (1)...(14267): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcttgacaaatactttgttctctgaattaaactgatgggaactttttgcagttttaaatccctattttaagttaaattttgagtaaatccaaaagtttggtatttcgagttgtcgtggtttcttttgtaacattgctttgtggtaattatctgcatgtgttttggttattctgtgtattcagagctgtctattttaatccatgtatgctttggccatagtaacccatccagattaacacatttataagtcaccatcgatttgtcccatagttgtgataccgttgctttgtattaacaccagagagtcagtgatgatgaagggaagtgtagtcgttagtcaccagggattgctgagcagcaaggatcaagaagctggtcatgcccaaacgcaaccttgagggagagatgttggtgagagataagagatgggtggctgggtacggtgactcacacctgtaaccccagcactctgggaggctgaggcgggtggatcacttgaggtcaggagtttgagactagcctggccaatatggcgaaaccccatctctactaaaaatacaaaaattagccaggcgtggcagggccggcctgtaattccagctcctcaggagactgagacaggaggattgcttaaacctgggaggtggaggttgcagtgaggcgagatggtgccattgcactccagcctgggcgtcagagcgagactccgtctcaaaaaaaaaaaaaaaaaggagagagatggccgggcgcagtggctcacgcttgtaatcccagcactttgggaggccgaggcaggcagatcacaaggtcaggagatcgagaccatcctggctaacacggtgaaaccccgtctctactaaaaatacaaaaattagccgggtgtgatggcgggcgcctgcagtcccagctacttgggaggctgaggcaggagaatggcatgaacccgggaggcagagcttgcagtgagccgagatcgtgccactgcactccagcctgggcgacagagcaagactttgtctcaaaaaaaaaaagagagatgggcagttcacaggggtttttatcgtgcactgctgctcaggctgtagaacttaaggtatagcagattttgtttgtttagatttgtggcttgtgaggcattttgttcttgaaggttttgttctgggccaagttcagctctgtagagctttactacagccctgcactctggccgtctttctgccctctctgcaatgggtaaggagaaggagccttagagattaaggcctgggtcctctcctgacttcagtggggtgatgcccagtgcacaggaagtggtgcagggctaggagtaggcactcctgactttggaggtcatgaagtgagtgacgtagaaaagcctttggtttttgttttgatttctgttttgtttttaaaactaatagttttgggctggggaatcagaatcaacctatggtgaaagtgctggcctatgtaaaatttgatgcgcaccccacccccctttttttttttaaaagaattgggtttagctatgggtcaggtcattttgctaagagttgtgattccactgggtcatcagacttcccatccccctgcaggtaggagtagagctgagctcacaaggaagttattaagtgtcctgctgatgagcaggtgtataagcagcagtcagtggtgacttgcatctcctccctttgctggaaggtgggactaggtgagtttatatgctgagttgaccaagagttaaaatagtaaaaccagggggcttccagcaggaagcaagtagaaaagttgtttgttagcttctaattccacgatgttgcggttctaaacggtggctcctttctggaaattgttaactgttgtgcagattttttctgcatgttatggaatcaccttcacccagcccctgctccctctcctggaacgtacttcattcagcatgtgatgtgttttgcaatgtcacatggtatttcatcctttgcttctctctctggtagactgagctcctcaagcttgaaggctggctgtcccccttcccaccccagcccttgtagaggacccagcacgaaggtcatgataggtaacagttgctgagtggtcattctgtgctagagattgctcgcagtgcttttcctatgtcagtgaatcttcacaccaccgaagaaggaaggaaatactgttcttcccagtctcagatgcagaatccgaggcgtgggagcaattaacctgggtcacaaagcgagtgtatggcagggccagggtttggagccacgccgactggccgcagagccgtggagcgctgtactgcttcagcgaccatttgcagccagcacagtactgatgaagccccactgtggcatgcggccgtccagccttgggatggagctgttcttctaaagctcggtgaaaatcttactaccaagaggcgtgtgaaaatgcttttgaaggcaaatgaaaatggaatgcctttaaaggaagtctgtgtcaaaatgatagaagattagtaacaaggattcaagaatagcatcactttccaaccaattctcaaactatttgaagagtagataccacagagacagtaagtaagtgaaacacctgcacgtcaagcaagtgctgcagcacctttgcctgtgatgtcactttccacatgactgcaacctgcttacctgcagggaagctatgggtcttgctcctttatatattacactaattgctcctatggagaaaccgtggggaggggttgggggaggagggtcttatattgaacctggttttatatagctttatagcttgataacagctggttcctttcttctcagaatttgtagttttaagtgtattggggttttatttgttgattttgctttaatcagtttcttaatccatgatctgttgctttgaattagacattaacctgtttctaaagagatagactaaacaaaactaaaggtttgtttgcttaagtcaagcttgagtctggggagttatgtaagtaacatagatatctggttaatctggtaggatagcctttccaagggagtttacattggtactttgaaagaaacattttaagtcgcagaaaggtaacaaaaattaagttaactgtagcatcagcaccagaaagttactgtttcattgaatgtaagataatgtctggctcggtggctcacgcctgtagtctcagcacttcaggaggccaagacggcaggatcccttgagcccagcaatttgagaccagcctgggcaacatagtgagatcttgtctctaccaaaaaaaaaaaaaaaagaaagaaattcgggacgtttgccaggtatggtagtacacacctgtagtcccagctactcaggaggctgaggtgggggcatcgcttgagccagggaggttgaggctgcaatgagctatgattgcaccactgcactccagcctgggcaatagagtgagaccttgtctcagaaaaaagaaaaaataataataattatatatgtatatatataatctttgaaattaggtgtgtcttttatatataatctcctataatgtcttttatatgtatatataaaatctacatctaatttcagagatactaagatgtggggaaatgtacttagaatcaatgaaatacggtgttggtgaatgcaaaacttgtcagtcatatttattgatttcttctgtgtacagataatgggcatttggtatttattcatttatattttttttttggtcttaatgggacatggtgtctgcttatttgaattatttccggtctgatttctatattccattgtagaattttcatttacttaatatttatatctgtgccattgaagagaaccttcaggaaagcatcctctggggaaggccatcaaacaagcaaacagtctagtaatattttgcagtttgacttatgagagcttcataggaagcctctgcctttaggaagtcagttgtatgccttaagattcacagactcgccgggcgcagtggttcacgcctgtaatcccagcactttgggaggccgaggcgggcggatcacgaggtcaggagatcgagaccatcctggctaacagggtgaaaccccgtctctactaaaaaaaatacaaaaaatcagctgggtgtggtcgcgggcacctgtagtcccagctactggggaggctgaggcaggagaatggcatgaacccaggaggcggagcttgcagtgagcggagatcacgccactgcacctccagcctgggcagcagagcgagactccatatcaaaaaaaaaaaaaaaagattcacagactcatcatgcttagtacagccacatcttaacgctcaggaggctggcctggtcatcgttacatcgtgaagttaagtttacaagatatgtggtggtattgaatcatacctggtgattttccacgttccctgattttaagcagtctgctgttctgatgggaagttccaggttgggtttgtgtctgctgttttcaactctgagggcccctttctgagcttcagctcgcttatctagaagttaaatcagaagctttttgttaagatcaaacaatgtgcagtgctgttgcaacttgaaaagtgcttttcaagtattagatacaactgttaattctcttgtattttaaagtattggggcttggttttagctatatttaaacacaaaaatagcagtttcttgtttttccttacctgcttcatgtccatctacccagatcccttccactgggcctggcctcttaatgtttacgttattattcagtgattattcccatcccttgatctttgctcctgtttctttctttgcctagagtatttattttgcttcctgtccattccctaagccctgctgatccttctaaatccacctccaatcccacttggcgagtccctgctccagctcccctcagcgttcagtgtcgtcttagactccagatttccctttcacactgtgttccatgttgtttagcaattggctgtgtcctgcttgtggttcccttattttatcacatgtattattaggctcgtctctcccactggatgtcagtcagcatatggaatgtcatgatattaccaggtgatggagaggaattgtgcacgtggaatttggtacacatccctttttcaccctcttcaggctttgtgttaacttgggaagttacttactcttttctcatctgttaaacgggtactattacttgtgaccattacagggttgctgtgaagattccagaaaatgtatggaaagctctgacaaacaaacacgttaactggtaactgttcagaggctgttgtcttaagagaccctcttgcataggaaaatagctgactctgtcacttcagggagccagtttaagaaaaatgaagggtaatgcaggggccagctttcagcttggcacatctgaaaagttcacgacagcataccaaagggctgctagtgctggctgttggaaatagaaatgcagttcttgccttcaggaaacgctgtttggacacagacaagcaggtgggtccttgcaccatggctggaccagagcacactgaggcaatgtgaagaagtacccagtacacagacttgggtagggagtggaggggaggacatcagggtataagaagagggaggaagggaaggggaggagaatgttccaggtggagagtgcttggtgtggaggttggacagagcatggtatgttctgagaggtcagtgcttggcatggtcctctggcagaaaagggagtggctgtgatgagcaggaggctggctggggccacaggatgatgaataaaggacttgaatcgtgtgctcaggactctgagtgattgtgagcttttcagatcctaagcggaggagcgacatcagctttgtttttaacaaggtcactctgccctttggagagtggatggtggtgggtaagaatggagataggaagttactgcaataataaagattgggaaaatgggcttactctagtttcggggtggccaagcttttttgtaaagggccaaatggtaagtatcttagactttcaggccatcctgtccctgttgcaacgactgaattcaactctgcctttagcaggaagacagccatagaccctgcagagatggatgggcgtggctctgtgccctgcttccacaggagcatgcctacagaaaacaggcagctggccagatgtcgcccaggttgtggtttgctaaaccctgacctagagttggtttgcaaagtcttttggtgctggaataattttatactcttaatagttatattgaggatccagagagcctttgtttgtgctggttatcgctgttgatgttttctatatttgaaattaaaacagaacaacttacaatatttattttactttaaaagaatctactacatgttaacataacctttttaatgagaaacaacttttcaaaaacaaaaagattaagcaagaagaacagtgttgttttacacttttgcacatccttttaaaatatgaggtttaagaggtgacggctggattctcagacctgcttctgcattccgtgtgttccagttgctttattgaaaygtgtaaggaaaatgtggcgtcacacttccatgtgggcagaagaggggtcatcctggaggctcttagcgatgcaccataactcgccaggtggcagcgtgtttgagtgtgccggcctttcggagtcagtgacgtttctgtactctcttccgtcagaaccctgaggtctgtcttgtgctcagagtgggtcttttgctcatggacatgatttggtaacatcacacgggggttgtttggaaatattgttacatggagttgtttttttttctaaatgttaacacattccattatgtaaacttgaagaaaatcctattttttaatgtcatcactgatctcatcagaagaaaaagtgagaaactgtcaaattagcagtagtagagaaaagttttccaaaattctaattttctcttgaaagcttggattttatcattggtaacaaatactgtcagttactttctgtgaagtgagggacgcagtgtgttcattttcaagtcaatttctgccagataccaaattcttaataaccaaagttggtcagttgttctttcaaataaaaatggcattccatgaaaaaaagggctagttcagcttgtgtgatactgtggaatatgtatttggtcttccctagtacacaactcctaaaatcctcgggctcgtcagtgatgtcttcgtaatgcgttggctaagggccggcaacccctgggtagcttcagaacaggggctggtcaccagaaagacctaggcaggattagaaggttgggactttcagccccgatccccaacctcggggagtggtgaggggtgggggagctgaaggttaagctgatcaccagtggccaaacagtcttgcctatgtatggactgggtttgaagatagcttccagatgtttctggaggggggcccacccagagaggacacgggagctctgtgtctcagcccccgtccctcgccctgtgcatcacctcagtgtcctctgtagtctcctttataataaaccgctaaactaaagtgtttccctgagatctgcgtgctcagtgagggttgtggacactctgattgatagccagtcagtcagaagcrcaagtaacacaacctgaggcttgccgttggctctcgaagtggggggcagtcttgtgggacagagcactcaacctatgggatttgatgctttctcccagcatcaagatttaatggaatcaggaccccagccagtgtccggctgcagaactgactgcttccttgctgctggggagaggtccccacacctctggtgtcctaagtgtgctgtgaggatgtgatgggagaaactgaattttgttttttgtttttcaaccccaacaactgtaccgtgtgctttttcttgagacagttgtacttggggatgcagcaaaagttcttttgtggcacattttatcacagggttggaaytgaataaagtggtgaattattttaactgttcatcagggaataagctaagcaaaactggcctttttcctttttctttcccttttccctgcctgtgcagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccgttgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggccgccacttgccttttttcattaagagtctataattggagatcttacagggaactgggctttctgctcagccatactcgagctcatttgacccccggccactgccccttgagatgtaagtactactgtgttgccttcatcatacacatgagacgatcaagtatcaggaagatgaagttacttggtgaaggtctcagagctaataggtgctatacccattatttgcatgcagacattctgagtccagagcccatacttaagtttttaaccaggctgcctttttatgtggctcattttatcctttttgatggctgcatagtattcccttagttatttagtccactgtttctaatgacagtgcaggagagtctcgtccatccttctgcccttcctgggtggcagacatccaggagtgggtacacggtgtcagaggctgtgcacatttcttgtttctattctttgaattgctttgattacatcttttgtccatttttctgctgaacttaaaaaagtcagtctgtaaaagtggtttttttggtttgtgtgtttgtttttttgagatgaaatctcgctctgtcacccaggctggagtgcagtggcactatctcggctcactgcaacctccgcttcccaggttcaaacggttctcctgcctcagcctcccgaggtgtgattacagggatgccaccatgcccggctaattttttttttttttttttgtatttttagtagagttggggtttcaccatgttggccaggctggtctcgaactcctgagctcaagtgatccgcccacctcggcctcccaaagtgctgggattacagttgtgagccaccgcacccagcttgtaaaagttctttatgcattatgaatattagtctcctgagtttttaaaaattgttgaccttgagttttaattcctctgcccccattccacactctcctctccgagtacagctgaatttattatacatgtgtctttgactagattttttgtattgctgttgctactctggaaatgaagaaaaagggctgagatccatgtttgggtcagtaatggggtggaagaggaataatgtgtgggacaaaaggcgattggtgaattgaactgaaatatcatgtgaggcttaatgatgggggtggatattttctgagcaatgtgtcgttaggcgattttggcatgcgagcatctgagagtacacttaccaagcccaggtggtagggctcactccgttacaggcctccattattgtctcatgggaacgccatggcaggtgtggactgtcaggagtttagagctcagaggcaggggcaaccatgaaaacaggcaatcctggagtagtgacagaagtcttgctaatgatgttagatatctcagagcatgaaagagacttgagcttattttatctggatctccagagatgataaaaccacaactaaaataggaatgcagccgtgtgaagacacaggctgtgctgatctttttctgtatcgtgcacaacacctaccactgcaccggcacacaggaagggcttttatgaattcttgggtgagtcaccatacctgcctgaaaggggcagcaggtttgctgataattagcaacatttgagtgaaaaaaacacagacaataggtctgcatgtttaaccgcatctaatggctggtttgttttaagtgggtggtgagtaaaagagttaacattaatcatcatagaaatggtattaatgagcaaagatatgaccggcctcacacctgtaatcccagcactttgggaggccaaggcaggaggatcccttgagcccaggaggtcaaggctgctgtgagctgtgatcacaccactgcattccagcctgggaacagagtggaccctgtctcaaataagcaaagacattctaattaaagcaataataatgttccatttttcctagtcatttctggaaggagtgtctgtacactcattttttggagggtaatttgacatttctctctcaaacttaacacaagggttaggaccccaaggttccacttgtaggaatcctacaggaaataggccagcatttcagaaagatgtgcactgcagtgatacaacgttgaaaacactaaatgcctaaaagtagtgaggcggttacatgtgttagaacacacactttgtggagtaagagtgttctgggcccctcggagagcagtctgtgacacattgggtgaaaacagcagcttttgcagaagaacggtgaccccaggcgaagctgagtgtggttgtaaatgctgctctggaaagcagatatccaggggtgacatcgggggtgcctgtggggaaagggtggtcacgcctcactgaacagagactttggcttttattctgcacatttctgtattattttatgttccacaccaagaatgcattgtttgtaggtataaggagaaaagtgcccttaagaaaaggtaaagagggagttctagcaactcgaaggaggaaggtttttctctccgtgcacccctaatagtgactcagcactgcttagcaccccaccttctgttgtgctccggttttctggaattttaatggttttaggctgccattttgtcatgtttgaaaataccttaaattttttttttttaatttcaatagttctgttccagaatctagaatggcgaagtagtatccctaaaagagtattcattacaaaagctctagtacataactagatttaaaagaaagcaaaacaaaaactcagctagtaataatgattgaaaaggggggattcgtgccttacgtgtaccagtgcgtttgtaaacgttcctggctttcgtaggcattgaaggctgcgtctcagctttgctcccgtcctttgcagtaacctgtgtacgggaggctccgttgtttgccacctcacattgggataggttgcttttagaataaataattatgtattatttgcataaaataaataaacacccacatactccacacttaacaacggtccatcttgttttgggtttttgaagagatgaaggctacggtcatgttgaggctgtccatctccgttttaactccccaactccgttgcccgcactccttcctcactggaggcactgtctgtgaaattggttcatagcctgtccctgctcttgagtgtttatccaaatagatccatgggttgccttttatcagacagaggccgatggggaattgcagctctgccgtggccgcgcttctccagctccctgcaactttgtcagaccctagagatctgttcagtgtcacaggtcacatttcttagatgttgacttcgtttatggtaacagatagatgttgttaaaggcatctgaaatattagataatcgttgaagtagtattaaccaaaattattaatctcctctgccatagagccccggttaagttcaggtgtgtaatagtgatcttaaaatggagagaatgagaaagtttttactttaaccattctcaatttgcttactgttcattaaagaattcagtagtaaaaggcgtaatctatttggattatgaaggtatcagcatacggctttctgtgtacgccctaaagtactgatcacagtcaaatatgtcgtaggtaaaatagtaaccatagaaatccattaaatgtctgctgctgggttatttaaaaagtagatggaacctttctctggccacgcgccctgataacctccgtgttccccgcaggacaggctgtggtggaggcgcacacacagcacccagaggcgggctctgtggagttcgcatctgtatgtcagcaacttagggtggtttgggccatgtttcacttgacctacagagagaaatgtgacacccaggttggcatagattgggatttttttttttttttttgaggtctaggaattttttttaattgtggtaaaatatacatggcataatatttatcattttagccgttcataagtgtacagttgcgtggtggtaaatgcacttacagtgttgtgtagctatcaccactacctgttcccaaaacaacttcctcattaccaacacaactttgtcctattaaacaataactccccttctccccttccccggcccctggcgaccaccattctactttctgtctctgaatttgcccagtctagggacctcaggcgggtggaatgacacagcgtttgtagggacctcaggcgggtggaatgacacagtgtttgtagggacctcaggcaggtggaatgacatagtgtttgtagggacctcaggcaggcggaatgacacagtgtagggacctcaggcgggtggaatgacacagtgtagggacctcacgcaggtggaatgacacagtgtttgtagggacctcagtcgggtggaatgacagtgtttgtagggacctcaggcgggtggaatgacagtgtttgtagggacctcacgtgggtggaatgacacagtgtagggacctcaggcgggtggaatgacacagtgtagggacctcatgtgggtggaatgacagtgtagggacctcaggcgggtggaatgacacagtgtagggacctcacgtgggtggaatgacacagtatagggacctcaggcgggtggaatgacacagtgtagggacctcacgtgggtggaatgacacagtgtagggacctcaggcgggtggaatgacacagtgtttgtagggacctcacacgggtggaatgacacagtgtttgcagggacctcacgtgggtggaatgacacagtgtagggacctcaggcgggtggaatgacacagtgtttgtagggacctcacacgggtggaatgacacagtgtttgcagggacctcacgtgggtggaatgacacagtgtagggacctcaggcgggtgggatgacacagtgtttgtagggacctcaggcgggtggagtgacacagtgtttgtagggacctcaggcgggtggaatgtcagtgtttgtagggacctcaggcggatggaatgacacagtgtagggacctcacgtgggtggaatggcacagcgtttgtagggacctcaggcaggtggaatgacacagtgtttgtagggacctcaggcaggtggaatgacacagtgtttgtagggacctcaggcgggtggaatgacacggtgtagggatctcacgtgggtggaatgacacagtgtgtgtagggac

SEQ ID NO: 10866 - DNA, 33159 bp, Homo sapiens
  misc_feature (1)...(33159): n = A,T,C or G, or insertion/deletion polymorphism (see Tables 1-2)
agataatgcttataccaagcatgcatcatcattgctaggtgtcttagaactaactgcttcaggcgccacattgctcttagctgcttcttccaaatccctcaataaaaggaatccaggcataaccatcaacaaaaagaactcaactccaaatctgctcatctgtcttatccccaagtctccctttcctccaggcccctagtactgtcactgagctcaggtaacaattgtccggatcatgtctggagcttcaccagcacaaagctttctttcctatgtgaagccagagtagaatgctgccatctgccagctgccccacgctctcggctgtggggtagctgcagagcggtgtaggggaaaaaacatgaactctgaaattatcatatcagctgtgccaccctgaacaaattacaatcctcaatggctctgaatctcagtttgcccacttgtaaactgatgtcagcaatacctaccctgcaagattgacctgggaattaaatgaaactctgcaggtaaagcaccggacctacactcggggctcagtgaagaggagctatttttatagactttcactcacttggctgagtaattcagttccagaaacaaaacggacagtttgagaaagcagtgatttaaaatgaatcccaagccagaggtccttttggcactttacctgaagtgaattggattctgtttggattaaggaaaaacagacttgttctctaagaatttagcagtcaattcagacagatgccaaatccatgaaaaactctctgattttgtcacgcaaaccccagagcggaagtcagacccaggcagattcaggttttcaggtgacctgaagcaaatcgtttcactggccagtctagatctcagtggttccaagcccagctaccattcgcattacctggagatcttttctagactatgggtaccaagccccactccaaaccagtttcatcaggatttctgcagggtgcagactgaggatcaagaattttaagagcccctggggtgatcctaatgtaagctccactggaccagaagtgctccaagatcctcgccaggtatccctggtgcctacaaccatgtatgattcagagtagatatttagtatatgtttattgagtaaatgaatgaagattctgactcaactttttgctgttttcatgttcataatttatgaggtaaaagaagaaaagaaaaggagtttaatcccaagaaagaatcacagagcagagctgtccaatagaaatttctgcaatgggccaggcgcagtggctcacgcctgtaatcccagcactttgggaggttgaggggggtgaatcacgaggtcaggagttcaagaccagcctggccaatatggtaaaatcctgtctgtactaaaaattacaaaaaattagctgggcacagtggcaagcgcctgtaatcccagctactggggaggctgaggcaggagaattgcttgaactcaagcggcaggggttgcagtgagccgagattgcatcactgcaccacagcctaggcgacagggtgagactccatctcaaaaaaaaaaaaaaagaaaagaaaaagaaaagaaatttctgcagtgatggacatgttctataatctgtactattcattacagtatctatgagccataatggctactgagtacttgaaatatggctagcgtgattggagaaactgaacttttaattctatttaatgttaattaaattcaaatttaaatagacacatatgacttctggctaccatactgaacttctggctaccattgcagaaatttcttttcttttttttttttgagatggagtctcaccctatcacctaggctgtggtgcagtgatgcaatctcggctcactgcaacccctgccacttgagttcaagcaattctcctgcctcagcctccccagtagctgggattacaggtgcttgccactgcgcccagctatttttttgtagtttttagtacagacaggattttgccatattggccaggctggtcttgaactcctgacctcgtgattcacccccctcagcctcccaaagtgctgggattacaggcatgagccactgcgcctggcccattgcagaaatttctattggacagttctgctctgtgattctttcttgggattaaactccttttcttttcttcttttacctcataaattatgaacatgaaaacagcaaaaagttgagtcagaacatctaccttttataaacacatctatacctgtgtgcctccatgcccctcttttactaacagcaccccatttacctttagggcagtccttctcccccaaccacctgtagtcttggctaatgaaattgccccatcctcctctagccaaggatccaagctaagtcaacagactcttctctctggaaatttcactctagcttctgtgtcacaagaatagaaaatgtgtcagagcagattaatatgagtgttgatgccctaagacaacatgcgttcatttgcagaccattagtccagagtgtgacgataacaaatgtgacacatgatatgagttaggcgtcattatcgtcatccttgtcatcatgaaagtgacttgtacccagcagctcagatgtgcctgctcctgtactaggtatgtaatttgcctagcttctcttatgcatcctttcttcatctgtaaaatggaaatcatactcatcctaactcttccacggtttttgtgaagacagcaaaaggaataattgtcatgagggccgggcgcggtggctcacgcctgtaagcccagcaatttgggaggccgaagcagacggatcacttgaggtcaggagttggagaccagcctggccaacatggtgaaaccccatctctactaaaaatacaaaaattagacagacatggtggcaggcacctataattccagctactcaggaaactgaggcagagaatcacttgaacctgggaggcagaggctgcagtgagcagagatcgagccactgcactccagcctgggtgacagaccgagactctgtctcaggggaaaaaaaaaaaaaagaaaaaaaagaaaaataacggtcacgaaagctttgagccaaataaggagttacccaagtgtctgttggaggagttgttcccaaggcataggtgtggggagtcatgggagggcttgatgaaggacccaggatctgagaccaattcacaagttgtgccataccaggttaagtcacttgttctctctgggcttttggcttagataagactgggttatacacatctctttccagtttcaccattttctaatctatttgcaagcccccttgcctgacacataccctcttccacttctatgcacacatgccagaaaattctctagcctagtccatgctgaccttgtacccaactcatttcttcttttcccagctcctcacctgattgggaagttgctctgggtatgcactcccacagcttcctgaataaccctctggcagagcaccttatggaaatcatgcttaactatctcctccactagtaggccataagtccaactagagcaaaggccatgtccctcttgttcactactgcttctccagtgcccagtacagagtcaaacacatagaagatgttctatgagtacttactctttgaatgaataccctacatctattttatttgtcatttcagaaaacacatggtattatctcatgctgcgtaacaagttagtccaaaacttagcagcttaaaacgagaatagtcacttatcctctctcaatttctgtgggacagaaagtcagacagggcacagcagggctggttgttctctgctccatgtctgggacctcaactctaagacttaaaggccgagggctggcaagacctgaagtctcggtttgccatgatctggtgattgactctggctgttggctgagagcccagcagcagctgtcagcgagaacaccctcatgtggcctcaccatgtggcttgggcttcttcacaacatggtagctggtttcttctgaggaaccaagaagaagctgtctcctttttatggcctggtcttaagagtcatacagcttcactttcatcacactttattcattagacaccagtcaccaagtacatcccacattcagggggaaaggaattagatcccatcttttgaaaagaatggtcaagagcttgcaagccaattttaaaaccagcaccacttggctaacacaagaagcaatgtatagagtgaaaaacaagtgtctgaagaagtaagacttctgttcacattctagctctgccacttactagctgtgtgagtttggggaaattaccctctgagacttggtttatacaatacagggtgatagttgttgatccctagtgatttttctacgcttggagtcttcttgccttagtgagtttaagaagatccaggctgaactaactttcttggagtcttgcaatccttcccatcactgataacccttggtttctgaccctggaggtagtaagaggttgctacgggagcacagggtacccagaaagttcagatactagggacagctttagagaacagatgtgaaaccactgaggccctggggtctctctaaggcctttaacccagcccttgtgtagtaacctcagcttgtcaagaaatgcaacgaccccacaactaaggaatctgaatctgccggctaaggccaaggaatctgcattctcccacaagactgtgattcatgctaactacaggcaggggagagggggagcatcttaaagcacacactcggccgtctcttcctaaagttcttggcttcagcctagagatagtgcctttcccaccatttacaactctatggcatgagggaggcggagggtgcgtccagtgtccaaccacgcaccacagctggttgtactttcaccttcctctaggccagcggaccctccccaagcattgcctcccacgcccacgtcgcggtcccaccctggtccgcggggtccagagcgtccaaagcccggtctaggcagatggtctaggggtgagctctgcgcaccccattcccaccagtgcaggcaatcgaataaaacagggtgacttttaacccttttcgtttccagagatagtgaccccccgtctcaatccctagatgtcctcctctaagaactgtgcgcgctgggagggactctgcgctcactcactgtgaccacctcggctgggatatggggaaactgaggcctacagagggaagggaactgctgaacgtcccaaagcaacacaggcactgaatccggtctagaatcccagtcttccaggccagtgctctcggtcctaccggctcagggcccctgcgaagaatctttttcaagaaattcccgaccgcaggaattccttctgcgctaggaatctccatggagtttgcgctccctctggcacgttgaaaacgtcctccgcagcttcgcaccggcttcgcggcgccctgacagctgggtgaggagggagcgaatgcccaccggcgtccttggggtaacttgggacagaggcaccgccgcggggggcggaggactgggcgcgaaggcgctggccctttaagggggggacggagcgcatgcgcggcgcgggccgtagtcgagcctggtgggcggctggctggcaggggacgtggtcggcggcagcggggcccaggggcggcggggctgcagcagcggcggccccagcttcgccgagcagcgatcggctggtgggcttctcgttggcgggctccgcgttggcgggctgctccccaggcaccagcgcagcgcgcgctcgcccggcttcgtcactcgcctccagctacatccgccggccgaggctgcgcgagcctccgggcttgcggtccccgccccgcggtccttcctccaccctcagccagggcagctgcagcccgagcgaacagccacggagcatcctccgcccgcccgggccgcgccaccgcccatgctgcagccagtcccaggcagcgaccccgcggccgcagcccgccgctcagtgacctcagcctggcccctgcgcgccgcccgagccggtcccgctgagccgcgggccccgtgccctgcgatggctcggctggtgcagcgcggcgccaggtgccagccgtcctcccgctgagacgcgcccgagtggggacccgctgggcctcggggctcgcagccttcgcctccccgccgcgcccgctccctttmtggggactccgccgctgtttctggggacgaggggacaggggacccagacaaagcccactttgtgcagggagttggccgcaggcggggaatgtgcgcgtcggcgcgcgccccctccccgctcccggccagctgcgagtcttggctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctgtctggcctcagtttccctccgacttttctccgctctgccagccctcactgctgcccgtcattgttctcgcagttagatgggggtgctttgtgacggctgccaagttggggtgtgttctctttattccgtttttcaaacagaacaaggcctccaaggctgaccccagacaacccaccccctcggaccctaattcaccttattgcactgattttttttatcaagtcgtattttattgtacaggagccacgccctgatttcttaaaggcgccttgcactctggccatgtgttatctctgcagccggtgtgtgggaggcctcttgtgagccagttgttttcccgcctccaccacccccctcgaagatttagggatgccaggggggaagaaggtggctgggggtggcagcagcggtgccactccaacgtccgctgcggccaccgccccctctggggtcaggcgtttggagaccagcgaaggaacctcagcccagagagatgaggagccagaagaggaaggggaagaggacctgcgagacggaggcgtccccttctttgtcaaccggggtgggctacctgtggatgaggccacctgggaaaggatgtggaaacacgtggccaagatccaccccgatggagagaaggtggcgcaacggatccgtggggccacagacctgcccaaggtgagacacacgggtmaggggggtgatagcacagtctaggttttagtgaccttggggccaagagtyaagccacactctcctcccacggggcaggggaccactggctcggtaagatctttaaaatgcagtgatatcatacctgtctaggagaactttctctcactgccattctaggagggaggrtcacatacattgtctccaggaggccctccccgctgtcttttaaaatgtccacgttttacaggaggggacagcagcagatggaactaacaaacacagtaggatggcttgacgtctcatttgcttgatgacacttgccaagccagagaactgtgagcagacaaatgtaatgaatgactaaggagatgcagggcttcatatgttgagaaaatattttcgtgcattatgtcattgaattctcccaacagccttgtgacgtaagtacagtttggattcccattttacagatgagaaagctgaaaactcaagtaggaactcaagatcccacagccagtaagtggcagaactgagattcaatttcaggtcttcaggagaagggcggggggtggtggtggagggaagtgtccaggtcctcttctctgttggacagtagattcaagcacattagaagaggtcttatggagaagcataaaatgaaataatttttctgtgttggctgtaactcctcctccatgacagctatacttcagttgtgtcaccaacgaaaacagaggctgtatctcattcatctttgtcttcccaaggcctcctgtgtgcctggcacagaacaggcactagtgtgtgtgtttgctgaatgaaagggtatttgagagtttctgtgctgtacgctgctatatggaaatacatgccagatattaaaaaaaaaaaaaacatgatcaagactaggaggcactttgccaaatgcagaggcctgaaatctccaaaaaagagccctttggactgagttcagagcccagtgcttagccctgcctgcccaggttggaaggaagggggctaggaagaatggaagttagtgtgaattagacatgaggacaagtggcccgttttgtttttaccaagttattggtacagccatcagaaagtgtcttctgggaaaaagagaatcaaaggttgaaggtttaaatactgcctaatgtttccaggggaaacaaaatgtagattgatttggaatggccgcataaatgtgctctgcactgacttaatatttatttagctaatcccctagagttggatgttgtttccagttttattcctaaaatgaatactatggtgaacattctaaaatataaattttggggttcatctctgattatttccttgggaaaaattctgaaagcgaaagtattgcgtcaaaggatattgacattggtaggggtcacctgcttatctatatggcctcttccacctatttgagatgcagttttcttatcaataagatgaggttgattgtggggaagaaatgagagactgtgtgttaaagtatttaacaaactgtaaagccccaaaccagtacctggttattggatatcagttacctttttttttttttttttgagatggagtctcactctttccaccaggctggagtgcagtggcatgatcttggctcactgcagcctccacctccctggttcaagtgattctcctgcctcagcctcctgagtatctgggattgtaggcacctaccaccacacctggctaatttttgtatttttggtagagatggggtttcattttcaacattttggccaggctggtctcaaactccagacctcaggtaatccacccacctcagcctcccaaagtgctgggattacaggcgtgaaccaccacgcccggccagacatccatcacctttacttatrtgctttatcaagcggcaagactgggttttgctcagatcatttgtcccgatgaggccagagtcacaccctgctcccacgtgaacaagtcgggcagctctccagccatcttgcttatgtctaaatcaggccataaaagagtgtgaatggytccctgcagaactgccaccactcctgggaactaaaaaagaaatagtgagctcactagtaactggtctgtaatgtcattctgtcatcttcagtcctcatgtacaggaaagacacggatgaaggaagtctaggggtgggggctgtgttgtgacagacccctagacttccatcgctagggtagaaggaattttgtgagaggtttggaaaaatttgaacntccccctcttcaaaccacagatctcagataaatcgcatgagtctgyatgaggtccctcctctacctgggctctgagtagaaaggtacccttagagtctgggagtgcagtggagtccaggaggccttggagagaagcagcgtgggttgggtgcctgggtgccagggtgccagtggcagggtgggctgaccccgcccttaccatccctaggggccatgccactggagctggcacagggtcattccctacagcggccacacagtgtggggctcaagaagtgttttgttgggaaaattgggagatttctcacataaagatccagagttttggcatcttttcagaaaataagaagacttgggaacacatgggaatctgcagtcccacgtggcagctgtcagctggggctggggagtgagtcctactcccccatcttgccactgtctccaccactcacctaccaggcctgcctgccccgtgtatgttacttgcccggcccctgcatgtggttgagtctgggacccctgcaggctggtgtcataaaaggagagcactctggagtcaaagctaccatgttcaaatccttgatctcccataactacttatatgaggaagacaggcaactttcttgtgcctcagttttccgcagctgtgaaatggagctaatagcaatgcccatcaagaggatgttagaggaattaatgatgcaaagcatgtgatgcttcattaagtgcctctaatagatacccagtaatggagcagggagtgagtgttcatcgacaccccactagcgctttggagaagcagcctttacagggatgatgccagtatgttatagggcaacaatttctagaaagatcccaaatccagcaacagcttaggctccttgataagagtctgtccttgatgtttcaggcttccaccccctttaaaagcttagtggccactgaccccagacccagctgctgaaggtcttttatggtctcttatggctcaggccacagagctcctgcagaatgggaatttggacatctcctctagctacttattatgactccagagtgctttcctttgatttatttatgagacagcgtctcgcttggtcacctaagatggaatgcagtggcacagtcatggctcacagcagcctctaccttctgggctcaagtgatcctcccacctcagcctccagagtagctggggctaccggtgtgccctaccatgcctggctaatttttttattttttggttgagatggggtctctctatattgcccaggctggtctcaaactcctgggctcaagccatcctcccgcctcagcctcccaaagtgctgggattacaggcaggagctactacacccagcctggacatctcctctaaaagggtaacgttgctgggattagcatgtgcgaggcacactgataatgatgacagtgaacacaaattaagtctgtgctgtgtgcctgaccctgctctaaggcctcgacctgcagcatctcattcgcactataaggctgattttgtgttggtgcccactttataaatgaagtgtctgaggcacaggggaggtcaggagcttcactaaagtcacgactaggccgggtgcggtgtaatcccagcactttgggaggtcgaagcaggtggatcacttgaggtcaggagttcgagaccagtctggccaatgtggtgaaaccccatctctactaaaaatacaaaaattagctggatgtggtggtgcatgcctgtgatcctagctactctggaggctgaggcaggagaatcacttgaacccaggagatgaggttttcagtgagccgaagttgagccactgcactccagcctgggcgacagggtgaaactctgtctcwataaataaataaataaataaataaataaataaataaataaataaataaaaagtcacgactgtaaatggcagagctgaatatccatagtgatgatctagttggagactcagccctattgccctctaggccacactttttgggcgcacacatccakctgcaagctctccccacctcccccaggcctcattgtgttcgattgaaatagacccctccagtgagaatgtctctgtagaactcaggactaggggttcctggagccgggggaatccttggccttggctgtggaggaggagtgctccctggggagatctggtggctataccactcccccttaccgtgccccacttaaacccaccactcaacagtgaggaaatatttcccgactcctgtttcggaggtgggggtgaggggcaagacctaaaatgggcctggtcatttgcatatatagaatctttcttatttgtgtttgagtgaacgagtctatgtaggtaatgaacattcagacaaaaaggtgcaggtgctgtctgcagtggggtgacatgagtcaaggagctagcctcggtgatggtggccttaaggtcttgcctctgaatccccaggtattttcttgaccttccttctcccagagcagccagctcctaggtcctttgtctgcacagcaggtgctagtgctttcgtgggtactgcctggtcccrgcccaggcctggctctgggtgaatgatccagtcctgggactgcagctccctttttgcagcttcttgtgggagggtgtactacaatctttatcccaagctcctcaaggtcactggatccccacttgtgcatggggataatctgcatgcttccctgcctggcaggggctgccacctgcagagatcaggtgactgggtggatgtgccatgctatttaaattgctaagtaattcctctaattccccttccacctccccacccctgtatccttgacatggggaggccaggccaggccctggggcccatttggtacagagtggccagacaggaagaggggggagccccccaccccgggttttatcttgctggtgactgtaagtggtggtgccagtttggggagggggagcaatgtgaaagggaaatggctccctccagacagagacgtcagcggctcaggagccagggcagccagtgcggttgctagggactctccagacaggaaggagaagaccgacgggagggagggtgaggaagtgcaggcgacgctgtggccctggaccagggccccttccctcctgcgtctccaccccttagaggaggtgtctgtcagacactgtcccgtgtgcctgtgccatcagcaacaccccagacatgagtgtgcagtgataactggagtgtcacttccctccttgtcagagccccagccactgcggtcacattatttaaaaagctgggctggcatctccaccactcgagagcctccccaggaaaggaggaaaagagcttcatccttccctccttacccagccctacccccttcccttcacacgtgcccctgagcacagactgtgactctcagcagtcccatcgggtgggtaggctcagtgtggccttggagggccgggtggaggcttaggggcagggggtgggacctctctatgtggggagccttacagctactgtgctggtggacaagggggagccctgaggggtgggccttttccctggaagtctggttcttctacccaaggaagtctgttctgaaacctcggaggaccctagctgatgtatctcttggcctccttggcctcactgacttgttggcagccaaactgccagatccgggctcccctggctggagagggtcccatactggcataatggtctcttttctggagactggaggctgagggaagcctgggggtcagctgttcttgaccttacccccagcagcctccaggctcccaggcatcgggaaacactgcctgttctctcctctgccatttctgggctgggtgctggaaagtgcgttctggggaggaagactgtctgggtacctggaaacctgtactgactaggtgtggagctggcaggaaagagaagacttggaggaggacccggcccctctgtgcatgccccagccacagagctacagcaagacctgttccaaaatatgtccttctggcctgctaccgctgactgactccttgacagttcaagttggtgctctggaaggcatggcgaatatgcccatgatactgggtgggtcccctaccaaggatgctcacccccctcaggaccactcccaaagcctagggcaccacctgagaagatgggaccccggatataccagctttgatccggcgcttgaaccagagcaaacttcaaacctaaaataaccccaatattatattcttaagtcttgaaactaatgaatatttaaaatttaaaatagtcagtgaattaacctatgtttttctgaagttattaaagaagcataaaattggaacatcagcatacactctgaatgaggaatgctgttaagtcccaggagggaaggaatggctgggctggggccctggcaagagtcttcgaatgagtggggtgccaagaaaggaagctcaagtgggagggaggggaggctgtgcctccccagggtggggcgcctctggggccagtcctaggtgtttggtggactggaagctccaaggtgagcctcttcttgtgaccggagctctttctctgtccccagatccccataccgagtgtgcctacgttccagccgtctacacctgtccctgagcgcctggaagctgtgcagcgctanatcagagagctgcagtatcctctctggtcaagggtcatggccaccttctggccggtgtggtgggccttgtttccaggcagagctggagaggtatcagcagagccgcctcattccacaacgccagggccaccattcacgtgacatctctgtgctccctggtgctgtgggackcggcgcgtgtgcctcctgggtgtcggaggaattttgtctgatgagtgcagggcccactctgcactctctgccacccccttcccgctcctgccgtgtgatggggtaaagagaggaaaatgggtcctgagtgacttgctggtggggtggccaagtctagatagatctcmtgctctgttgtccacccagccctagcagagggggagagagggagctgccttggggcttttaaaagtctgattttgaataaagggaaaaatggcagagaaaaaggattttctgctccaggaggtaacttcaggatcctagaattttctccagttcttctcctttttttccctggcagtaggatggttggccagcaggggaagagctgggctcccctgggnccagattcctctgtgtccctgctctgggccctctagcccctgcaccctgcccctgcaccctgccccagagctgtgtgtcctgggtcctctctcccaggcttctggctgcagaggtcagagatgggagagctaggcatgggtcctgggtsgggagaagccaggctgatgactgcatatcgggtccagctcctccttctgccagtggggaaacrggtccagtgaggcaggtggctggctcaggagcaattaaaggctgagttggaccccctaccctagcctcctctcagttcctgtggcttctcagctggttggaagatgaagtgctgtarggcgctgttcccagccacagcctctttctggccctcgccgaactggtcgcctgctccatgtctcttgtcctaagaagagaagccaggggagaacaagggakaaagccaaggagggtgagggagagggaaagagaaggaggcgtgaggcggggagaagaattcatgctgtgcccccatctcccytccaggagacttggctcttgagcttcaggataggcaggaagagagggtcaacctccttcaggccaagctaggaagcccttaacccgtgcccacaggtacaatcacacagggacacagttctttgaaattaagaagagcagacctctgacagggtaagtatggggaggccagtcctctgccccagggctggcttggagcttcttgaaagccctatagtgcaccttggagaggaagtttatggggcagtcagggactcttctgaaggaagccagcctttgggggcaggtgccaccctggggccttatggatgtcataaagagaaaaatccggctgagatgaacagccagggctgccttgatgaaaaggaaatcccgggtccatgctgagctagagggtgggagagccgcccccagctcttgccttggccaggagagagggtggtcctaggtggattgtaggtgagcctcagatcttttgttttttagtgagaggtggaccttgcaggagagagccctcccttctctgttctgcggctgccgcactccccattgctgattcccattgcagggtacttgcatggtcaccccatttgccttactccgtggactcttttctgggcattgagtagcaggctcagggtctgagcacagggagctccctggagagaatgttgcatctctcacttcccatcccgccaccccgtgtgtagccccctgcctggattcacttcccctggaaagtttctgcccatgaagccccragggcagaggagagtgaagagtgaatgccacagctgggtctaggggctctgcccaaagatgcccacagacttaagacccctgggctttaaaaattcatgtgaattggccaggcacggtggctcacacctgtaatcccagcactttgggaggccgaggtgggcggatcatgaggtcaggagtttgagaccagcctggccaacatggtgaaaccccatctctactaaaaatacaaaaattagctgggcgtggtggtgggtgcctgtaatcccagctacttgggaggctgaggcaggagaatcgtttgaacctgagaggcggtggttacagtgagccgagatcacgccaccgcactccagcctgggtgacagggcgagactctgtctcaaaagaaaagaaaaagaaaaagaaaaaaaatttcatatgaagtttacatcttgccccacacataatctatgtttgcttctttgtgaaaatgcatttaaatggcttattagcaaaattacttaattacaccctctccgaggccctggatggagtccaccctccctatccccaaagctttgcttttgttggcctgtggctgctgtgtgctggggaaccactccagccttacttggcatggaggagtctgggtgccctcctgggcaaagccagtgaccaggctgaattcccaggctggggacagagggaggaaccacgcctcagggaaaggctgtcttaaaatggcctgaattccaagttcaggagcagatctgtagtcagcaggtaactatctgcctaagatcccacatccaggctcaggcagctgcggggaggcagttgcagtcaattaacaagctcctgggagaagccatggttgggtcagtggtgtctactgtgcttcagaagggaagagatcgatgctgacgtccctcctcccccgactgcctcgcagaaggccccagcctggtggctggagagaagttgcccccagcttctgctgccctcccccagagctctttggagcaagagccaggcgtgggaggtggaagtgaaagaagggaagagcagggagagtgggcctccttcctatcagcagtggccgcctctttcccaccccctcaggctccagacttccgtccgtcgggagtgtggagggaggtgctgggcctgagctgagagcagcttagggggcagcctctgtccttctagcatttctagtccaccctgccccctccttctcacattcccctggaggggctggaggcgctgtccttactgacctgcctccctttcccacagrctgatggacctggccaaggaaatgaccaaagaggccctgccaatcaaatgcctggaagccgtgatcctgggaatgtatccttcctcncctgaaggggaggggtccgggcttctctgggcctcagcttcctgctctgaaagtgagggtggggtaggttgaatgggctccagggctctcccatatgcagtcatctgcttggccccaagatggagaagcaccccactaaagtggaagaaccccccaaaatggaggagccccgaggtcccagtaccccacatctcagttgctaccttcccaggcttactgggcagctcttttttgagtcacgtggatacagggaccgttttctgaaccccaaatcagggcacagtgtctcacaaagacagttgtaccatttccaagaactagacagtctgggaggcacagttggaatgcccagatgttggcatttccagaacatgttgatttctggacgagatattaaagcaaaactgccttaaaaaaaaaaaaaccacaaacaaggttttccagtcacacccccgcctccaacccaaagggcagaagtggggcctgtagctgagtcaccagggtagccttggagacagaccagccaccaggagaggctgtcctccccagccccacagtcaacagcgggagaggaggaagtgtttatggctggttctccatcctaactggtcaatgcctgagccctaccttttcttctcagtcattttattattaaaaatgtcataaatacacgtgaaacctagaacaacatcatgaactcctgtgcacccgttactcagcttcaccaactcaaagccaattctgtttcatctcttccaccctgcccgtattctttaccagcttttaaacattttgcctgcgcccctggggtaggcagcccactgggctcagtgctgcagaggagcacagattaggtgggagccaagagggtgacggggagggggtctgatggaacaggagtcccatctgagggcaggtcctgggaggactgtgatccaggggtccatccccaccccccacacagacatgcctgcctgaagttcacacaaagaggctgcgggtgcccttctctttccgcagaggtctcggagggaacgccactatggcaggcatttgctaacagggcaggcccatttctggagcccgacatccctgccctgtttatggggttctttgctgggataagcctgaggccacccgagaaattcaggctgcaggcagtgcctccttcatgtcttcacgttcacttctccctcaggggtcacacaccaaagtggaggctcccaccctcataggagagagactggtccttttccccaggaggacacacagaagtcactccaggcagggtcctatggtctcaaagcttttcaggggtcacctggtggcttgtgggcaggaataaaataggaacagcccccatctgggtgaggggctccttctcagtgtccccacagctccctcaggcacagcacacgccgtggttctcacgtcttgtcctcgccgcactctgagcctctgcagggccgggctgtgcatttctcatcgctgtatccttggtcacttacaaggagtcaggctcagtaagcattggtggaatgagagtagtgctggagggaccgtggcataatgtctcaacacagactttggggtcaggttgacctggacttgaatcgtggctgggctgctgactcactgtgtgacccccaaggaagttccttaacatctctgagcctgggagtcctcctctgcaaagggggatagtggcagtgtgtagagttgttaggacaatgggccgagccggtgccgtgagacgcagcacagtgctggacatggtgtctgctacacgcttctatccattcatgtccttctacccatttgttcgagaactttcactgagtaactgttgtgtgcccggcttgatgctgggccctgaagaacatgacagacaagggccctgtgcttgggaggtttgcattctagtggaggagacaaaataagcaagtaaggaaaaagaagcagtaaacactggtcatggtgagagtgccgtggaggaggtggacggtggcgcaggctcagcttcagtcctgagcagcagccaactttggcaggcaggggaaaaggccggtgtgaganactcaggtgggaggccccgggggctggagaggtgagcaggtggggcagaggtgtaggaagtgggagtgggcctggggctggctgggggcacctcccaggcctcagtagtacacgtgattgtatttgaagggccacaggcagggttgcatgtggatatggggagaggacagggtgagggtaagagaagagtgaagccgcgtctgtggcctgtgtgtgtgccaaggtgcgggatggaggncgagggagtgaggcaggggagggaaggcttctcttccgtccttgggccactgggctctggaaagccctgcagtgtggcaccagccctgctggacttyagagcggtggccacaaatccctggaagccccgtgcctattcgaggttccctttattgagctccagctggataccaggctcaatgctagatggcaggaataccaggaggagacgccaggcgtatggagatgagcaggactggtgtctgcaccccaaggctggcggtgcgtggaccccgtggctcccggtcccagtccctcccggtgtgctggccccgtgcttctcctggctctttccttagcggggcactggccagttacctcaccaacagcatgcccaccctggagcgcttccccatcagcttcaagacctacttctcagggaactacttccgccacatcgtgctgggggtgaacttcgcgggccgctacggtgcgctgggcatgagtcggcgcgaggacctgatgtacaagccgcccgccttccgcacgctcagcgagctcgtgctggacttcgaggccgcctacggccgctgctggcacgtgctcaagaaggtgaagctgggccagagcgtgtcacacgacccgcacagcgtggagcagatcgagtggaagcactcggtgctggacgtggagcgcctgggccgcgatgacttccgcaaggagctggagcgccacgcccgcgacatgcggctcaaggtctgcccgccttccacgccctcgccccctccctcgccccctcccccgccccagcagaggcgatgtgaggattgagaggactggggagcttctcaggggactggggtgctgggaccttgcttagtggtcgatattgttcargtggtcccctggggtgggcagaccaggacggctgcggagggaggaggtgggtgggctgggtttggatggtggtaggtgttgggcacatggcaaggtcactggtggagaatcacggcctgtctggagggtgtgatcgggtgctgtgatgggcagcctccccactcctcctgtaacatatcctgactctgccccccaaccctagcaaccattaaaggactaggaggtggtcagaagaaagggaagtcagaccatgtggaagacaatgagggcagtgttccttcttcctcttcccacccacacttgagcaggaggtgatagggagttgggctgggggctgttgtaccaaaaacagctgggctgagctgttgagccctagagcctttcagcaggcagaattctgacatctgcctgggttctcctggggctgccagggccccctgctgggtatctccatagctcagtcactgctgcactgtgactgcccctccaggcagcctggagcctccgcctcaaccaccgacctctgcactcccaagtgcactgcttctcttgacagccctgggaggccagcgggcggtaggtggtagctccattttcagggttggaagcccagagtcttgctcactggcagtgagaggcagatcagactggagctcagcctcctgatggggtgatggggaacccaggtgtgttgcaggtgcctgcaggtgtcctggcaggggtttgtaagagctacggctgccctagccattgccagccctaggccaagatctcctggggtgacagtgccttcccctagggcagaggcaggctgcagccaaccctgcgttagagaggggctgctctcttctgcccctgagctgccgctccccacctagctctgggtcccccagcaccctggctcttgctsctcagtttgctattgtgtctttaaggcatcagattggatctagggtgagagccaacagttccctagtgtttagagctgtgatggattcccagcctattcagtgctaaacactcacctgtgttacttgcccctctccagcactcctgcgttttgaaaactcaagtcaagctgacggtgscatataaaggatgactcttttgtttttctcatttttttcttaagcagagctaaagctaccagtctgacttctcaatggctggagatacccagcatcacccttggggtgagtgggatctcagccccaagttcagtgtgggctgctcccacaactggcacgtttacctggcctttgttggggactttttgcratattatggtatctcagtgacttcccccacttccactctgccttcaggagcccacagggattggacagccccatggaggaactcctgctctggcagctttagtgcctgggaaataggttgggaaagatccagacagggaagagccatgcttgaggttccccgggccttccccagggcagcctccagggacctgtggctcctggaaggagaggttgggctccagggcagtcctggagtgatgctgttgcttcctcctctgcacctagattggcaaagggacgggccctccctctcccaccaaggaccggaagaaggatgtttcttccccgcagcgggcccagtccagcccccaccgcaggaacagccgcagtgaaagacggtgagagagggaccacgcctgggtgggtccaaagagggtttttttcctttcctctcatcgtgtgggtccctttttttttttatctctctcccacccttctctctttttcgctcccacccaagggaggtgacttgggatggtgggtttagaggtttgtgtattgacatttcccacagcaaggcagttctacttccccagagaaaccaaactctgctagcccactagtctgagcatgggttatgtgagagaaaaggtagaaaggatggggcccctgcaaggcagtragccacccaggaatgtcatgggggagggcgtgaatattagatggctttgaacataactttgccccccacccaagagtctggtttttgtctgtatccaggtagcaagaacaagccattgaaataccagctctcctcctctgatttcagctcctacacatcactctgactcttgctttaaatataattgtcattcaggagccacctctctggtatgaattcaggggtggggtactaagcaggcctctggcaccaaaatatccatcatctgtgacttttatctaagaggcttttgtagatgacagattcccctcagacagatttatactttaagctgttacctaccaactgcagccagattagccagcctccagcagcgagaaagcctgtgagagcgagccggggccacattcagacagcacaggcgggccagggtgtccaaaaacacacttccatacgcactgtgctgtgcgttggagggccacttggagaatgtggcggggaagccaccaggcagccgctgctggctccccaactccatctccctaacagaccactcactctcctcccgctctgctctcttcctcccayaggccctcgggtgacaagaagacttccgagcccaaagccatgccagaccttaacgggtaccagatccgggtctgaggcggatgccagcaccccaggccccacccactcttgggggccaggatccacctgctggaaccagccttatgcatggggaaggcggggctggtgacaaggcagggcaagaggctgcaggaagagtgtgttccagctcagccccccaagctgctctcgctcccactgagccaagccccctaactttgggcctagaggccgttagtattttatttggagtttttaactctacaactgaagtttaaggtatttggggaaaacttagtccaaatggatctgctgatggtgggaaggccagtgcttaacaaatccatgtgtcatggggccaggtgagggaaactgctggttctgctggtgcctctgcccctggcttctctctgggagttgggtgcatcttatcagtgggaaatctcccagccttaccaggcctgtgatggggggtgggggtggggtggagatgtttctccagttctgcctgccctggcagaatcttgacccagggaaagggaagcagggtaggagtccttctgagaaaggtctgtgtagcccattaaccaggagcttggcacaggccacatctgccccaagagcatgagctcgtggctcaggagagccttcaggcccttgaggcccccatgggcagtgctgtgtgggcagaggargggtgatatgagagcgagcccagggaaggacctctgggcaaaaagttcccaggccctaactgcgtctacttgctcagtcccagctctgcctgttgctctagcccacaggctccctgcggagggtctgggcttggcggaggacccagaatggcactgaggccagcatggctgtgggagttgagcaaaccctgggtgccagtccaggagctgtggctggacatggggtgatggggcgggatgcttgggcctgggtctctccgccagcagtgccaggagcccttgctggggaaatcaagaccagactaggatgcttctgccccaggcctgccttccattctttaacagcccatcttggcttggggttgcaatgatggctgggccagtcacttgtggcagggcatcagggccctggcagggaagaacctaggcacctggggttgtccccagcctgcccgtcagcatgagatacccagtgggaaagtgagaggatgcggagaggttggcagagccaggggtaggttctggaggctcaagcaacaaggaggtgcaggtaaagggtgcagtgcagccactgagggacagctgggaactgggggatgcaagtgagaaagggatgtgggggagagttcaggatcaggctgcttgaggagtaatgggttacctacagcagagacgagatggctgtttgtcaggaggcggtagaaaggtagaaaggattcagattgtggaagggtaaayggatgagatgaccattaaggttttgttttactgagaggctgtaagtctgccagggacagctgtcagtaaggctgcagaagggctggggggctacacaaggaagagcagaactagggttgtaagctcaaatgacgagcaaacggtgagaaggaggcctgaagggctgtgtggggactatggctacctgaagagggcacaccctgttaaaggggccacagctgctcagctgttcttacagtgccggccctgtgttgccagattgtctgctttgtcagaggccagaattctgactttttatgtgaaataggatttttaaatgctggtgatcacttaaaaaaaacttaaaaacccaatactggcaaaagaggatgccagtttgcaatccctgaagtagagagagctcgtgctggggagaagtccaccaagatgctttgaggcgggctgtagcaaagtcctgtttctcagagctgggctgggctggggtaggatccttgcagctgaggaggaggaaaagccactgagtctcctcccagagcgggacaaaccagaggccctttgcagttgctgggtcaccagcgggggtggcgcatggagtacagacagtgtagctcttggcctgccagggagacggatggtgcctttgaagcaaagaggaagggaaggcagaaccagggatgcctttgctgatgagagtgcctgtcagggaaggcgccacaggctggcagctcttcaaaccagcagcgcttgacccagagccagatccagcatggcctggccagaggcaccctgggaggccagctggtcagtcccttgcctccccaagttccccctggggtcaatgagccctgggaggatgcctaacctaactccagccagactaataggggcatggtgacccttgactcaccatcccatcccagctttcagggagtgggggtagtgtggtctccatgttcctactatgcctaagaagagatggctcaccttgggaggtgccaggctgaaactaggtcctttccgggtctggatgctgccgctcaggagcaggggcgtggcctcagctgcctctgggagcttcccgggaatgacagggtttgaggggagtagatatgagagggagccgctcctggttctggagtcttaggaggttccaacttgcaggatcctttcccagagccctccatggagaaaacagcaaaatgaagcccttacctgcttgctgtctgcaagggagggagccgagccccagctgataatcccccagcactcacccttcctgagctgagacttcggggctgtggagaccagcacaggacatagtggtgctttttaaatttatttttaactgtttctcatatgtagcaacccctcctcccctcctgggcatgtttacacaggctctgctctgggggctggcctggctgtgaggtttctggggaggcagagaggcagggactttggggccttagtcaccatccatggtatcacctcatctcacttcctgtgagggacagggcctggctgatgtgatcccagctccccccagttcaggactgtctttcagctcctttgcccctggaggtgggggctgctggctgaggaggggtcaaggtgagttcaagaaagctacctgtggaaaatggaccaggttgggggggtgattgcaaagtctccccaaagcctggctcctcatgctcagtgccaggggcagaacactggggagccaggtatagagagccttcctgtcataactgccagtcctcttcctccaaggcctctgcatattctcatgttcccctcacccatcatgccagccacccctatccctcttctagcagggccaagatggggacagcagcagccctctggccttgggatgtgatgataaagcaagcctagggccagggtttggggagcagagagagccaagaagttgaccacgtgtgatttccagcccttcccactgggacttgacttcccaggtcaaggagtccgtctcattctggctggtcgagtgaccagaggcctgtgtgaatgtgtgcacctgcttttcctgcctggaatgttttctggctcagctgcagcaacatctgtgagcccagtgtctgccctgtgtccctgggctcgctccaagtgcaggaacatacatgcagggcccaacatgatgatggtgtgaagggcaggaaacagtcctctgaaggagtggggaggtgggcagtctgcccccgccaggtaccatcgcctcctgccagcttccttagaccaggcagggctgccatggtgctagctgcaagtccatcagtattgaccgtctcgctccatcttggtcctccggagtcccaagtttccttttcatcaaatctgacaagagagaagaaacatgggtgtgcttggcccacagggcctggtggtgatggacctccccgctccctcaagctctggatggctgcagtgttgtactagactttgttcaggctgttctcatctcagtattgccccttcctttcactttcacacttcatctcattcctgttgtcactttccccgaaacgaataaagtctccccagctcctgctgtgtaggctgggcagaaaccacaacacgtaagccttgtctcctttcctttggagctggggcccgagccctcccccagcccagcggcattagccccattggctctgggaagagcctgacctgaggtgagcctgaagccagggaacaggaaacctcccagcgcctgcagtcatgatgaaacttctggggttccagacttcctcagcctgctgaagcccctcaggccttgttaaccctgatctgtgagcagtgctttccccctcttcacacagtgggcctggcctccagaggctcaagttagcacccaggatgtattccaggaccctgctcttccagtctcagtccacagcagtccatcaggagcaaaggagaaatggggcatgttctcctgggagatgagtgtagctcaggaaaccgtagcaaccttctcatcacttgacatccagaacccatggggtggaaaacacttcgggtcccatccgtcaccccccactcttcctctctgttgtccctccagctctggacctcttcccacactttcagacaagcccaaacagttgaaaccagacttgcacagaaaatatcttttggatttcacagcatatttcacccataacccttcctgcccttgtctcagctctcctttcattcagcttaagggtaaaacccagacctgtgagagaggaaacagtgtatttcttacttttcatcccagccagtccccacaagatcgtggctagaagtgtagcttcgcaccgccaagaccccctcattttcagtggtgtggtagtgaccaggggaggaggaggcatggcagcaggaaaaggagaggtgacccgcaggaatccatagacatctgggactgtacaccagtaaacggaggcagttttgttacaggctcctttaaatccagctaaagcattacccaaaaaaagcacttcaaagtaaccagaatttatgaataccttgcattgcacaccctttcatagacgcagtgttgtaattttcatatttaagtccagctgatatgataccaagtaaagggcctcaggcttcaacaagacaggttcatacacagtggggcccctggcctgctcttgtacaaatgaggggctgggtaagtaagtgctggggtgagaatctacgtaatgagtcaggtaggctctttgtggacactggccattttcttagaaagcagaaggaaatgtcattgcagactcctggaggatcagaacccgacctgcttgggggtggaaggggttacctcatttcctgctgtcccattcctcaggctcacagcacgcacctgcctaatttaggcacctgactaactgggttagacctttgggtgcaggtggcccttctcagaggcctgacgatgaaggggttgaagctctgctgccccatttaccaggagctggcatttggaccactaccgtggaggtagtgacaggaagcagtcataccaagaaccaagcagaatggcccagaagcaggctgcctgtaacccttagtgtctgccagcaaggtgaggggaccagctgttgaggcctggcagaagatgaggagaggccacgtcaggtcagctggcaggtcacctctctgagccccgtccaaatgacaatgtgcacacagatatacaaactttttccaaccctgagcctgaaaggacttggttgttggaagcacaaaacctccaagaattttaagtgtaggctctgttctctccacagcgagctgaggcttcaggccttagggtcataggagctgactggggatgggacagaagtgcagagttccctccacaacccatgaagtccacattctcttgcttccagcagatctgcaccctcaccaccatgctgccatctggctggcccatacctggaacagtcttgtctagcacatttgctcaggagggagaggagaggggatggaccagagtgatgggagcccagggctgcagggcagctccccctggtggaccctagaggtggcccctcccactcctgggagaagagaagccacactgtgcatttcgcagccaatcaaaacacaaccctccaatagagggcggaatggggttaccagaagctgggaaaagcaggggaggagaatgaagagcaggtggatggtacaaaaatatggtgaggactaagttctagtatttgatagtacagtagggagactatagttaacaatttattgtatatttcaaaatagctagaagaattggaatgttcccagcacaaggaaaagataaatgcttgaggtgataaatgtccttaaatatcctgactggtcattacactttgtacgcatgtatcaaaataccatatgcagccccaaaatatgtacaactatcacatgtcaattttaaaaaggaaaaacaaaacaaccagaacattcctctagttagtagctacaacagggcaggaactggagagaaaaacaaaacaaaaaaagcagcagcctcctgactggccatttcccttcttggtctccagttaaaagctgcctctgagctcccccagccccaggcccccaccaccagcctctgccttccaagataacctgtcttgcctgatcctggaaaggcttgtgagaaacttggggtggtaagaaataaaccaaaggagattctcaaattctatctctgggatttctgtttcctcaggtgtaaaggtagaatctgaacaccacctaaactgccaccacacagtgccactgtctttgctagctgacgtggaagtactgtgcaaacttaacagaagtgctgtggagatgctaactgactgaggcaactaggaggaaccctccctgccaggaagaggttcttggggatatacctcaaagcttagggctttcaaatacttcctagccaatgggcccaactgtccagcctggctggggtaacgatctactcccaactcctaccaataattctctggaattcttagcacctttttcttgccaaagcccaaacaaagcaatttcagatctgaaaattcttcacaagtagaagtgattattaactttaatttctatttcaccaaggaatgtgaactgaaatacagagaggttaagtaacttacctacagtcaccagctgaacaggccaagaggacaaatgatgtttctaattcctagctgagttttctttcttttcttttcttttctttttttttttttgagatggagtttcactcttgttgtccaggctggagtgcaatggcatgatctcggctcaccacaacctccgcttcccaggttcaagcaattctcctgcctcagcctccaagtagctgggattacaggcatgcgccatcacgcccggctaattttgtatttttagtagagacgggatttcttcatgttggtcaggctggtctggaactctcgacctcaggtgatccacccgcctcagcctcccaaagtgctgggattacaggtgtgagccaccgcacccggccgctaagttttctttttactaaatcaattgaggggatcgcaacccaggtagtgcaatggaagcaaccaagtggctttaaatcaatcagattctcagagactgattcagaggcctggtgtgggttctgggaacctgttcaggtaagacagaaaaccagatgtggtttcagggctcccagtgggcatgtgggcttggctggtcttactacatagggaggttggaagacaaaagcaccaacagaggtaggcctaggaaggaagagacatttttccagcgacagatggcccactgctcagccctggctccagaatgcaaaagagatcagaaatagatgctcagcaagaggcatgtgccacccgcatcatgtctcatgcagctgccatagctttaatcaggaaaacacacatcttatcccactttgcacagaccctcctgaagtgcagaagatactaggaggaggcatggggggagcagatggaggaagaatgaaaagcagtccaaagaatcattctctcacttgggaaggacagaagaaagctgtaccccagcagtgtcaaggcaggaggcttcactcaagccctgttcctcccaggcctcacagcagtgggaatttacctcagctaatagagggagatcttacaacacatttctcaatctagattcatgtcttgagaccccaccccaagatcaaaagctccttagtctcttcctctgcccacctcattcttcaggccctctctcaaggacctaatcccttcaggatcctaataaaatgaacaacattggggggaaaaaaggtaaacctttatttggaaaaagagtttaaataacaatttaaaaccccatttcactttcaaaacagaaacaagaaagcaaggaaaagataatctatcaagcatctgccctctgctgtggttagccattttaaagctgcatttcccagcagaagagaacagtgatgggccctagtcctaggaacccacagggcactgtcttgagacccttttaggcagtgtccagggaacagacagacagaatgaatggtggggtgtagacagacctggggctcagacaggcacatgcccagtacccaggaaacaaagtttgaaaatatatacacatagaaaaataaattccctagaacctaggcatggaaagcttctaaccatgaatgcagcagcacaatgcaaactgggtctttggctttcaaaaaaaggaaagaaccttaacccctggcttactgtcccgaactcaagtctcttgaccactgtcttcagtcccactttggaggtcgagtgaggcaagagcaagtcaaatctaccagggccagcagccactctgacttagggagatgtgtggaggggctggcccaggatctcccaaggccacaccccagcaatgaaagattaaggcatgcaggtgacacagtgtggactaaggagtcccctgaataagccagggtacccttctgttaggggagggaaagcagacgcaacaagcagctgaggccttgctggacagagccaatccgcaagtactgccacttcaaattcttggaccagttttgtccaaggccacctttctgctgaggcagtttggcctgagctaaataccagggttttctagaaaggaaatggaagggaagcgggagatgggagatagcagaaagtaaaaagtggtggaaggagaggaacagaaaattgcttcttaggagtggagaggaaagagaatcagcttaggtcttcagtcccagctgaggcagctgaagagtctacctgctccttcccctactggaactcctacccttgccccagttctgcaggctgcagagtccagtgaaacaagagtttcctgaagactctttctcctcctaatccttaaatagttttaaacctcataccactaccctagcccaatgaaccccacataagggttcaaacttccgcctccctcagggaagcctggggaaagggatggcccttgtgaaattacaccaggtctgtggggagctctgggttggaggcacagggcccgctgggacaggtagcgcatcccccaaaatttgccactccaggatgtgggccccatttgttcccagagcccagacgccgggcctgccctggttggcaggatgaatgcctaatgaaacacagaggctaaaaggagagatggggccatgccctgctgctgcctgctcatacataggtacttgggtagactctgaacctgccccaggcctacagccccaacatgaaaagtggactggtcagaggcaggcatggctgtgcagaagtctcaccccaagaggacacatacatgatatgcatatctcacatatgcatgcctggcaagagggctgggcccagaagtcctgaaggcagggaaaaggtcaggtcagaaggtacatcaagaaacggcctgaaagcaaataaccaatgaaatcaagaactcccataaccctggtaattaaaaatcaagggggagcgctggatacatggaaggaagggggagccccccttctgcctctcccagggccactgagtgtgtggcacaggattagg

SEQ ID NO: 10867 - DNA, 23875 bp, Homo sapiens
aatagaatgagtagcatatccctgaatttttaaatatttaggcaaaagatgctcaccttttatttaaatgccttgccaaagctaccaaactgcaaaactgatggctttactttgaagtgtctttctgtgattttgcaagccacggtagctctaccatagctaagttgcttcagcttgtatttcaacaatggtggttctaaggagctcattcaaaactcttttttgtactgccttctgcctttttgccagtacacatgagtgacagcctctatctagtgcctgagtatatgaacctttaatccatcaaggaacttctaacaccatcagaatatacacacccacgtgcatacaccttcctgcagccaccaggtttgaaaccagcagaatatatttttctaatctcacccagattttatggctataatgtggctactgacaagattctaaaattagcttttatttaaataaaccatgtaatttttttttagttttttttttttttttttttagtttttaaaactctctgccacggcaatctactgctgtagacatggttagaaatattttttaaatggactagacggtcagttaaatacaagaaaatatttcactatattatattttcttattccctaaagtccatctccatggagtgtgctgcgggtgatggatgagactgttgtctatctgaatggaaacctgctttcataggaagggtggaggtgggagaggaccagtgaagggcagagctctaaaattctggcaactagagtgaatataccctttcctcctttcatccttcttcctttgctccctccctccctcgcttcctttttgctacgtctctttttggtagatcactgtagttaaccttcgttctggccaagaccaagaagggttaatggacacccggctcctgacaccttccaggtcagcttggcttgcgaacttccaacgcaggaattggaggattaccggggaaggaatgcgaggtacccgatagcctcacacctgaacacggtcgcttcaatccactgggattcatttaaaaaaaaaaaaaaaagaaattctcttctggaaaatggttaattggatctgcagctacatttcctgttgcaccgaagagccaagcagggcagcctggattggatccctcaagctgccaagaaaatcgagcaattggggggtggtggtggggggggggtgaacctttctaaataaataaacaaacgtaggtagctatcagttgctttagggagcgcagatatttaggaaaaggccaggagcgggaaaaggaagaagaaacgaaaaagattctccccttttcttaccttttgcccctcctttcccctcccgaaatttgcgcctacttgattatttgcagctgtttcgaacctcaaggtttgttcacagtagcgagagagacttgcgcttggagaagtgaaaagccattttcgcgccagggcttcgctgcttgagtttgggggttttgctctccctcccagcaaactcccctcaaagccttgctaacttcgtcaagccctgccagcctttactccttggccacttgggttcgcagtacccagccaagggccccgggcgggtttccatcgctgggggtggcctggtacccccaaagctgagttcccgcctaggagaggacgctgacgtcctggggcttcctcggtgcctgtcacccagccccctgccttcctcctcggcctcagatgtcgtcccacctgcccacgagcagggaacctggaacccactctcccggcagtccccagcgggttccgccacccggcggccgcccctgacaccgagtgggtgggaggaagaggcagctggcggggatgggccattgagacctcttgaaaaatattaaaagacaggatgggtagagatttctccgggagaaagttcgagggtgcatcgggtcgcggctgggaggagtacccgaaatgccagcaggagaaatgcaacctgtttaggccacaccttcaatccccgaggctgtctggagagactgcgtgcgggggacttgccggcgttcccacaccgcgcctgcaatccactcccgcggctgcctggcctctgccactcgcggcttgaagccagtggctctcaagccctcggccccgcggcggcccgcgcagccttcacccggcgccggcaccacgaagcctggccgcagtggactccccgcagctcgctgcgccctggcgtctcccgtcgaggagggagggacggaggcctgagccgggagctccctggcggtggtcgggccgccccccttgaggcctgctcccccctctcggcctcgccaaatccctgaaagcccagtcccccttcgtcaccccgggggcttctaatcactcggtatcgatttccctaactcttttcatcctgttgaagacacatcttaaaacactccagcccggagtgtgctctgggctttatccacactaataaaatgatttacccttctctccgcgctctcctcacagaggaaaatcgttcgagccccggctatttgtgtgtgatcagtaaatatttagtgcgctgacatccttagctgggcttcggatcgattcggggcccaccgggaggtgcgcacggtccgggcggggctgcgccgagctcgccgagggggctcctcccgccctcgccgccggccgctgatttacggcccctgcaaccagctaaggggggcgaaagcgcgcctggaaaattggcttttcaaccttttacttttgacattcagccacttccccaggctctaattctcgcccgcactcctccctcccgccctactaagggttgccctgtgcgccctgcgagcccttccagcagcaacgcgcggcgctcgcgccccctcggcccggggaccacctatcacagccctgagccgcgacgcggggaggccccggcccctgctatgggggtcgcctccttcgaggagagatgctctccgcccgcccacacctctgagggaggagagggggtggagaagcccagagctgcatctgctggacgacgagccgctctccctgctaccctttctccgacccgtcggcctttctcctactctggagactgatcctcgacgtccatcgggccggatggcgtcgggtggaagcgttactttcctcgcagaaaaactcctcctctttcctaagatcagaaaaagcgcttagcttggaattgttaggtggaggcctcctgccctgatagtggctgtgagagggctgcggccgtgacaccgtctgtgtcccctggccctcctggccttccccgggcgcagacgatttcattattgcagggccgcaccgtggacctggagtagggcactgcggggtcccgctgcgtcctacgggagcgctacctcggtctgctacgttgcccgagtaagatgtgaggaatcccgaccctcggactccactactcttgggccggggcttcgggcctgaaagtctccggcaatgtcgcccacctgttagcgagcttgttcccctctcacctggggcccgggcctttgcaattcccctggggcccaagaaggaaggggcatgaccttgctgggtctaggcacctctccaaaatgctagcgccctctcctttgtcctacacatgattttctaaacaaccttatctgcagactatatctttatactaatgcatacttaattggtccgtcttgactgtccatataaaacaatttaattagggtgctttcttgctttggagagcaaagaaaaaaaaaaaaaaaaccctgcccagtgcttattgtatttagcaccaatacaggcagaaaatgtagcacaagtttttggttgaaagagcacctctgtgcccattgaagggcgttgatccgaaaagacagaaaggacaagtaaaatcgatttgaagcgaccctctctgtccctttcacaccattcagaaactccattccttctaagacaaagaccagcgccttgggaattctcagggaaaaagaggactctagtcccacaagcctagggcactttttaaaaaaaaaatcctcaatatttcacttaaaacccacacttgatgctgtgccccccaagtatgggttccacagatgccccctccaaagtgccaagctgcaaggctgacaaaccccctttcccctgcctgtttggccttgtagccaggccaggacagccgtttagggttagtgcagccctcacctttgacctcctagatccgagtggctgccagcactacaactttggccaaagttaaaagaaaaccacaacaaaaaattttttctgctcccaaacccagggaaaccagttctggttcagccgcctgagccaccttacccaatagcaacctccatccctaacttttttttcttcttcttttgcaatgaactgcctgagccatctctgaaggagggaattgaagttgtcagggctccacggctgggttgtgggtgggggtgagtttcttggtctaactggtcctccattaggaacccccgaatgccaggttatcccactggtgcccgagctggggaaggcagtcatctatcagaactggcaggaaagggagaagggagaggaatgagatgggcagggaggggagagaaaaggccaggctgtgatcatcttcacctgccctgagtccagccttcctgttcaactattcctcgaccttcggctggggatgaagggggcgggggcgaaagggagggggcacccccgagttacacaagtggcctccttctactaagagaatgagttcacctcctccccagaggagcctcaccatccatccactcagtataactgatgagacaaaccgcaaggaaaaacttctgtagcccatatttatggtattaatgaatagttaaaaaagatttacacttcttatgatcaatattctgagttattttgctcaaagtatataattacagtgtcttcagagttttcatcattgtttgaggtggcaaaaccatttgtaattttcattagccagtaaacatgtaattaacattcagcactgtgtttaacttaattcctgtttaagacaaggacaagaagcagccgaagagcgttagttccatttgtcaagtctgacatacatcttaccataacagtttcctaaaataaaagatccgtgtttccccattattcttctcttaaaacaaaacaaaacaaaaatccattagttaagacagtattaaactgtgagaggcagcatagtttatattcaattttcactagttaccgtattcttgcttcctttattcgttttggggagtagagaaagggagggggtgaatgaagcattcattatctgaaggcatggaatggggaacccctccccccaaaagaaatagatttcctcctcaggaaagttctagaataaggaccggaaaggggggaggcagaaatccacaggggagagggggaaaaatcacttggggagacttgagttaaaagtagaaaatgaggattccaaaggattcctaggaaaaatgttgccctcttgtctcaagttctatctttgatccaggacgagggaagcctgtctgccagtctgcgaggctgatgctttttccccctcctcttccacctctgttttttcccaacttgctttaggattagcctccatctctctcgaccccaaacagtggaatttggctgtgccttgggtcgtcttgctttgcaatatcgcctatagttgttggcggttttctgctgaggctgagccgtttgctccagcctccgactaaactcattaagttgggagatttttttcaattggacgggtgtttttaaagtctcgtctttccagccccaaacaaggtgtaacaacgcactcttccttctaaggaatgagatgagagacaaggatcactccagacatctcctacctacggtttggggttttttttcttaaaggcgaggcttgcattcctcagcagctatgtacaaagctccctgaaaccttgtctctctaaagttagtgtgcagggttttccaaggctgagagagcctaatacatggggaagcacttccttgaggtggaagatctctcccttcacctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttggtatgtttacttacagtattttttctctctctctttcctttctcacttttctgcttgtgctgtgtggggttggggatgacttggggcttttcaaaatatcggtttgctaacgtgtatgaaatgccgaggactgtggtttaaggggttcggggaaggggggatcagagtcaattcaatgcattgccatattttattacatgtgtgtggtaggagagatggtggagggggaggggggaaaatacaattgcaaagctgccaaaatatgattaaaccgaagcgttaagactgcggagcctcctatctcctcgtcctgtctcctcaaactcatttccttccacagagcaaactaaaaaccagtcctataaagcgtggttttgcaagcagcagatgactcggttttctagcaaaggagctgctaggctcgcactaagtatcagaatttactgttcgctttgcctctgcgcttcattttgcaaccttgtgcaactgacagccaggcaggcagggagggagaaaakcctagcccggcgccctcggccacggttcgggtaggcgagcgctcggttaagctaggaggagaatcgcgacgagaagggtactcaccatcgggcggggcggtggagctggcgtgcggatttcaggcaaacgtttacctttttgctgtctattgcaaccgcgccgggctgacttaagaagcaattctgtgctctgtccagaacattcaaggagcggttcctcatttttaaaaagccagcgagagagacgacagagacagagagaaagaaaaagagaggagggggtgagggggacgcacataaacccagttcaaaaaaaaaaaaaaatcacctcttcgccagtgactcgggaaacgcagaggtggcgagatccgagtacggtccaaccaagccagagccaattaattttaaatcctgaagaattattcagattaaaatgtacagaagtttcgttctcctatgcctacgtgagtccaaagtcgtttccctttaagagctccttttcttttaaagttgaattttaggcagcgaggactcttacactagggggcagacagatactgtacttgctctaatcttaagcaattttttccctcccagcatatgctctgatttagcactgtaaatttttcagaggacctaactctgacagcccctggtgattttcaaagtaccacaagccagtggttaaaaattgcattgacttggaagttcagagggrcacaatggaagcccctttccctattcatggagctccagtgtggtggaagagaaaaacacacacggactagattgagggaaaggaggaattcaatgaatcctggaggacggaactggtttctactgagttcagagttaaactcggcatttgctggggtctgtattcatattgtgattcaatctgtaaagaaatacagcccatcaggccactttctgcaagaaaattatattcctgggtgttgagtttctttcttttcttttttagattagggcaaatgttgtcccaactttctctaggcaaattaaagcttgccattcttctcattaaaataaatttacatctgcaaaaaaagactgagttggatttttaaaaaacaacaataatatattgattttatcttctcagagctttttaaccttagacgcacagcaagtgagcatctctggagaagacatttaaaaatatttttgyccttttttcttctcagtctgtagtcttgtctcttcttctatgcattaaaattaagtataattcatacggtgattttttttctcccttgtaacagcatttcataactgaatgagtcctaaaatacagagtgaaacacccctgactttatggcagccctgtgatcatttgcctagcaggctccaatttgttaagatatggttgggaaattattccattttaatctaaggccatcacgcatacttcaaattccaaaaatctctaagtggactggggaagctcttcctcctcgatattgttccttcccatgtttgtaaaaggtaatctgctatggaagtctcattcaggaggtgagatgaagatttccctataatcaattattttcatcctctattgagatgggaatgcccattagatttcctatctcaaccccagtctcatcacatctcagctgagcttgtcccgaatctgctgacatttgtaacattagcaattcctgaatcatagaggttggaagggaaaacaacaacaactaccaaaaaccttctcctgtgtaatgatttcttttccatccttcttatcctctttaggagaaagttatattgtgtctctaattaacctgaaattctcagcttggcttcattctgtggcaatcttattacacaccaggtttatgatagttcagtgtccactataggtttgctgggcttttttttttttttttaacaactttcaaataaaccgagaacctgcagctttagtgaaatacgtgatttcatcggagaaagagtgagggctgaggtttcgggaatgaagcttaaagaagatttttcctttcctaaaaaccagcccctatctgcccagatctttagtccttacctcatattctgcctatgtgtgtaaagagaattgaatgtaaaatgtgatctatgcatgtcaattatatgtatggtttatttttaaaatatctttaccctgtcaatttttttttcagctaccaaggatgttttctgtggtcatcaatttactcttcatatgtgttcatttctttcctggagctcagcgtcttttgtgtaaaatattttaattgttcacaaacctggttggtttaccggcatgaggttttttcttggtgcaaagtgtgtacaaaggagacacaattttcttgtataaatgtggaataatgataattcactaactggtcataaacaacaagtttactgcgttggaatatagtgtgttctgagagcaattctacatgtttgatgtttaaaaccagacaccctggaattcaaagacacaactgtctcaattattttagcacatggagcagaatggcaataggctatgaagttgttctttttgcagtgacttcttgaggtagaatatggcttgggtttggttcttgtgacctgtactagtattatttcccatttggggcagaayctctgggtgcgttttaatgactatatgaatgcttaaaaggaacttgaggaacaatgaagtccgtactcaactgttctatgacctagaagcatagtcggtgaagtctttgtctgtgtacattgacaaatgtgcatctgatacatgtgcgcttacatgtgtgtacagagggtgtgmacaggggaggctgggcggctgcctcctcctgtccatcagtgggcagaggtctttcccctctcaccatgactgggtgtgtggcaggatgttggctggagagttagctaaaaccagcgagagagggtaaagttgaggaaaattgattctaattgcatcatgacaatcagatgaagtctatttctgcttctcagcatccgagatgctttatttgggcaattaaaatgtcaggccacatacctgtgaaatgttaaccctacaaggaataaacagaaacagaacggcctttatcctctgaaaagaatatatrtcatatatatatgtcaccaaaccgaacaagtgatcagagttaattaagagaagggtttgccatcacccggatctggccaactctttcgtttggaaaatgcctacaagctcagttcgtggcaccttcccaccctcactccctatccctctgcaaagaaaccagggaacttttctttggcattgtgggtactaagatgcgccaggagtcccgggtggtgcgcgagcggcggaattcgtgacatcgccaagttgcgagaggcaaactccccgattccatccaaagcctctcgcggagcctttaagagacgttgtgtgtgcgcgctgcgctagtctccccgccggggcggaaacctcgggtgcgggatgtggggagagcagaggcagcgctcgcagggccagcacgggcccatccccctctcggcggcggcggcggcggcggcgcggccaccccgtccccgcccccccaacccccggtcccccgcgtgccccgcgccgcgccggcgacgccgctcgcgctaggaccgggctgcgcccgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccagcgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcgggccgccggcctccgccccggcctgcctggctccctgggcgcgcccgcacccggcgcctccgatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaaggtatcggcctctcatttctccttccctcgtcctgggtcccggggtcctgggtacgtttggctagcctgctctgggtaaggacaagaagccccaagctcttctcttcgtattgcagcggaaaagggttttatactagaagcgagttctgcattggaacccagaccccaaatccgcatgctttggccgactgatttccttctttactctctctttgggctgtttccatttcctttgcattgattgtgagttcactggagtctgcctttctgcaagggatggggtgtttgttgttgttgttttaaagcctagtttacttctctctctctgcccttgtttttcctgcatgttcaacatgtccctccccctcacccctttccccagcccccaccctctcaaaaaaaaaaaaaaaaaaacctgagattgtacttttgtacaggaggttcaaattacaaatggcaattttatgcacttcgccgtattaacgctgccgcccgggcagcgctcatgtgaccctccgtggattaacatcctgctaaaaaaaaaaatacctctgctttcttttttcctttcactttttgaaacgaagagagcgcgataggaagtaggaaagggtgggcgaggggccctgggcggctgctttcgctctgcgcgagttgggtctttgtgatataaaattcgccgagcgccgcgagccgtgctttgccaatggcgcgctcggcgcggggcgcgggctccgggttggggcgagccaacgccggggtttctttgtgtttctgcgagagcgactctcccggtccggagtcagataacagcctgggcccgagcctcgccggcwttccccggcccttacaggccctgcccaggctccgctagtgccggccgcctgctccctgcctctcccggcttcctctctctttagccggcctctctctctccgccctctccctccgtctctttctccgagcacactgattagacagacgccagacctccgctctctgcttgtctctcactgggggggttccccgccgggctggggctggggcttcggggtttgtgggagagtcgttccggagtggccacaggccgtctggggtggaccctcgtgccttttgcaaaagcgcctcaccctccccccagactcgcccctcccgctccctctcctccaatcaataagaaatatcagctgtttagcagtaaagaagaaagatgccctcagaatgctacatcccgcccacagcgccggggaccccgaggcaaggtggccaattctgggtcctcggcggaccagccccgagcgggcctcggaggcaagtgtgcccctctggccctcagagctcgcctgggtggtggtttgaaaggaatggtgccaagagcctggcgactccagctctgtggcaggcctgcctggttcttgcgctgctcagggcctgggtcaggtgggggtcgggctggggcagaccccgccggggaacctggggactgaggctggtcattaactgtggagtgtctcctttcctccccgcagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcaggtaggaaggagccctgtcttctcgtgcccacgggctcctagcccagagctgggscccagagaacttgggagtccccagggcaaacccagtctgctccttgaaaggccaaactgttgagtgcaacttaaagtgggaactttttatagctgctgggcactaccaggcctgtcctggggagaggagaggaaggctggattgcaggaaggatgcttcagatagattccccacatgggccatagggcagcctctgctgcctgtttcccccayctgcagtatccagattgggatgccctctcctgctccctttcctgagcccaggccccccgggcctgctgggccccagggaatctcctcaagccctcggttttctctagcgccctggctgggcctccaggagatgcyctgggcagtggagcagccctgacattgtctctgcagggaaaagtttgcctgctaactcartaggagttggagctccaggcaaatccaacctgagggcagcaattttcaaaatcayattcttactggaataatgcagactgccaggagaggcgaaaagatgtgtcaggatggggcaacaggaggaaagggaccgtcataactcytcagaatgtctgcaggaggttgaagactctggcctcttgcttcccctgcccaagcaaacacttaaggcaattttcaaacaacccaaagtgtatgccaacttgggctggatatggatgttgctagagatataaaaccatcattgactgcattatgcaatctaattagtttgcatgtagtttaacctgtgtgagtaatagagctgatactaattaacttgagrcaaaatgatttttgaaggtgtctggctttccattttgggccacacctgagctttttggctgcctccaggctgagttcagcatagcccaggtggatggaaatcaccaaccccctttcacattcttgtactaagttgtcagctgatccttttgtcatggctgagaggggaaaggggttcccgattaagaataacaaacatctggacgttagcagggcttggaacctagtcacccactacaattttttaagcttgttaacaggaaacgaggagagatgtgtagtttatgtggcaaacataaaggaggtccacaatctcttccttattgttcgaaagaagtctggggaactaagtcattagctgaacagcttgcagcttcttagtcctcaaactgctgtcttgtacattgctgctttccacataaaacctcccagcacagccaccccaaattctgcctttggaagtccttaggtaatcaattaaaggccagtgtctgggcagggaagctgtttgcagaggtttggatagggattatttttctcgagtgcccctcatacctagaacgtttgcctgctgcagatatacagacaagatatctccctacctcatagccaccttcacccctgtcccacaacccaacacccagcccaccttcttggacgatggaggtagtcgttaatttcttggtatcattgctagctcttagccttacccttggtctttcaaggaaaaaaaaatgcctgatactgtcgttaacagtttaatttatgactatttgcaaaatgtggaggcctgtgtggagaatgcaaatcgcctcacaaagagataaaggttcctgttatctgattcagagggagacacacagttccgaggatgccgagggaaggagtcctgtgcaaacagatcttttagttcctgtccacagacacctctacattctgtagacatgcagagtcctagatatacatatgaggaggttgcatgtgtgttctggttcttggggtggaggtggtggtggagattttcgaatatctgttttaatgactcacaatatgcatatgttaaccccagtcttgtatggggagccctgaaaggtcaggtcacaacctgaaccgcctttaccaagaagcttctcatttcaaaggcacttactgtattttcacgtatcaaaaaagaaaagtgttttcctgaagataacagggaggggggatgcttctcggagggacctgggttttaaaaaataaaggggggtaggagaaaaagggagagagaagaaaaagggggaaaagaaacagctcaaatgaacagagagatcacggtttgcatggctgcccttcaataggctaaactgacaagatcagttttaaagggccacttaaatcagtttcaaagactggagaaaaatgagtcgccctctttggggggaatctgaggctggatcgtggacgccattactcgggactgggccaggttgtccacccccaacccccaacccctatataattataagccaaactattatttacagaggaggaggggagagagtgctggtagttttggtttcttctgtttactgacttgggccagacagacccaatgcacttttgcttgggcctctcaatgacccaggctaaggactcgggcagtgaaagcctgtagcacactgagctatgttttattttaaagcaaacacttcctcaggaccatctcttgctctttcttcccccaccccgcctcccccccttaagttttcagtacatagacatttgctccaactccggttggggcagtttgacagagctctgtgcacacacctcatgtgacccaattcaaacctcttaatctgatgactgaattcttcttcttcttcttcttcttcttyttcttcttcttcttcttctgtttttaaactttcttccagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgkctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagacaatccctgttttattatgctttaagcatgtgttctagacgttggaaatctctctcgcactcttaagtttaagcaatgagcttggggtctgcgaggcagaaaaacaggacccaaaatttttcaaccggttaaaacaaacccccttgtatatgtttagagtggccggaggaggatctgtttagagtcttgagttcggtttaagtttattgcatttaaagaaagtttttcttttcacgctgagttagaacaaaagatctttgctgcgactgaattggacaaaagacgagggctgggacccagcgagcgcgttctgtgtgaaattgacgagatctttaaaaaagctgctaaacatggcgactctttccctttaagtgtctctttttccttgctgggtttttttttttttttttttttcatctgatctgagctcgctttatttcttttcccaaccccgctccccctcctcctcgtggcgctcgggggtgtgagagaacccagttagacgcgaaatgcaacaatagtgcaaggagagagaggggcgctcgctgcttctcgccactttcaaacaaacctgggggaagattgagcccgggggggattccagcctgctcgctcggctcgcggtcgccctgcctcggcctttcaccattagctctccctgggccgcgaggagctggggctcaaagttagcgggcgacgtccgaggcttagcctctagccggctgcagggacgggggcctggagttggcagctgctgcgggaaagtgcctgccccccagcccccgcccccacttacgtgcggcagaattccgccagcgccccgggaaagtccggggtgccgggcgcgcggagctgcactcctgggatgtgcattaagcggcgacaggcggggggggcgagggcgggggcggggggcggtcagggggagctcgagcgtgtgaaactctgcctcgaatctcgcttttgacttggtcctatgagctgagccaacatggcgtctcccactgcaccgcgagcgccgggctgccaggctcggcagggccgggtaatagaaaacacattggttaccaaaaagaaaaaaaggagggcggggggcgctaaaggccattccgtctgcaggcagaaaacccttttttaaactcttgctggcaagtgagtccggtcctcggttctttaattaaagcaacagaattcgtaaggaaaatattggtaacgctgtaccttctcccctccccctcccatattcaggagagttgatttcctgtcccctctccttccaagaaccaaattagaaaaataaaaagtctgtatccgcaaatgatcttaaatgtttgaatggtatagggggatgggaagaggacggtctttacagacctcggtcagttctcgcgctcattaatgcaggggctgcgccggggtttgcgcgggcccgagcggagctggggcgcggtggggagggcggaatgcgaaccccgctggacttgggcagaacttgctgcttttgcacgcccaagttgtgggaaaggaggctttccgggcggagggttgattggggggtgggagggtctagcaggggctgagggccggttccaggcgggtggtcgcagaccctagaaatgtgtgagcccgcgtggactgtgcccctggcaggagagcgactgcagcggaggaccctctttctctaataggtttgagagtgggcaagggcggccgtgggacagacctggcctcctagagagggtcttctgagggcctctgcagaggtagtggatccgggcccaggctcccttctcgggcggatgggatatcgccccgccacgtccagctccatccccagccccggcctggacaaccctctccctcagccgcctgggatactctctgaattccaggcctcgtcaagatttattgaagttgggcttaaaaaacgtgcttcagatgatttttcccattttctcagatttcaaaggctccctgcagtgcggctgcctaattaatggtgaaattcaactaaatctaattatgcagtaattttaaagcagttagtgctgggcgttggtttgtaataggacctcagttttttaaagtttgcttactgtgttggtttaggggaaagctattttttgtatggtaaagaaagaccgggaaatagtactactggaggaaccagagggctaagaaccgctccccaccccacctctatctccatccccaattctatctcgttttccttctgttttttctatcccaagcacacggtaaaaagctgagcaaggtgctaacccaacaaggagaccctatttcatagccaaaggggaaagagagaatctttcatacagagacacaaagggcttggtatctgtcctggaggcctctgtaaatgcccccaaacccgggaagggattctcatctcctctaatagagaacagatttcctcctcttaacatccattgtcattaaggcgcaaagctgactcttggagttgtaaatcttatcgtccttctgataacacacttgtaataagttagcgtcctattcaaagtgaattgtaaaactgcctcatttaatatggcatctgtgtcattaaaacttttatttttctccccctcgtgtcttgcaggtttggccttggggctagcgctgaagtctctgcctatggggcctctggggtagggctgaggggaagaaaggtgtgaaagacgggctgcctggattcagcctctggatcttagaccggggtgagagacccgaggcagaatgggcctggggggtggtgtccctctatcccatctcccccggagcggccccctcgaaatgacgttccttgaaagaaacatgcttgtgattagctaagcaaacacatctgctttcggagttgggccttcgttaattagctgaacaaagggccgttttgctttttaccttttgctggggagagtgtgttatttcaggagtgttgcgggccctcctcttttcaattgcagccacgacgttaattttattgggattactgatgggaaatgaggtggcgcaggcttccgagaggaaaagcttgatcattaccccctttggaactatatttttccacccaacctcctgcttgagaggagggggtggggggcgaactgcgctgcaagttcggagcaattggaatcaggctcgcggtgcgctgatctcgggtgacagagcgtgtgttgaagctgaactctataatttgcgcttctgttcctttattaggcctggacaacgaactaatgagctttggcccagtacaatgtcacttgtatttattttcttatggcaactttgagatagcggaagtgttctttaccaagagccagggagggcccggagtcctgccggctgctgtcccggcccgggtcggtggctgcgtcccgggggagcgagggcgcggtgagagcgcgcgcagagccggcaaagctcggggactgggcttctaggcgaagctaatggggccctcaggaaggcgttaggccctttggaggcccaggcatccctacaggagcagctccctgaggatgaggtcggggggcgcggggcaagtccagggcaagttcccaggcacgagatgatggaaggcgcgaaagtggcatggcttcctcctggcgcagagcagggggtccttccgcaaagactgccaggccaaggaa

SEQ ID NO: 10868 - DNA, 105077 bp, Homo sapiens
  misc_feature (1)...(105077): n = A,T,C or G, or insertion/deletion polymorphism (see Tables 1-2)
cctcatgcatgttgagttttcaactttaaattttttttttttttttttgagatggagtctcactctgtcatccaggctggagtgcagtggtgcaatctcggcccattgcaacctccacctcctgggttcaagcgattctcgtgcctcagtctcctgagtagttgggattacaggtgtgtgccaccacacccagctaatttttgtatttttagtagagacagggcttcaccatgtcggccaggatggtctggatctcctgaccttgtgattcaccccgcttggcctcccaaagtgctgggattacaggtgtgagccactatgcccggccgttgagttttcaactttaagtgggaacttcagacttcatactttctgtgtgcagaagacatacgcagtgattataaacaaactgtacatctgccaaaaaaaaaggccggggggagggaggaacaaaggaaaggaggaaggaactgttgcgcagttatttatttacattggaaacagccctcgcagtacgggtatatgaaggccagacctgatgaacagcaggtgaaactctgggaacccagggcttaggatacacagtgcttccttgtacatttgtttccttcagatggtcacatccaccactgaagctttttagaaggcactttccatgacagatgcaggtcaaggtcgcacattaaaatcggccctaatgctttttgctgagtgtgagtccctgactctcttgcgaagatcccaccagcccttttcgtcttagcagaatgaaggcagtgccctctgcggcccactaacttcacaagctgaactcagacgctaaggcaggacgacccacgggctccattcaagcctcgcctcatctttcactggttgctgctggagaaaatcctttttcttttttttttttttttgttgttttctttgagacggagtctcgctctggtgcccaggctggagtgcagtggcacgatctcagctcactgcaacctccgcctcccgggttcaagtgattctcatgcctcggcctcccaagtagctgggattacaggcacctgtcaccatgcctggctaattgttcctatttttaggggtttctccatgttggccaggctggtcttgaactcctgacctcagatgatccgctgtcttcggcctcccaaagtgctgagattagaggcgtgagccagtgcacccggcccattctcttggtttttaaagctgaaaacaagatcctggtgtttgtggtctcgggagaagatgccgtggccctgaggccagccctcacctgggctgcgtgaagaaggcatggatctgctgtgccactgcttgtccgaccacctgctccagttccccaatggaagcattactcagttgctggatgcttggaaacttctggaggagaaggggagctttaacttttccaactcctgggatctgctgcacggttcgaaggagcgaaggctcagacagcagcagggcccgtttcttcccgagaagagggttcttactgggctctttggtttgctcttgaacctgaaccacaatgaaagcaacagcacgtgagcgccctctggaggactggccgttttcttaaaatatgttttgtagaaattgcgtttttccatttggctcagcttgacttaagggaacaaatgttttcatgtatcatgaatataatttctcagacatcagtaaaattattgaaaggtgaaccacacaaaggagttaagacattaatttacaaaaatgtgcgttttcagaatgtttagaaaaacacacagatgaattcaaacactttctgttggtccattaagaaacatttcagttgtgcaggattaaatgatggctacacctaaactaggcctacttcacgcaggagctgcaggaagcctgcctcaaaggagaaacctggtctagttagtggtggttatactaaggcagacaacagtgttatatcaaggaaagttaggaacggtgacgcaagggatatggtagagagggatctgtgaaccattcatggctgcttgcatcttcaatgtggctctcaactctagctccacatcagagggggtgatttaaaaacaacacacacataacaaagaaaacaaaagtgaaaaaaacaaacaacacacacacacaattgatgttccccatgctgggatcagaggcgtaagctactaaactgattttaaaaataagtgttggcggccgggcgcgatggctcacgactgtaatcccagcactttgggaggctgaggcgggcacaacacctgaggtcgggagttcgagaccagcctgaccaacatggagaaaccccgtctttactaagaatacaaattagctgggcgtggtggcgggcacctgtaattccagctactcgggaggctgaggcaggagaatcacttgaactcaggaggaggaggttgcagtgagccgagactgcatcattgcactccaacctgagcaacaagagcgaaactccatctcaaaaaaaaaaaaaaaagtgttggttggtgcggtggcccagaactttgggaggctgaggcaggcagatcacctgaggtcaggagtttgagactagcctggccaacatggtgaaactcttatctctactaaaaatacaaaaattagccgggcatggtggtgggtgcctgtaatcccaggtactagggaggctgaggcaggagaatcgcttgaacccaggaggcaaaggttgcagtaagccaagattgcaccactgcactccagctggaatgacagagcaagaccctatctaaaaaaaaaaaaaaactgcccaggcatggtggctcacacctgtaatcccagcactttgggaggccaaggtgggcggatcatgaggtcaggagtttgagaccagcctggccaatatggtgaaaccctgtctactaaaaatacaaaaattagccgggtgtggtggtgcgtgcctgtagtcccagctactcgggaggctgaggcagaagaatggcttgaacccgggaggtggagatggcagtgagccaagattgtaccactgcactctggcctgtaggacagagcgagactccgcctcaaaaaaaagggaaaaaaaaaaacttgcacaaggtgctgatgcttaacaaaaatacgggatgagacaaagcagcttctagttaacattttctttctttctttctttttttgagacaaagtttcgctcctgttgctcaggctggagtgcaatggagcatctccactcactgcaacctccacctcctcagttcaggtgattctcctgcctcagcctccggagtagctgggattacatgcacccaccaccacgcccagctaatttttgtatttttagtagagacagggttttgccatgttggccaggctggtctcgaactcctggcctcaagtgatcctcccgcctccgcctcccaaagtgctgggattacaagcatgagccatcacgcctggcctctaggttgacgttttcaccagcgaaagggcaggataatgactgatggagccatcacaccctgagaatctaaaatcaggtctccaacttgtatactttgtgatacacttgcctggagtgtgtgacaagctgagctggctgcagaggcagcttccgcatttaaattcctcgaagagattttataaaccaagtcagagaatgacatagattggattgatggttgcttctggagagcagctgagtgtccatgaggacaggactaccacgaaggtgtaggaatcggtactcaccaactggatgacgaggcaggatgcttccatctggctggccactggaagcagcaccattccaaggtccagcacagtaaacttctgtagggctgggaagtattgttcactcatccgggttttttcaacgactacaattcctttaagattattggacttgaaaggaaaaaagacagtaagtcattttgcaaccaaattgcttttcaggttaagaatgctatcacttcgtgcctgacctggccaatgattttaaataaatgataccaagggatggagggaagggtggggtgagacaaatcaatgttcgagtttctttaatccaatgcttacatttcttttttgtttttgttttttgttttttgagttggaatctcactctgtcgcccaggctggagtgcagtggcgtgatctcggctcactacagcctctgcctcccaggctcaagcaattctcccgtctcagcctccctagtagctgggattacaggcgtgcgccaccatactcagctaatttttgtatttttagcagagacagggtttcaccatgttggccaggctggtctccaactactgacctcaggtgatccacccgccttggcctcccaaagtgctgggattactggcgtgagccacagcacccagcctaatacttacatttctaacccgaacaagcctctttctgtagccatttcctgccaccaaatcagcttcggtgacataaagaatgcagcatctgttcgacagataaaagtctggtgtcaagccatcctcgaaaatgagcttaattttcccttaaaatacagagaagaaaatgagttccataagctttggatgaaaagatggcaataataggcagattttttttttttaatatgtcaggggaggaaagggctggcagagggcaggccaccgaccttgcatctcctgcgccagctgtgacccgcgccatttctcattggccacaatatgccccaaaggcacgtgcacggggcccgtatcatcaggggggttcttttccatggatggtctccacctaaggagggaaaagccaggcggcacttgagcaggctctcccgcacacggccctgcattccactccaagccagggcctctggggcaggatcccctctgcaaactgaattatttgtcaaagaactgtcaaataagattccctttataattactaataagaaaacacaggctgggcgcggtggctcacacctgtaatcccagcactttgggaggccgagcgaggcgggtggatcacaaggtcaggagttcaagaccagcctggccaagatagtgaaaccgcgtctctactaaaaatacaaaaaaattagccgggcttggtggtgggcacctgtaatcccagccacttgggaggctgaggcagagaattgcttgaatccggaaggcggaggttgcagtgagccgagatcgcgccactgcactccagcctgggcgacagagcaagactcgtctcaaaaaaaaaaaaaaaaaagaaaagaaaaagaaaacacaaaggcctgaatgaaggccagggtggctggagacgggatgtgtggtggtggaggtggtaatggcattggattccaataaggccagaggcacgatcagatttaagttttaaaagaatcctgggctgggcatggtagctcacgtctgtaatcccaacattgggcaaggctgaggcgtgaggatcgcttgtgcccaggagttcgagaccagcctgagcaatacagcgagatcccgtttgccaattatttgtggcgaaataaattctctaagaaccaggagattcctgtcctggtgtccgcgtccttcattttcatcacgtgcctagcccctgataccccagctggatccgcaccgtagcttctcagtccagtccaaggcccgaatacagccggcaggaaccccaccgtcccagtctagagatcatgttactggtggccgcgccaccttccgggttcacgccctcggtgctcgcccagtccttcatccagcccgccctccgcctcccgcagcgccggataggctgtggcgtcagaaatggacgtctaacctgaccaataagagaacggataagggcggacgtttccgccctggcggggatttgaacggtacccactggttgccaagaacgaccggtgtggaagtaaccttagctctgattggtcgagggccgagctgagccaatggccgacgtggttgctgcaaagtccattgcgaagagaaagcgtgagggctgggcctgcggcgggctttagggagtggtccctggctgtggatagatctgctgatgagtccaggccccggtccattctcctcgcgctgcaaggatgctcctgggatttcggagaggccgcaggagtcatttcgtaagtagatgctcgcccgccgcgcgtggggctctgtggggccgggaattaggggtaaagtgttggggcgggttggggtttggcctgagatccagtcaagggggcggcacaagagaaagtggttttcagttgaggaagccttgatttttcgtgttctaaacttttttttttttttttaagaaacagggtctcgctctgtcgcccaggctagagtgcagtggtgcgatcatagctcactgcatcctcgaactcctgggctcaagcgatcttcccaccccagcctcccgaggagctgagactacaggcgcgcgccactactcccggctaattgttcaatatttttgtggaaacagggatcttgctatgttcctatggtggtcttgagctccttagcctcctaaagtgttggtatcacaggcgtgagccactgtgcccggcgttaacaatcttctgccccagggtcggccacagttggacaggagcaccctgcctcccctgtagcattcgtccccgtgcccggagttaactcctggacgacgtacacctgctgcactgctggatatagccattcttcatttttccctcctccacccaccatgtacaccccatcagcaagtcccatccgatatacccactacatacatctgccagctgttcccatctccacccacaccccggcctccagcatctgtctggactgctgcggcagatcctcactggtttctctgcttccactctcgcccttcccctaggtccattctccacgtagcagccaaggggattcttatatttatttattatttaatttagttttagagacagggtcttgtcctgatgcccaggctggagtacagtggcatgatcatagctcactgtggcttcaacctcttgggctcaagtgatcctcctgcctcaggctcctgagtagctgggactacaggtgtgcaccaccacacctaggtattttttatttattttattttttgcctcacactctgccaagtctcaatgcctggctaattttaaaaattattttgtagaggccacgtgaggtggctctcacctgtaatccagcactttgggaggctgaggcaggcggatcatttgaggtcaggagttcaagattagcctggccaacatggtgaaaacccatctctactaaaaatacaaaaattagcgggcgtggtggtgggcacctgtaatcccagctacacgggaggttgaggtgggataatcgcttaaacccgagaggcagaggttgcagtgagccaagattgtgccactgcactccagcctgggcgacaaagctagactctgcctcaaaaaaacataattttttttttttggtagagatggggtctgggtatgctgcccaggctggtcttaaaccttggctcaagcaatcctctcaccttggcctccagagtgttgggattacaggtgtgagccactgcatctggcttgagtttttatttaaagccccaaacattaatgagtccctgctgtgtgctgatacccacaactgacagcttatggccacacggtctgtaggatagacaagcccataaataattctgtacacaatggtaaaacaagaactgctgttgatgtgtgtaccagaagggcagtgacrtcagcctggagagttggcctgggcctggcagggagtaaggaaagaattctgggtgcagaagacagcaaataccaaggcctaaaaaagaatgaattatttgctgtttgggaaatggaagcccacgctgagtgctgaagcacagggactctgcgcaggaagaggaggggaagcaaganatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagccgcgcaggcaggagccagggacaagtgggagccctgcctcttccaagttggcggggtgggagctcccaggtgcagctgtggctgcccccccaggcacaggacgagggcatctctgnagcctgcaccatcggccatcccaggaaggacagcccccttcaccctccatccctgcaggntcaggggtgtctgcttccactgcctggcctctctccactccagcaactgctctgatcttggaggggagtcggagccaagacctgcagccatgaatggcagcaggaggaagggggtggggtccccagtaaggccccaccctcaggccagggagggcctgaattctgggggctgggctgccagtccctctgaccagagtggaaactcgtggagccttttctgggcctgccaatggcccaatcagcacacacttcttccccgctgaggtccataaaaaccctrggctcagccagagcagcgcagagaatagccagaggatgaagatggtagagacgaggggacaggatgaccagctgcagagagcagtaccctctctgctgatagctggagacggtggggtgaccagctacagagaggagtaccttctccgctgaaagctacagagaccacctgccagcagagaggagctacactctgctgcgagcttcagagacctgcagagacattggaatgacttgcctgcggagaggagccactctctccagggcctcctctctgttgagagctgaatgmttgagctcatgggacaatctgtctccagagaggagctacccactcctctgagctcttctaacactaaataaaactcctcttcacccttcacttgtctgtgtacctcattcttcctggatgcaggacaagaactcaggcaaaggcactgtggccacagaggttccggccagaaaaatcgacaccccaaaaatcccataacacttggtaggaaccaacctatatcagcctgataagccatgctggacatttgcctgccgttgagagagtggtgctgcccatgagggtttttatgcccagtagagacaggattgacgaggggaccatagttaggaatgattgtgatggtatgaggggggattcactctttaaaaaaaaaaaatcttatgcagcctttttggaggacctgctggacgccagcccttgggattcaaaggttaagaaaaccttttctggccaggtgcagtggttcacacatgtaatcccagtaytttgggaggccaaggcaggcggattgcctgaggtcaggagtttgagaccaccctggccaacatggtaaaaccccatctctaccaaaatacaaaaattagctaggcatgttggcacatgmctgtggtcctagctacttgggaggctgaggcatgagaatagcttgaacccaggaggtggaggttgcagtgagccaagatcgtgccaccgcactccagcctgggtgacagacnagactgtctccaaaacaagcaaacaaacaaaaaccatttcttgtcgtgtagcaggtggtggaggggggcagggtggaaacatggaaactgtggaatcacttgacaaatacagggtggcaggtgccacacagaggtaaacagagtgggggtattgggtagagactgcttggagcttctgctcctgtgggtggctgtgcaagtcggtggtgggggctgtaggagatgactggaaggtgtgcccatccctcactcctgaaagatgcccccactctgtgccacccttcccagccttgtgtctcgtgctgaccactacctaacattcctggggccactgtcagtgggtgctcctcactaggccttgggatttcctccatctgctctggaagcccttcccatgggaattgtccccaccatgcccccaagccccaccctcgaagatgcctctagtctagcaaaacggagaatcgtgcttatgatttccgagcactgcaaccaatgtcttgctccattcctttgttcatgccgttccctcttcctagaatgctgttccgtcacatttccaaatgtgggaccagtgggcatctctgaaagcccagtctaaacgcctgtgtgattttctcgaaggaaagcatttgaaattcccaggctggccccagacctggaggaatcttccctccctgcccaccccagcactttgtgctaattactggcttcaaatagaaaacaatagtgtttttatcccacatctcattgatgctcttttttttttttttcatttttagtgagagcctttctcccggctcattccataattctatgttctgtaataattatttgggtgtttttcctcccttctcaccactttggggatgaagacaaggtttcttcattgctgtcatggtgttttgcctctagtaggtgtgaatgaatggctcgtgccaagaaaatgattggactagacccagaaacgtctcagagactcccagttacagttacctaaagcggagctctctgactttcattgtgtataggagctagttttcattactctcrtcttggagataagccacctaaaagcttatattaagcccctatgaggtgtgaggcaatgtgctcaatgctagagttccaggattgataaagataagagagtgggccaggtgcagcactcgcacctataatcccaacactttgggaggctgaggtgggaggatcacttgaagctagaagttcgagaccagtctgggcaatgtagtgagatcctgtctctacaaaaaaatacaaaaattacctaggcatggtggtgaacatctgtagtcccgtctactcgtgtggctgaagcgggagtttgaggctgcggtgagctatgatcgtaccactgcactccactctgggcaacagagcaagaccscatctcaaaaacaaaacaaagcgaaaaacaataaggatatcacttgcttctcaggaagtcgycctgctctgcagggggagccacatgagacatcactggggggagtgctgtgggacacatggaagagctagagggtgactcttggggacagccagggaagctctgaggagggaaggacaagagggccacacaatgagcagctatcatgatgctccttggctgtgtgcacttgtctggcctgatggggactggggatggcaggggaggagtgggcttctgatgggtttggatccatgggtggccagtgcaggtgtccccttgcaggcccagggagagtggtgacaagactcaggtgatccagtgacccaacccagtgacttctgttggatttcatttgtgcagaaacacatcatccatggccttttacctgcagccagcgttgctccgaaggcagctgtgccacgcacacctcctccccgcagccccaacccatctccagagagaccaaggtgagtatcagatgagcaggcactgaggtcacccctgtgctcagcctccaagtactggatcctggaactgctcaaactgcccagaaaagtataagtagggtggttagaatcatgtccttcaaaatgtttaccacgattccataatgatgcaattaatatggtgtctctgaggataatggactgacttgaggtctctccttttcaggtgcatgaacttctcacatttcatgattgaatgcaatgagtatttaaaaaaaaatgtaaagcattaaagcccaagtattcaggttaacagggaattttgaattatacacataattttctttcttttttttttccttcgaaacggagtcttgttctgttgcccaggctggagtgcagtggcgcaatcttggctcactgcagcctccacctcccaggttcaagcaattctcctgcctcagcctccggagtagctgggattacaggcacatgccaccacgcctagctaatttttgtatttttagtagagatggggcttcaccatgttggccagactggtctcaaactccygacctctttcttaatccgcctgccttggcctctgaaagtgctgggattacaggcatcaaccaccgcacccrgcccattttcttttttttttttaattattaatttttttttcaaggcaagatcttgctctgttgcccaggctggagtgcagtggtgcaatcatggctcactgcagcctccacctcccaggctcaatcagttctcccatctcagcccgccgggtagctgggactacaggcatgtaccaccatgcccaactaatttttctattttttatagagatagggttttgccatgtttcccaggctgaaatcctgggctcaagcaatccacctgcctctgcctcccaaagtgcctgggattacagacgtgagccactgtgcctggccaaaacaaaaagttttttcgagatatggtctcattctgttgcccaggctggagtgcattggtgcgaacgtgactcactgcagcctcaaccccctagcatcaagcgatcctcctgtctcagcgtcctgagtagctgggactacaggtrcacaccaccatgcctggctaattttttaaattttctgcagagatggaggtctcactatgttgcccaagttggtcttgaactcctagggtaaactgatcctgggaggctgaggcaggagaattgcttgtgcccaggartttaagatcagcctgggcaacatagcaaatccttatctatagcaaaaatcaaaagaaaataaattatctgagcatgatggtgcatgtctgcaatcccagatactcgggaggctaaggctggaagatcacttgagcccaagaggaaaaggctgcggtgagctatgatcatgtcactgcactgcagcctgagcaacagtgaggctgttgtgagtgaggccctgcctctaaaaaagtttattttaaaaagataattaatagggtagctcctgaaaaagaaaaaaagataataaatatatctatcattctgacaagggtcctcatgctcctttgtaattccttccccctgcccctctctgccacctttcatgctcctgttcatccccaggcaacctctcatctcctttctcacactatggattagcttgtattttctagaattttatataagtggagttacataaaatacactgccttccttcactcagcatgattattctgattaacgcgtgttccgaaagtcaataattcatccttttccttactgagtagtatttcattatatgaatatgccacagtttgtttatccattctcctgttgatggatatttagtttgtttctaatttttggttactagaaaaaggctgctgtaaacatttacacactggctgagtgtggtggctcatgcctataatcccagcaatttgggaggctaaggcaggcagatcacctgagcttagtagtttgagaccagcctggtcaacacggtgaaaacctatctccactaaaaatacaaaaattagctgggtgtggtggtgcactcctgtagtcccagctactggggaggctgaggcacgagaatcgcctgaacctggaggcagaggttgcagtgagcccagatcgcaccactgtactctagcctgggcaacaaagcgagacttatatctcaaaaaaaaaaaaatgtatacacaaatgtttggatacatactttcatttctcgggtaaatatctataactgggccttatactaggcaggtatttaatttattaaggaactgtcaaactattttccaaggtcattgtcccatttatgttcccaccaacagtatatgagtccagttgcttcatattctcaccaacacttggtttggtcagagtgtgtgtgtgtgtgtgtgtgtgtgtgtgtgtktgtgtgttcatgtgcatgcgtgtgagtgcgtgtgtgtgtgtgtgtgtgtgtgtgtggtcttttataacttggacagtcagtggttagttttcatccacattgactgtaggtttttgaaagtggtgacagttgcatagctaaccaatgtacagagcttgtttgatcaatcttcatcttcattacgctttctggacagtggtacacagatagggtgagggatattccttactcctttgtctgagacagctttgttgagcccggcatcaatgcacacatctcgagttcctagctctttcatggaaaatttccagatctctttgtgtatgccaggggcagtgtcttaaagcacactccataggtgtgctcatgagtgctgatagtgtgctttctggtcacaaccttgttgacgacagaacaacccttcttattgccctcctttgtggaatccattctcataggcccagtttagaataaaagagcacaaggggttgtcttggtcagtttttaaaattttggacatttcatgagcgtgtactagtatttcattgtggttatttttgtttttttgtttttgagatggagtctgttatttttgatcagagtctcattctgtcacccaggctggagtgcagtggaacgatttcagctcacttcaacctccgcctcctggattcaagcgattctcatgcttcagcctcctaagtagctgggattacaggcatgcaccaccacacccggctaatttttgtatttttagtagagatgtggttttgccatgttggccaggctgatctcaaactcctgaccttaagtsatccacccgcctcggcctcccaaagtgctgggattacaggcgtgagctaccgcgcctggtcttattttgcatttctctaatggctaatggtattgagcatttttttcatgtgcttatttgtcatctttatatcttttttagtaaagcatctgttcacatcttttgcccatttataaaaattgggcattccttgttggtcacaagtcctgttgcagatctaagaaccatcttgggaaggccgttggactcaggatcatgttcagttggaggcaatgacatttttcatccaggagacgtaagcagagacctgggtgaagactgtgggtttcctggagacatcacagccctggcttgttttccattattgcatcctgagggttcrttatatagtatcaatacaagtcttttatcaaatatgtgatttgcaagtcttttctctctatctatggcttgtcttttcattctcttaaacagtgcctttcaaagagcagaagttattaatttttatgaagtccagcttacaattttttcttttatggatcatgctttcagtatctcatattgaagaaatatttacctaacctaaggtcacaaaggttttctcttatattttcttctagaagtgttatggttttcggctttacagttaggtctgtaatccatttagagttagtgtttgtagatggtgcgtgtattagtccgttctcacactgctgtaaagatactacctcagatgtggtaatttataagcaaaggagatttaattgactcacagttctgcatggctggggaatcctcaggaaaccaacaatcatggcagaaggggaagcaggcatgtcttacatggcggcagatgagagagagcgagcatgtgagagctcagaagaaactaccatttgtaaaaccatctgctcttgtgagagctcactatcacaagaacaggatgggggaaaccacccccataatccaatcactttcctccttcgacacatggggattacaatttgagaggagatttgggtaatggcacagagccaaaccatatcagtgtgtaaggtatagatccatgatttttttttttttttgcatatggaaatttgatttttccagcaccatttgatggtaaggctattagttatttattgctgtgtgacaattgcaccaaaatgtagtaatttaaaacaaaacagcagctgggcgtggtggctcatggctgtaatcccaacattttgggagactgaggcaggaggattacttgagcccaggagttccagaccagcctggagaacatattgagaccccatctctacaaaaaatataaaaattagccaggtgtggtggcgtgtgcctatagtcccagctattcaagatactgaggtgggaggatcacttgagcccaggaggttgaggctatactgagctgtgattgcgccactgtactccagcctgggcaacagagtgagatcgtctcaaaaaaaagccccaaaaccaaaatatgaaaaatggtggtttttatcccacatctgattgatgctctttttttttttttttttttttgagatggagtctcgctctgtcgcccaggctggagggcagtggcgcratctcggctcactgcaagctccacctcccaggttcacgccattctcctgcctcagcctcccaagtagctgggactacagatacccgccaccacgcccacctaattttttttttttttttgtatttttggtagagacagggtttcaccatgttggccaggatggtctccatctcttgacctcatgatccgccctcctcagcctcccaaagtgctgggattacagatgtgagccactgtgcctgrccgggtctttcttatatgatttgttaggtggggtgtggagcagtgcccagccagggctaattattccccagtacccaggccagacctttctgagtgctgcaccyggcatcttgtgaatgataggtttctccagtsttcctggtgggagcagctgccgtcttgggctgtatgtaagcacctggcactgctcctctgatcctggtgaatggttcttcctccactgtctggtaatttcctcacacttgtgtgctgcactgtatcccgctgaaactaggggaccttctgcagatctcctcgttctctctgtgcagttctctcctttccggcactctatcctacacattctctcagctccatctctgcaactcagggagtctgcctggctccacccattcctcctccctgtgctgtgacctggaaattttcctaggcagcaagctgggacggtggtcttttgttttgttttactatttttttttttgagatggagacttgctctgttgcccaggttggagtgcagtagtgcaatgtaggctcatagtaacctccacctcccgggttcaaccgattctcctgcctcagtctcctgagtagctgggattacaggtgcgcgccaccacacctggctaatttttttgtatttttagtagagatgaggtttcaccgtgttagccaggctggtctcgatctcctgacctcgtgatccacccacctcggcctcccaaagtgctgggattataagcatgagccaccgcgcctggccttgttttacttttttaggcaggagggtaaatctgtttactctaactttcctgtaaaatattcctgagtaattcacaagtatttttaaagtccccttttaaatcttttagtctttctatatctcattttctttttccattctgatcttccattctaataagaaaactacttgaatgtaggcttttgtgtctgcctggattagaggccctgttctacctcctattggctaggtaatctttacaagtcatttaatttctatggaaaatgggatgacaataatatgtagtcatacagttgtgtgagaatcaaatgagattgtctgatggcctgcggtagatgatgggtgcagagtaaatgctcagtcgacactgtccagcagaaggtaagccttgatgagtttatgtaccttgttcagcattcacctggaatgttcatgtctcactgtctccatgggatgtttttgtccgcagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcggtaggtaccagatcgccgcctctgcttcctctgagagtggaagaggggcaggctcagcctggtctctacgtgtatgtgtgcatgcgtacatgtgtgtgcatgtgtacctgtgtgggtgcgtgggtgctcatgcatgtatttatgactagagtcttagtcactgggttttcatcaccaatgtcaaatggacactgtccagcaacctaattgctctgcgatctggatttcctccatagtggatcttgttagattttgacttgtatgggtcctggccattttcacagcggcacagagctaatgaattcagcgctgcttccagcccttagtaagtttctttgtgcagcaacctgaacagtgagagtggtccctccttacctctcacgtgtatctctggacattcacattaatttgatcttcttggcagctgcagtttagccttttttcttcatcatcttttcctttgttgcttgtcctgggtttgagctgacacagggctagggggtcaggaaggtttcctcctgaggaagaaagggtcaaggggagagcttaggatgtacaggaatcatctaggaacagctcaagggctaggcatgatctttgtggggctgggatgagctttccagacagaaacragggagtgtgacacaggtggcagtggaaagaggatgtttgggatgcgagatggggctggaggagtgggcagggaccaggctgggggtgcctttggtgtcctgtttagagggttggtgtctgcctttggagyggtgggaagacactggaggtctctaagggtgcatggggcagggatgggagtagggatccacgatcacatttgtctgttttttttttttttgttttgtttgttttgttttgttttgttttgagacagaatttcactcttgttgcccagactagagcacaatggcacaatcttggctcactgcaaccaccgcctcctgggttcaagccattctcctgcctcagcctcctgagtagctgagactacaggcacacgccaccacacctggctaatttttgtatttttagtagagacggggtttctccatgttggtcaggctggtcttgaactcccgacctcaggtgatccacccgcctcggcctcccaaagtgctgggattacaaacgtgagccaccatgcctggccacatttgcctttttaattgtcacgtatattcacctttgtgttgggttgacttttttgagacagagtctcactctgttgcccaggctggagggcagtggtgcaatcctggctcactgcaacctctgcctcctggattcaagcrattctcctgcctcagtctcctgagtagctgggattacaggcgtgtgccacctctcccggctaatttttgtatttttagtagagatgagattttgccatgttggccggtctgtaactcctgacctctggtgatccgcccaccttggcctcccaaagtgctgggattacaagtgtgagccactatgcctggcctgtgtaggcttttttgatatactaaatattctgtattttatatttagtaaaatctatccattttttctttacattttctgtaataattgtaaatttagtaagacccttcctactattagtattatataartacttaatgtatttccttctagggcttgtttttatttttgttttggccaaaaatattgctaccattttgagatatttgaatttaacctttttttttttcctggtaagcattatactttggctgagtaaaaactaaaaacgagtaaatcgttctaaaattcagtggaaaaaataagcacgtaagaccatcagaggagatggtctgacccacaggagtgctggactatccccattgtattttattttttggcgggggggggatttttttgttttgttttgacacaggatctcattctgttgcacaggctggagtgcaatggcacaatcatggctcactgcaacctcctcttcctggggtcaagtgattctcctgccttagcctcccaagaagctggtaccacagatgcttgctaccgtgcttggctaatttatttatttgtttttatatttatttatttatttttgagccagagtcttgctctgtcactcagggtggagtgcagtggcatgatctcggctcactgcaacctttgcctcttcagttctagcaattctcctgcctcagcctccagagtagctgggactacagttgtgcgccactacacctggctaatttttgtatttttagtagagacagggtttcaccatgttggccaggctggtctcaaactcctggcctcaagcgatctgcccaccttgacctcccaaagtgctgggatgacaggcatgaaccactgtgcccagcccaggctaatttttatttttattttgtagagacagggtttcctgatattacccaggctggacttgaacttctagcttcaagagatcctctctccttggcctcccaaagtgctgggattataggtgtgagccatgctcatgcacgcacatacactcaatttcaagaactatttccgattaaatccacaaccaccccatctctgacttttccatcaacctaggtaaacctacccttgccaaaccctaaaaacaagagactaaaaagcaacccagtcagagcccagaaattatattttaaccacgaacatcccaacagctacccctcaattgatgcaataaaaagccattgtgcccagccctgtcatattttaaaacatatagataaagtagcaagaacagtgtaggactagttgagtgatacagaggtgcccaggaatgccctgaggtgaacgtagtgtttctacaagcatactgaatctttaataaagcctgtcccacagctcaaaggggaaggaaagcattcagtgctatattgattagcagtattagaaatcagctttgagcctcgcctaagtcatacactaaaataaattcctaatgaatgaaggactatactctatagacacacaaataagactntgaaatccaatatccagtcttatcacacctcttcagggatatgactgctatttgcttttacaccaagaatttagaaagtaaaaaaacctttttaatcgcttttatgtttaagaaatttatataagcaaaataatattaatagaacagaaaaaacatttatagtaaaagcaaagtcaggactttaattttagtagattaattttagtaatttcaaattggaatggaagtcaagtgtggtggttcacacctgtaatcccagcactttgagaggctgaggtgggaggactgcttgagatcaggagtttgagaccagcctgggcaacaaagtgagacccccatctctacaaaaaaatacaaaaatcatcctggcatggtgttgctcacctgtagtcccagctgcttgggaggctgaggcaggaggatcacttgagcccaggaggtcaaagttgcagtatgatcttgtcacttcactccaccctggatgacagagtgagaccctgtctcaaaaaaaaaaacaaaaataaaaaaagaaaaaacaggccgggtgcggtggctcacgcctgtaatcccagcattttgggaggccgagatggacggatcacgaggtcagcagatcgagaccatcctggccaacatggtgaaaccctgtctttactaaaaatacaaaaaattagctggcgtggtggcgggcgcctgtagtcccagctactcaggaggctgaggcaggagaatggcgtgaacctgggaggtggagcttgcagtgagccaagatggagccactgcactccagcctgggggacagagcgagactccatctcaaaaaaaaaaaaaagaaccaaattggaatggacataccagaagtaaaacagacaaaggacctgaacacaagtatatggaaaaacattcagtctcagtaacaaatgcaaatttagacagtgggttttaagttgttttggcaagttttagaaaattattaccagtgtatttatagcttggagaaatgattttgtgcagtatgtatgtagacacaaaatgttcacaccatttgactcaagaatttactgtatgggccggacacagtggctcacgcctgtaaccycagcactttttgaggctgaggcgggcgtatcacttgaggtcaggagttcaagaccagcctggccaatgtggtgaaaccccatgtctactaaaaatacaaaaattagccaggcatggtggcaggcgcctgtagtcccagctactcgggaggctgaggcaggagaatcacttgaacgcgggaagcggaggtggcagtgcactgagatcgcgccaccacactccagcctgggtgacagagcgagactccatctcaaataaaaaagataaagaaaaaaagaatttactctatggcggtttgttttatgtgagtaaccttaaatacagtaggggttatctgcacacagatgtttattacagggttatctacaacaatggaaagtgaaggaaaaaaaccccacctaagcaaggaaaatggctggttaagctggtatatctagtggattcctaccttttaaaatgttgactataaaaactcattaataggctggggacagtggatcatacctgtaatcccaacactttgggaggttgaggtgggtggatctcttcagctctggagtttgagaccagcctgggcaacatggtgaaaccccttctctactaaaaatacaaataaacaaacaaacaaaaaattagctgggtatggtggagtgcatctctagtcccagctactcgggaggctgaggtaggaggatcacttgagctggggaggtggatgctgcagtaagccaagattgcacctctgcattccagcctgtgtggcagaatgagaccctgtctcaatttaaaaaataaaaatacttattaatagcaggctggggccaggcatggtggctcaggcctgtaatcccagcactttgggaggccgaggtgtgcagatcatttgaggtcaggagtttgagaccatcctggccaacatggtgaaaccccatctctactaaaaatagaaaaattagccaggtgtggtggcgagtgcctgtaatcccagctactcaggaggctgaggcaggagaatcacttgaacccgggaggcagaggttgcagtaagccaagattgcrctactatactccatcctgggtgacagagtgagactctgtctcaaaataataataacaataataataacaacaggctgggctcagtggctcatgcctgtaatcctagcactttaggaggctgaggcaggcggatcccttgagccaaggagttcaagaccagcctggacaacatggtgaaaccccgtctctacaaaaaatacaaaaactagctgggcttggttagtcccagctattgggaggctgagactggaggatcacctgagcccagagagattgaggctacagtgaaccatgattgcaccacttcactccagcctgggagacagagtgagaccctgtctcaaaaaaaaaacaaaaraacaaaaaacccttattcataacaagacaaattgtatatgtatgcagtaactctaaaaacagaaactagaaggatatgccaagtgtacaaagagatgggacggtggaaaatttaatcttttagcttctgtgtactttgtagtatcccacatttatggtaaggacttggaggcagtgcatttaatacatgataytggccgggcacggtggctcacgcctgtaatcccagcactttgggaggccgaggcgggcggatcacgaggtcaggagatcgagaccaccgtggctaacagggtgaaaccccatctgtactaaaaatacaaaaaaaaaarttagccaggcgcggtggtgggcacctgtagtcccagctactcactaggctgagrcaggagaatggcgtgaacccacgaggcggagcttgcagtgagccgagattgtgccactgcactccagcctgggcgacagagcaagactctacctcaaaaaaaaaaaaaaaaaaagatatttatcagtgtcaagtgttaagtgactttttgtttgttttccccatgaatattctaatacagrccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgttttctatgttcccagttttcttcttgacattcaccctgatgttaacttttggtaaattagtgcattgctaaggatttcttctctctattctgcatttgatagcatttgctttggggcttatttttttaaacgtgtccagcctcatttctatctggttagattaaaacataaacttctttcctttatcttgcaaaaacaaagattaacatcttcatattgttaatgtggagttccattcacagcttagcaatctcgttcttttctttgaccttggaagctaaatttcctatcacttttatggtatcattttgcacactgcagcctttctttaaattcatgcctgacggggaagatcgtcatgcgtgtctcaatgggagctgacgtgctttgagtgtttactgtgagcgctcccgtttctaactcctgtgtgcatttatcttagctgacccccactgactcgctgaggaattcccttcattgccctgtcacacatcagggcactgcacacagagagattcaaggaaacatacttctccactgccagctgctctgcgaatcccgatttttaaactgctcccagggttttggaaactagataatgacatttctttaatggcaaaatatagcaccatatccctttttcctttatttttttctttcttttcatttcttttctttttcttttcttttttyttttttttttttttgagacagagtcttgctctgtcctccaggctggagtgcagtggcaccattatagctcactgtagcctcaacctcctggactcaagtgatcctcccacctcagcctcccaagtagctgggactacagacacacaccaccatgcctggctattttttgtgctttttgtagagacagggtttctccatgttgcctaggctggtcttgaactcctgacctcaagcgatccgcctgcctcagcctttcaaagtacctggattacaggtgtgagccactgtgcctagcccctttttctttttttcaccatcattataatgtgttattcatagtgtctgtacawatagaccagcagcattaagctacaccggtattgattatatgtatattaattagcccctactatattaaaacacttttttttttttaaattgakatggggtctcactgtccccaggctggagtgcagtggcacgatcctagctcattatagccacctcctcctgggctcaagtgatcctcccacctcagcctcccgagtagctggggctttaggcacgcggcaccacaactggctttttttttttttttctatagggccagggtcttgttatgttagccagactggccttgaactcctgggcttaagcaatcctcttgcttcgggctcccaaagtgttgggattacaggcataagccaacgcccctggccctaaaatacattttaaatggtcttcaggagcttattttgagggatccttatgtggctgtttcatgaactcaccatcattttcccacatatacagactttcacacatagaattaggcttctcatagcaagcagctctggaataggcagacactgcccagagctcaatatggacaactgtgctcctgtcgagctctgcagggctcagaatcagtcccactgcycctcacccgcacacttgccggctggttattttgtaccgatgttacacatagagtcatatctctccactgttctagagggaaagcttactacaatatttcccttggaagaaagagatacagtgacctacagagactctttccttgctagaaggacagatattttgtttttttaggcaagtctgttagggtggctttaggagccatgtgtagtaggaaaatttttaaattttaacatgtgaaaagtagaaaataataaataataaaatgttaccattagggtagatgttgccttgtcccctaaccccactccctccttggaaactcatcttttcttggatttggagtgcatcctggaagtttgtgtttttattcttttactacaagtttaagtaaacaactgtagtagtgtgcgtgtgtgtgtgtgtgtgtgtgtgtgtgtgtgtatrtatatatatatrtatatataattttttgttgttgtttatttcttttgagacagagtcttgctctgtcgcccaggctggaatgtagtggtgcaatcttggttcactgcaacctccgcctcctgggttcaagtgattctcctgcctcagcctcccaagtagctgggactacaggtgcccgccaccatgcccagcaaatttttgtatttttagtagagattgggtttcatcatgttggccaggatggtctcgaactcctgacctcaggtgatcctcccaaagtgttgggattactggcgtgagccattgcgcccagccaagccttttaaagtatgtttatataaagtatcacaaattctttatgaaggtatgtttttagtagacttatttattgatatataaaatatgcacaagaagtgagtaaatcataagtgcacakttcgatacattttcaaaaagtagccaccactcagattaaaaaaaaattacttgtaccctagaaatcmcccttcttcttagtcactacttcccacagagttaaccattgccaagattagctttaatctttaaaaataacctgagattagctttgcctgttctgaaaatttacatgcatttaattagacgatatgcattatttggagtttgggagtcttcagttattgtgtatagcaggggcgggtttgttctcattgctgtatattttactgtacaaccgtgccactcagttattcattttactgatgacagagacttaattggttccagtttgggactcttaggaatagtgctgctgtgaacatttggcgatgtgtcccttgatgtacatatttgtgtatttctggtgggtatatactgaggaatggtatgtgtatggtcatagggtatatgtaccatcagctttagtaccagtagatactgccaaacgattgtccatattgagcatcttcttaatgctttttttgtgggggtgaagggggcagagtttcactcttattgcacaggctggagtgcaatggcacgatttctgctcactgcaacctccgcctcctgggttcaagcaattctcctgcctcagcctcctgagtagctgggattacaggcatgtgccaccacacctggctaattttatatttttagtagagacaaggtttctccatgttgatcaggctggtcttgaactcccgacttcaggtgatccgcctgccttagcctcccaaagtgctgggattatagatgtgagccaccatacctggcccctaatgctttttaagtcatcttacctatttcacatttccttgagaatagtgagtcacttaatatatttttgacaggttgaacaaggaagtttgttcctgggagataaaaaagcttgaggtcggccttgcgtggtggctcacacctataatcccaccactttgggaggtggaggtgggaggatcatttgaggacaagagttcaagactggcctggacaccatagtgagatcctgtctgtattaaaaaaaaaaaaaagtacggggccatttactttttctttcttcaaatgatgagtatcttgggagacctgtttgcttctcttgagccaggtcatcttggaaccatgtccacagagacaggtggacgtagcagccttagctcttactctgaaatgccccttctcatgggcgtcttgctagtccctgccaccacctccttgtcagccccagggacagcccttccattgcctgcagtgcagcccagctaagccaaactgatcacaaaagcaagattttactgaagaatcaggagagccaaagggcagcccacccagacagcgccagtcacagtttaccatgtaacacctggttcaggtcgagtgcagtggctcatgcctgtaatcacagccctttgggaggccnaggcaggaggatcacttgaggccagaagttcaagaccagcctggacaacatactgagaccccatctctacaaaaaatttaaaaattagctgggcttggtgtcatacgcttgtagtcctagctactgggaggctgaggtggaggattgcttgagcccaggaggtaaaggctgctgcaagccatgattgcrccactgcactccagccagggtgacagagtgagaccatgtcttaaaaaaagaaaaaaaaaaagacctgcttcactgttctttctcttcctcttaggcagcctctgtccctacccccaggctcctgccaatggaaatatctcctcctcatcagcrgcaggtcccattcctggcccatgggcctctctaaaggacaactctgtgtccctgccatgttgggatgaaacaaaatttcagcagctcctatatagctaacatgaatggttacctatataggagctactctcagtcagtagaggggagtccctcagtaaatgaaatttacagtggacttacataattggtgaacataggaggcttcaatgagagtcctcccaggggaggtcagcactgcttgtcccacatagaaatgattaacacaggctgggtgcagtggctgtcatctgtaatccctgcattttgggaggctgaagcaggaggatcgcatgggccctggagtttgagacgaacctgggcaacataaggagaccttgtctctacaaaaaataaaaaaaaaattacctggttgtggtggtgcacgcctgtggtcccagctactccagaggctgaagtgagaggatcgcttgcacgtgggaagtcaaggctgcagtgagctgtgatcacaccactgtgctccagcttgggtgacagaggagaccctgtctcaaaaaaaaggggtggggggaaactagtaacatggtgtcagtaccagggtggagtggcattgggtggtccctggcagggatgaggaagggaagctgccctggcaacatggctgggatgtggagctctcagtggccttagcataactttaatggtgttgcctttgccccctaagcttttcctgagggcctggaagtgtcatccagccccacctgatatacgccttttgtgtgtcactgaggaaagcagctgaagtgcccatggaggaagctcccagtggggaaggtttgaaagatgttggaatttgttaggaggacatgctgtatataaaggttacctttctcacttttttgctcctttgtcttttataacaaaaaggtgccattgttacatgaggtgaacagtgaagacgatgaaaatatttctcatcaagatgggtttccaggctcccctcctgcaccacagyggacacaacaaaaaggtagaaaaaaaaagccacaatttttataaaatataagaacattttttcataatgaatattgcttatttttaggaaaacatacccattgccccttcatgctgtagctctgtgattttaactaggaatataattgaaatttattttttattgaaaatgagggtccaggtgtggtggctcacgcctgtaatcctagcactttggaaggccaaggctggaggatcccttgagctcaagaatttgaaagcagcctgggcaacacagggagacatcgtctgtacaaaaagtaaaaataaaaacatcagccaggcaaggtggtgcacgcctacagtcccagctactcagaagggcgaggtgggaggatcacttgagctcggaaggtcagggctgcagcaagccatgattgcaccattgcattccagcctgggtgacagaatgagaccctgtctcaagaaaataaggctgggtgtggtggctcgctcctgtaatcccagtactttgggaggccaaggtgggtagatctcttgagcttaggagtttgagaccagcttgggcaacatagactctctctacaaaaaatggacatcccatctctaccagaatacaaaaaagtagccaggtatggtggcatgtacctgtggtcctagctagtcaggaggctgaggtgggaggattgcttgagccctggaggcagaggctgcagtgagctgagatcgcaccattgtaccccagcctgagtgacagagtgaaaccccatctcaaaaaaaaaggaaaagttattctgcagtcaattgcttctggatattaggttgtttttaaagtacaaggtgctgtttttttttgccatgttaactaggctggtcttgaactcctgggtttaagcaatagaggtagggataggatagggtctccctagtcccagtgcttggggaaagacctggcccacagtggcccactaggaaagatctgttgggtgaatgagtacgtggacatatatctatttgattatcccaatgagagaattcagcatgttataacaaaggtagggaaaagttttcagtttcctaagaggtggctcacatttgagaagtgacaaggagagccaggcatcaagtggacaaccaataactactttrtcagcagccctagagttgctcgggctcagggaaacgtttctgtaaatcatttctcagggaacacagaatgccagcctcataatcctggggccagaaaacacctgttggtcagttggcgtattttttaaatattagatttatgtaaaaggtgcatctctttttaaattacaaaagtaatactgtctcactgtaaaaaaaatacataaatatataaagtgcattagtccgttttcacgctgctgataaagacatacccaagactgggtaacttatcaagaaaaagaagtttaatggactcatagttccccgtggctggggaggcctcacagtcatggcagaaggtgaaaggcacatcttacatggaggcagacaagagagaatgagaaccaagagaaaggggtttccccttataaaaccatcagatttcatgagacttattcactaccacgagaacagtatgggggaaaccgccccatgattcaattatctcccactgggtccctccgacaatatgagggaattatgggagctacaattcaagatgagatgtgagtggggacasagccagaccatatcataaagctaaacacacttaattgtgctcccacagataagatttttaacaatttagagagtatatgtatataaagtgcatgctgttttgttacctttctttcatctcacaacacatgccaaatgtctttctatgtccccagatttggttctctcctgccttgtgtaacatctgcattgtgtggcctgatgtagcatatatcagtcaaggtccaatcaggagtcagaacacacacaatgacttgaagagggaaaatttactataaagaatgattaataataacaggtttgggagctgcgcatggtggctcacacctgtagtcccagctatgcaggaggctgagatgggaggatcacttgagcccaggaaggaggtcagggctgcagtgagatgtgatagtgccattgcactccagcctaggtgacagagtgagaccctgtctctaaaaataataataataataacaacaggattgcctactaaggagtaaagagaatactgaagaattcaggagtagcagctcaggggagcagccactgctcctagggctgatgcttcaggaggaagcagctctggaggagcctcagccagaacccaagatccacaccttcctggagaggatgtagctgtggcctgccgggtggccaagaagtttgctgaggggctgccctaatgaaactcactgggatagggggccaggagaagccaccatggggaggtactgcatgttgctggccacccaaaaaattaaagaaaggatctgcgcatgaaatcccatttgtaatcccagctccttgggaggccaaggcgggaagattacttgagcctgggagttcgaatccagcctgggtaatatagtgagacccttggactctaaaaccagaaattaaaaaaagaaattaatgcatggaaggaagagccagaggaagctggaatcagaaagcaaagccccagctcctccagcgtctctccagcaccctctacagaggaagccttccatggtaccaactggctgggtggaaatgctgcagtaacatgagctggccatgaaggtggatttggagatgagaggccrtggccacccacatacttgggaacgtgcacctggcacacaggtggtggttgggagggattgcagctcctgcagtgatgcctggtttgtggtgggcattaaaagyccctgcatacttctgaaaaaccccagaccccaaactgtaatttagtggctcagggctgggcccagaggtctgtactttttttttttttttttttttgaaacatagtttcactcttgttgcccaggctggagtgcagtggcgcgatcttggctcactgcaacctccgcctcctgggttcaagccattctcctgcctcagcctcctgagtagctgggattacaggcatgcaccaccacacctggctaattttgtatttttagtagagacagggtttctctgtgttggtcagactggtctcgaagggtctgtacttttcacaagtacacagaggagtctgttgtgggtgatccttggacaacacatgaggaaccctggcttttggtggtttggtccttgactctgtcgtttctaggcatggctaacttacttacctcattttctcctcaatctagagtgtctgtctcataaatgaagtgacaatgtaaagtgcagtggcttccatcagtgctagtgatgattagtgtctaaagcctgaagctttcatcacctggtgcatccctctgcactctagcgagacctctgccaagaagaccaaacacactttgggcaaggcccttgtaccgttggtcagagctgccaaattcatgctcgtggacgctgttcccctttcctagattctctgcagacccttctttgatcccacagtcccctcttgctagtacttcctccttcttctccttaacagctttgtcaagtgatacacctctccaggccttctccctctccatgtctcctcatacctctccagcttggcttccctccccatcgcaccactggaccagagaccttcatgtagttaagtgcactggatggttttctggcttcatctgatgatgtctcaggagcataccacgtggttaacataccttctccctgggctcaggacatctcgtttcctcctgccttcctgggcatccacccgtcatctcctcagtctaggccctttactcttcgaagcactcacagcctgctccccagtttgctatcattcgttgtgtgctgcgcccaggtttcctttcgcagcttctatgccatgtaaccatttgacttcattcattcatcccctcagtcagaagaagagttttttttttttttttttacagggtctcactctgttgcccaggctggagtacagtgttatgatcatggcttactgcaacctcaacctgggttcagttgatcctcccacctcagcctcctgaatagctgggactacaggtgtgcatcatcatgcctggctaatttttgtattttgttagacacagggttttactatgttgcccaggctggtcttgaactcctgggctcaaacatttgacctgccttggcctcccaaagtgctgggattacaggcatgagacacctcatctggcccagagccatcttttcaaagcacaaagctggtagtgtccccttgcacgtccacggacccccacatgcgtcccttcacacccccacataccccagacccttttaaattggatctcttccatggtgtcccaccatctgcttggcctgccagcccctgctgactgctttccagctactctgctgttcttttatttcctcaactctgtggtgttccttcctgccactggacctgtgcacatgctactctccctccccactacctaatgtctcttatatgtaggcatgtgaaacgtggtgagttgtggggtttgactttttttttttgagacaggatcttgctctgccacccaggctggaatacagtggtgtgatcatagctcactgcagcctctacctcctgggcttaaaccatcctcccatctcngcttcccgcagtgttgggattacaggcatgagccactacatccttatatgctcaaatatatctgaaaagaaccatacccagttgataaccatggttacctctggagaggggaaggtttcgagggattatggtcatgggtgaattttgatttatctgtgtcattaaaatttttgacagcaagaatgtgttcatgtcatgtgaattttctttctataaagattggaatagggccaggcacagtggctcaggcctatgatcccaggactttaggaggctaaagcaggaggattgctcgagcccaggaatttgagaccagcctgggcaacacagggagaccccgtttctacaaaaatgtaaaaaattagccggcataatggcacacacctgtagacccagctactctggaggctgaggcaggaagatcacttgagcctggcagctggaggctgaggcaggaagatcacttgagcccggcagctggaggctgaggcaggaagatcatctgagcccagcagctggaggctgaggcaggaagatcatctgagcctggcagctggaggctgaggcaggaagatcgcttgagcycggcaggttgaggctgcagtgcagtttccaccactgcacttcagcctgggtgacagagtgagaccctgtctcaaaaaaaaaaaaaaaaaagactgggatagacccagcatgacaccttgtatgcagcaggagtatgcccagtattgaagccttttgctgttattttatgtctatccccctcacccatataggtaatagaaatgaggagggtgaggactctggaaatctttttgagaaatgataaataagaacacaggacacaaagtagattcacagaaccaagtgaactgygtgtacattaaatgtacattaaatacaacatgaatttgggatgctgtaaattgtaagtttaatctttatgagactctttttctgaaaagttcatgactaagataaaatagcatgatttcctttgggaaaattgaattgccccttaaaaactttttattgtgatcatttttaatgtgtacaaaagtagagagactagtaaaatgaactcccacttgtccacctatgcatctccccacttctatagctgtcaacaattttcttatttttttgaggcggggtcgctcttgttgtccaggctggagtgtggtggcgtgatctcagctcactgcaacctttgcctgccaggcttgagtgattcttctgcctcagcctcccgagtagctgggactgcaggtgtgttccactgcacccgactaatttggtattttttgtagagacggggttttgctctgttgcccaggctggtctcaaactcccgggctcaaccgatctacctgcctcggcctcccaaagtgctggggttacaggcatgtgccagtgtgcccgaccagctgtcaaccttttgccattctatttcatgtaactccctgctcccccaattttattttgtgaagaatttaagggggacatagaagactccattaaatatgaaagcagtcagatctgaggtagcattgtgtgataccaaatcaagactattgtaaaggtgttattaaaaatatatattttttcttattgtatcactttaaacatttgctcattggaaatttgttcagtgccagccgtgtgtcagagatgatagagccacaggcctttcccctcgcatcccagctgcagaggaggagntgcagattgcaaaccgtagtctggggtgctaaggtgggcagtagaggtggttgtctctcagttagggaaggtggtagggaaaggagggttcatcaagctgaactcagaaggacagggcaggatttcacctggtgtccaacgcaggagagcagtccaggctgcccctggacatttgactgaaagcagtttggttaaaaacagttgatcaagatgactttggccaaaaatgagctcttcagtgacgagttgctcaatgcatcagggagtagatttattatttatttacttatttctttttttgagatggagtcttgctctgttgcgcaggctggagtgtcatgttacagtcttggctcactgcaacctctgcctcccaaactcaagcaattctcctgcctcagccgcccaagtagctgggattacaggcaagtgccaccatgcccggctaatttttgtgtttttagtagagatggggtttcactatgttggmcaggctagtcttgaactcctgacctcaagtgatccatccacctcagcctcccaaagtgctgggattacaggcatgagccaccgtgcccaaccaggaagtagatttagaatcttgtatgtatctctagcattttcttctgttgtctgaattttgtagggttttttcacctattttttgcatgtgtttccagtttattttcagctggttatttctgctctgcaaattaatagtagaaagttaaaagcaactcagggccaggcacagtggctcacgcctgtaatccctgcaccttgggaggccgaggcaggtggattatctgaggtcaggagttcaagaccagcctggccaacgtgggggaaccctgtctctactaaaaatacaaaaattagctgggtgtcgtggcrcatgcctgtaatcccagctacttgggaggctgaggcaggagaatcatttgaacctgggaggcggagggtgcagtgagccaagattgcaccattgtactccacctgagggacagagtgagactccgtctcaaaaaaaaaaaaaagcaactcgatgtccaactttttacaacatgaatgtgtacaggcaaactggggtgtaagatcacctgcttcctagggtacctggattacagatgtgtggaagatgagtaagtgggtgagatttgttttcctctctgtcgttgagacagtttgcttcaaggaacaactatttttctgaccaggttggatgatgcatctagggagggtaggccaataggagtatgcgttggcccatccagggagtggtgggcaagatgtgtggagcgtgatggggaggagtattggaaggagaggaggagcccggcatgggaagatgtgtggagcgtgatggggaggagtgttggaaggagaggaggagcccggcatgggaagatgtgtagagcgtgatggggaggagtgttggaaggagaggaggagcccggcatgggaagatgtgtggagagtgatggggaggggtgttggaaggagaggaggagcccggcatgggaagatgtgtagagcrtgatggggaggagtgttggaaggagaggaggagcccggcatgggaagatgtgtggagagtgatggggaggggtgttggaaggagaggagaagcctggcatgggaagggcttggagacactgaagagtttggctttggttctgcagccacgtgagccacggatggtggtcaggcatgggtatgggagagagatgacaatttagagtcaggccccagcctggctctgggacccacttgccctgtgaccctgtgaattttatccctgttctgggccttgtcgagctcctctgtagaaggtgaatttctatgattgtactttctgagttgtcatatttcattatctactttaaaagtttctctctctctctttttcttcatcagatggtaaacaccctgttctgaatttaaaggtaagatcattttttttaaaaactgattttctcaataaatagagtttttatcataatttttcataaattttcaacaactttggtgttgaaactttggcggtgattttggggcaaaaataaatcttcccttaagagttctttcctgttgaatatttcttttaaatgcttttttttttttttgagaagggggtctcactgtcacccagactggagtgcagtggcgcaatctcagctcactgcggtctccgtcttccaggctcaagcgatcctcccacctcagcctcccgagtagctgggatcgcagatgcatgccaccacacccagctaatttgttgtatttttgataaagatggggtttcaccatattacccaggctggtctcaaactcctgagctcaagtgatctgcccatctcgacctcccaaaatgctgggattacaggcatgagccactgtgcctggccttaaatacttttaaaacatgaggaaattgatattttccatagtttaatgatgaaagtaatgtattaaagggttagaaactactttataattaaaatgaatgtggaatgaatagacaattttatcttttgttaaaattattttttgagacaggatctccctctgtgacccgggctggagtgcagtggtgtgatcatagctcactgtagcctcaatctcctgggatcaagtgattcttttgcctcagtctcctgagtagctgggactacaggcacatgccaccactcctggctaattaaaaaaaaatttttttttagagwtggggtcttgttatgttgcccaggatggtctcaagctcctgggctcaagcgatcctcctgccttggcctcccaagggcattgggattgcaggcatgatgtgacgtgcctagcctgagatatttttctgagatggagtcttgctctgtcacccagactggagtgcagtggcgcagtctcggctcactgcaacctccgcctcctggattcaagtgattctcctgcctcatcctcccgagtagctaggaccacaggtgcatgccaccatgcccagctaatttttgtatttttaatggagatgagatttcaccatgttggccagtctggtctcagactcctgacctcaggcgatcccacctgcctcgggctcctaaagtgctgggattacgggtgtgagccaccacacctggcctggcctgagaattttaataactaatttgcaaacatggaaatagttctaacttaagtttttcattgtgcgatgtcataggaacttaaaaattaaacatttctctgcagagttaatttataaccttgtctactttgtcagcagaaattagaaacttaatatcacaccaccatgtaaggaaaaattaacaaaagttcacagccttccctttcctctaggtttggggttgagaagcaatatcttactgttcctttctcagcattttgcaaatgtgcttccctgcagttgatggggtcctttttgcccatcccagtgagaagaggcctggctggagtttgctgagggcatctctgctcagcacttgcagccctacctagcacatgcttttcaacgtgagcccacagcccgctactcacgggatctacctgtaaggacagtcactgaactcagtgcagaaaggcaggaagaaagctcaggcaggacttcctttatagcctcagagagcccaccagaggggaagacacttaaggtctcagattcaggtataagaaacagtgtaatcccagcatgttgggagaccaaggtaggaggatcccttgagcccaggagctcaaggctagcctggacaacaggagaccccatctctacaaaaaaaaaaaaaaaaattaggtgtgatggcccatgtgtaatcccagctacttgggaggctgaggtaggaggatttcatgagcccaggagttggaggctgcagtgagctgcgatcacaccactgcaccctagcctgggtgacagagtaagaccctgtcttaaaaaaggaaaaaaagaaatagtacatattaaagttttgaaagctaaaacaaacaaagaacaagagtcaaaatgaaggaaataaagcatgcttatatacctgctgtctaatgacctagctgcgtgtgtccactttataaaacactaatgctctgcacttattcctcttatgttctttctttcctaggatgaaaaacctccattatgtgagaaacctccaccctccccaggtatttgccttttgaattatattatgattgaaaagcttgttttggagaatatccagattaattttatctgaaaataaagattacattttctttttcttgtattagttgttgaantttcacccttgcctcaaaagagagggtccaaacactaggtagtggacgtatgtccatacaggatgtgcttggrtcctgggagggtgggggttggacctggggggacgtggacctgtgggatatgctgggatcctgggggaagggaggtggacctgtgggatgtaatgggatcctgggggtggaaggaggacctgtgggatgtgctgggatcccagtgggaggagtggacccatgatgtactgggatccgtactgggnaggcaggtgcagttatgggctctgctctgaggctgaaggcagagggagaggtctagagatgctttatgggttatgccccctgaacagtttggggagcttcagtggcttccaaaatggaggttataatttttgctgttaggtcccacattgttacaagatctttggggtgtcgcttttctggtcggaaatgtctgtggtgccagtgtgcctttgcctgagttcttgtcctgcgtccaggaagaatgaggtaagcagacaagtggagggtgagcaagacgaagaggagctttactgcatgttagaacagttcagaggagacccacagtgggtagctcctctctgtaggcaggtcgtcccgttaagtgttcagctctcagcagagaggaggtcccctggagtcgatggctcctctctgaaggcaggtcacccaactgtctctgcagctctcagcaaagaggaagccctggagagggttgttcttctctgcagctggttattctgaccagctcctagtagagaggaggccctggagtgggttgctcctctctgctgctggtcctctgacatctccagctatcagcagagaggggaactcctctctgcagctggtcatctcatctgctctgctccaactaagcccagggcttttatgggcctcagaagggaggaagtgcgcaccgattggtccatgggtggccatgggtgggcctggaaaaggcaccataagttcctactgcagtcccacgggacaggcaacccggtccccagccttcaggccctctccgacctgaaggcggggcctcaccggggacctgcctgcttctgcccaggaacctgtctccctcctgctgcccagtmcatggcacccaggctgctcacaccaaggggcaactgcaggccagtgcagagccatcctcagcacccccttgtctttccctcctgtgctcatgggtgcccaaagtctggagggggctgaggcggcagggcgctgtcgtgtcagtactgccctgagtatgcacactcccagccaggctgtgacagtgcccaggcttggcctaaaycccgctccaaccctgctgcaagactggagcaggcaccaggagcagggagagaccaggcagctagagcaaacacccataagcctgcggggacacgggagccttcccaggcccccgagggtgcagactgcagagacacccaggtcctacacatgggagggcaactgtagcagcaccccatgagctcctgccccaccaactcagaaggggcagggctcccgcttgtccccggctcctgatggctctgtggagcatgcagccctgaccatacctctggagcaggtgcccacagtggggtgaagccaggcagtgggatcaggcacttcggagcctatggtgggtggtgggcgccttcttgggcccccaagaacacagagattctcgggtctgcagccgggcttgggcagctgcagcagcacccagggagggccggggctcctgcctgctccatggagcaagaggcttgggccacacctccctgctctagagtctgtgcggtggccactctagatgggccactgctgccatcagtgtcactgctctgaaaatcctggtttaagtctcctccgcgtcagattaactttatttgcaccctttcaatctcagcattttcaatgctgtattctgggcgattgctggggctccaacttctgcgccatgcattcatttttcatgatgtgtatcctgcggctcagcccatcctttcagtttatggtgttaatcaaacgttaacttccatgatttctgtgacactgactacgtctctctgaaagttgtaaccatgcgcatccagtcttagggtttgtgttgcagccccttctcttctctcacttgccattggtgttctctggctctgctgtttgatacctcttggggtctctgagattccctgtggcccacatggggatgctacctctgtttactgcaccctgcctgaagagggagagccagcaggctgccaggctgtaccgactgctgcctccagcaactgatggggatggacaggatgtgaggcccaccgggatccgtggggacccctcttcctcctggctttctccagccccctgccctgcctttctgccctcagggcctgtgtgttctgcctgaggaggggcacacatttctgctgttgctgcctgggtcaggtgggttaaccccttgctattcccactctggttatctaactcaacagctcatcagctgcttcaagctgcttctttttaaatataattttatttattgattgatttttgtagagatgggctcttgctatgttgctcaggccggtctcgaactcctggcctcaagcaagcttcctgcctcagcttcccaaagtgctgggattgyaggtgcgagccaccaggcccagcctcatcagctctttctaggccactttgtgtctccactcctaccagggcaaggtgtatccctggagccacccctccccattttctagctgccctctcttggcacatttcaggcttggcacccatcttcattctcatctcaactgttttatctctgggatttctcagggttcccttgtttctatgtagctgtggagtttcccatttctgagcctcaccttttgcatgttagggattggatatgtgtgtgtcagaggttgggccaggctctctggagccaccagccatcctgccctcgtctgtgtggaagctctgcttccgcctctccctcccctgggaggtgcgctggccagggcccatgggagcctcacctcctgtgacctttcggagcacatctccccgtggaacagcgctggtttccaccccactttcttgctcttccttcttaaggtcctatgtgacctcggttttctcctcaccctggtgccttcaggtgctgcccacaggccagtggctcgtcagtctccccagcagaggctgccctgggactctgggcctctgtaccaacccaagcctgcctctcctcatcttccatccccacctgctcttcacagtgtgctcctcatctgggggagcatctgccagacacagacctgggtggtcatcctgggtctgcttctctctcactgcccgcacccagccagccaccagcccctgagtcctgctctcatgtgtccttttctctgtgtccccactctagtgctgcccctcagctgttgggctaggcctcattctaacctgccttcttccctgctggcctgagggattcacccaagagcagagcctcttccttctcacacctttgcttgaaagccctgctggctcctgctgccctgcaagatgaactttccatgccacatcacaataggcacggcctcctgcagctctggcctccctttctggcctcccctcagtacctctcttcctgccacccgctgtgacttcatcaggccacttactgtttcctgtagaagccattcccttcccagggaccaaagaacatggcaccaggcctgatgtggtttttggaacaaagtcagttgattttgatgtaacattgtcaacatcaattaacattgtaaaattttcccctgaaccctttcagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaaggtggggacagacagagtgcctttattagaggaatgagcaggacttcactcaattattttgagagttaatattttatgttgtgatatttgtgttggtaatttatgttgtaatatttcaggtttttttgttaatatccttatgtttgttgagatttgatttcatctgctatatcattattacactaaagaaattcctcaggttggaaagaagctgaatttacaaaaacaaaacagagattccaatacttcttttggaacttgatgcttagcttacatatatttcacttcagtttttatccctaagagaagcataaaaaagctcctcctttaccgtagacttaccaatgattatattttccttgctacttttataggttaaaaaaagaatagtattttaatttgtatttctgttattattgaacttgaatattttttcatatctttgcaagtcattttctttttctttcataaagctgcccactttatttatttattttttagagacagcatcccactcttgtcacctaggttggactacagtggggtggtcagagctcactataaccttgaactcctgggctcaagtgatccttccacctcagcctcctgagtagctgggactaaaggcaaacgccatcatgcctggctaagttttttttttttttaattttttttatagcagtgaggcctcattgtgttgcccaggctggtctcaaactcctggcctcaaggatttttcctccttggccacttaaagcactgggattttagatatgagccactatcatggccaagttgcccactttacaatgagacacttgacttctttttattgatttgcaggaactccttacrtatgaaagattttatccctttgtcataggtgtaatattttcttagtttgttgataattgggctaaatcaataaaatgtttttcttttatgacttacactcttggtattaagtcatttttaactctaaggttatataaatattcaccaatattttctctatacctttttctatttatataaaactaatatagctttaagtaaggtggtgtcagtttttttcacatagaccctgcataattcttatcttaggcacatttatttttagatactatatattatttgtgctgttaccttgtgggatctattttctgttttgttttctaataggacattgctattatgtgggaaggttattagctctaatacattttccatgtattctatatgatttttctctttctttttttttttttgtgagatggagtctccctctgttgcccaggctggagtgcagtggcgtgatttcggctcactgcgagctccaccccctgggttcacgccattctcctgcctcagcctcccaagtagctgggaatataggcgcccgccattacgcccggctaattttttgtatatttagtagagacggggtttcaccgtgttagccaggatggtctcgatctcctcacctcgtgatccacccgcctcggcctcccaaagtgctgggattacaggcgtgagccaccgcacccggcctctgtatgatttttcaaagcacatattcttatgtcatctgaaacaatgactattcctttccaacttgaaatttttattttactttattgtacatgcaaaaacttccacaaactttcaatataacgttaactattcagtgttaaaaaacgttgtaacttttattcattcacacacacagacacacatacacacacagacacacacgcacacacagttcattgcctctgagcgtgaaagaggggagaaaagcaaacgatttgcaatttaataaaatctggataaattggatgttatttcttatagtataatattaaatttttttccctagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagaggtaacgtttccgattgtgaaaatcagcttttcagatttttaagcctttactgttgaattgatttccaatcttgagaggttcttatttattataatttgatgtaagaaaagctctgtccaaggcacaatgtttctaaggaccattctgtttcttgcctccttcccttccttcttccccgtaataaaggcaataaagactgtwaaacattgggacaatacagaagtgtacaaagtaaaagaggccggatgaggtggcttgtgcctataatcccagcactttcagaggctgaggcgggagaattgcttgagctctggagtttgagaccatcctgggggacatggcgagacagtctctacaaataaaaaatttaaaaaaattagctgagcatggtggcgcatgcctgtagccccagctactcaggaggctgaggcaagaggatctcttgagcatgggaggtcaagggtgyggtgagctgagattgcgccactacactccagcctgggtgacagagcaagaccctgtctcaaaaattaaaaaaaaaataacaaaagtaaaagaatgaaagtgtatgtcggctgctcccttctcagtcacgttcctgaaagttgcagctgttgtcagtgcattaacttcgaaaggaaagcagagttttcagttctaagaacagttgcagagtccaactccacacactctcactgagcaggtcactgcatgagatgccgggaggagtgccagatgaaccgatgctcaggtccttactcttacagaacttggggctgtgaagatgtgagtgacactgtggacacaggagagggaggcaccgctggctgggctcttgctggggtaganggcgggaaggcacacggtgttctcccatggctcctgggagttcaggcctcatgggcttctgagttgctttttgaaggagggcttacgtttcactttttttttttaataacagctttgaaatataattcacataccatccaatttatacccattttaaaagtgtaccatttagtggtttttattgtagtcacagaattatgcaaccatcaccacagtcaattttagagcacttttgttaaatcaagaaatgttggctgggcatggtggctcacacctgtaatcccagcactttgggaggctgaggtgggcggatcagttgaagtcaggcrtttgagaccagcctgaccaacatggtgaattcccatctatgctaaaaatacaaaaaaattagccaggcatggtcgtgcgcacctgtaatcccagctacctgggaggctgaggcaggagaatcgcttgaacctgggaggcagaggttgcagtgagccaagatcatgccactgcactccagcctgggtgacagagagagtgagactctgtctcaaaaaaaaaaaaaaaaaaggaaaaaaaaggaagtgtcatacctgttgggaatcactccctatgttcccctgctgcccaattcctccagctcagcccctggtaaccactaatctattttctgtctctatgaacttgtctgttctgaacatttcatagaaatgaaatcatacaagacatgactttgtgtgactgacttctttcacttaacataatactaacttttaaacaaaaacaaataaagttcttagggtcctataattcaaaacctgcttgctaggtcagggccttctgcaggaccatggggcgggcagacaggcccagggacagccttctcccatgttgtcttctgccctgtgcaaatgccatgttctccaagacagtcttccctgatcaccccagccagaagtgattgatctctctctctctttttttttttttagacacagtctctctatgtcgcccaggctggagtgcagcatgyacaatctcagctcactgcaatctctacctcccgggttcaagtgattcttgtttctcagcctcctgagtggctgggattccaggcgtgttccactgcgcccagctaatttttgtatttttagtagagatagggtttcaccatgttggccaggttggtctcaaactcctcacctcaaatgatccaccctcctcagcctcccaaagtgctgggattacaggcatgaaccaccatgcccggccctctctctcttttaaaccattgcagacttttgtttgtaatcactcttaaggcacttatagcattctaccctatactgtttttgtatatcacgtacatttgtgttagtggattttatttctgttactaggtcatagaatccttgaaaacaagggttgcgttgcagtgtccataatgacttagtgagttgccaatgtttgcagagtgagtgagtaattacatagatattaaggtgttcacattgtaaagcttttgtgaaataaataattattttgtctaggccattgattctgtactagattttccctcctaatctaaacaaatagaaaaccagacagaatatgtaatgcaaatgtttacagatgtcgaacagcaggcagcaccagcctatgaccctcaagagtagcaggataaatagatgagcctgtgatctgctttctgtctggaggcagtctcagatcacagagcagggaggaagggcctgagctgagcccttccctgagttcaacagagatgagagtctggggaagctgaggagactagaattcgtagggcaagaataccagaaagaatggagtcctggagagaaagagctacttatataaatctgcatggggctccttggagtcttgtggaataccaccctgcacatgtgtaggatgagactgcaagatactgggcagaaaataagaacagggagctgtgagctgcatggttcccagagctcacacagcaccgggaaccttcgagttctgcccagccacaatggagagaccttgcattgagtcaagagcccaggagggccgtgcctgagatgtatggctaaaagagctttttaggaaaggttactacagacctaccatgaccagggtgaaaaaacaagcctcagaagcatgaaggtgatccacaagcaacttaggagttgaaagaaaaagagagagagagagaggagggaggaaggaagggcggaaggaaaagaaaccagtactctttaaaggaagataacaaaatccagacactcaacaatgtgacattaaaaagttccatatccagtgaaaacagtcactagatatgttctagattttaaaagactaaaaagggctggaggccaggtgcagtgactcacacctataatcccagcactttgggaggctgaggtgggcagatcacttgaggtcaggagttcgagaccagcctggccaatatggtgaaacctcgcctctactaaaaatacaaaaattaaccaggtgtggtggcacacacctgtagtcccagctactcgggaggctgaggcatgagaattgcttgaacctgggaggcagatgttacagtgagccgagatcataccactgtactccagcctgtgcgacagagcgagactgtctcaaaaaaaaaaaaaaaagaaaaaaaaaaaaaagccaagtgtgctggctcacacttgcaatcccagcactgtgtgaagctgaggcaggaggatcacttcaggccaggagttcaagaccagcctgggcaacatggtgaaaccccatttctacaaaaaatacaaaaattagccaggtgtggtggcatgcacttgtagtctgagctgctcaggaggctgaggtgagaggattgcttgagcccagaaggcagaagttkcagtgagccatgatctcaccactgcrctccagccygggtgatggaatgagaccctgtctcagaaggaaaaaaaaaggacataaaagacttgacagctaaatgcaacatgtgaccctgaattggatccttgattagaaaagaacattagtgggaaaatagatgaaatttgaagataacatataggttaggttaggttaaaaaatagtattataggctactctaggcacactgcctatggggtacccctgctctgcaaggagcagtaatatatatatatatatgaaaatagtattgttatctgtgttgatttcctgattttcatgacagtactgtggttaagtaaatgaatgtttttgtttttaggaaatacaagtatttagaggaaaaggggcattatatctgcaaattactctmaaacatttcagaaaaaatatttctctcatatatacatatatacatatagatagatagatgggtaggtgtatgggaaagtggatggatggatggatggatggatagatggatggatggatggatggatggatggatgggtaggtgggtaggtgggtgggtaggcagatggatagacagataaatgcatagatgggcaatgcccagtctagattaagaatatctaagacttgaaaattcagaggaagtgtggtttaacttgtcttcaatacatgttttgttcttagagcttaaatattgaaggcctcccatccaagggccctataccaccctggttggtaagtgaaagttatttaatttcaggcccatattttcagggtatatttgcatagctattaaaaaccatttcaggccaggcgcggtggctcatgtctgtaatcccagcactttggaaggctgaggcgggtggatcagttgaggtcaagggttcaagaccagcctggccaacatggtgaaaccctgtctctactaaaaatacaaaaattagctgggcgtgatggtgcatgcctatagtcccagctacttgggaggctgaggcaggagaatcgcttgaacccgggaggtttaggttgcagtgagctgagatcgtgccactgcacgcgagcctgggcggcagagtgggaatggcttcgggcaacggagctcattctgaccgcaggaggtcaagcctgtgcgggtgttgtagatgcctcctgtgcctcctgcatgcctctgggttcctcatttaagtggccatatagatccctgaaattggaaggatccaaggagagaaatgttggttgttctgggatcctgagctgggagggtcsttaaaaaacaataacaactgcaaccaaagaaaccatttcaaaaaagtataacttcttgccatttaaaaattttctggttgtgtttagatgtaagaaatatattaaccttcctttactctctatcttcagttggatataaagtacctgtcaccattgttgctggcttatgaagatatgatgaaagagaaggacgagctcaatgccaccctcaaggtaggctggcaaatgtcccagaagacacaagatttataaaaatataggaccgcttcaaattttataaaaacattttgaatgtaggtatacccagcatattatagataaccaaatgtttattagaggacagaaaggaggaaggaaggagtgtggcagggtgggaggcagggaaagaaggaagaggggaggaagtaagggagtgattggcagagcaggaggggtggatagggagcgaggggagaggtatggagggtcagagcagtgctgcatgagaagccatggctttctggacagccagcccatatgggctgagatcttggggtgcagggaagacagcaggggggaagtgcttctttcctgttactgtgcagctgcaaataccaccattagaagggacatttgggctgggcgcggtggctcacgcctgtaatctcagcactttgggaggccgaggtgggtggatcacatgaggtcaggagttcaagaccagcctggtcaacatggtgaaaccccgtctctactaaaaatacaaaaattagctggtgtggtggcacgtacctgtaattccagctactcrggaggctgaggcaggagaatagcttgaaccagggagctggacgttgcagtgagccgagattgcatcactgcactccagcctggcgatggggccagactccgtctcrraaaaaaaaaaaaaaaaaaagggctatttgggcagacatgggaaggaaaggctggagatgttttgggcaaacttagatgcttcttaattctaggatgagctgaccccagggaagtctgattgctgagctgttggaaatggagaagtgaggtttttatccatttctgccttgtccaccgccgttttgtgggaatgacttcgcgcagcggagctcgttctaacttcaggaggccaagcctgtgtaggtgttgtagatgcctcctgtgcctcctgcattcctctgggttcctcatttaagtgtccatatagatccctgaaattggaaggatccagcgaaagaaatgttggttgttctgggatcctgagctgggagggtcctttaagaggctcccagcttgttcctaatcagtgatgctgtcccgtgtccatgtcccatggaaaggaattttaatccttttcatttagactgagtgttggatgcttaattttctaagagcatgaatgaatcttgtactaattgaatatataacaatcctaatagctaataatattatttttttggtgctccttctaagtcagggtcagcacagactttctgtcaagggccagttaataagcactttaggctttggaggccatgcagtttctgtttgcacctgctcagccctgctgttgcaacatgaaagcagatgaggataacatgtaaataatgggcgaggcccattattttatttataaataaataaaactttatttataaaaacaggcagctggtttgcacactttagtttgcctgacccctgttccaaaaaagagtcacatggactgccagcagtgagtgagtgtgtctgggtggagagatgagaggagaagttacttggcagtgctgctttaagttaaaagggtgtaggcataaacacctgacagctgggagtagaatattttacaggcacaccagagtaaatattggcacctcagattctcaccaaaggacagcgcaggacacggaagctggaaaagccctgatggaggaggctcagctgaagtgtcacacacacagactgttgggagctgaaacagacatagactgttaggcatcaaaaccggcccagcgacagacctcgtgttgtggctaatggccagtgaagctctgcagactgatgacgctagtaagacactttctcatggttgtcatggacaaaactaagagccttggctggatgtggtgactcatgactgtaatcccagcattttgggagtctgaggcaggaagattccttgagcctaggagttcaagagcagccttgagtaacatggcgaaacctcgtctatacacaaaatacaaaaattagccaggcatagtagtacaggtacttgggaagctgaggtgggaggatcgcttgagcctaggaggttgaggctgcagtgagctgtgattgcagtactgtactctagcctgggtgacagagcgagaccctgtctcaaaaaaaaaaaaaaaaaaagagcttcctccaactcccacactaactaaccccttccccaccaaatctagctttaattaaggatgaaaagtcttattttttatattaaaaacctccaatttattctcctgcatcttcaaacaaaggaaaaatgtcagcgttgatgggcatctctgccttttctatcagtattcggcagttatagaacaatgttagcaaattaggaatctaatactcgaaagcccaggttctttgcctcttgtacttggccttgcatttggtcctagtgctttctcactagaccgtaagctccctgagagcaggcaccactggtgctggtaccgagagttgaaggctggcctgttgtgagaccttgctaaatggctgttaccatttgattttagccacagcagcagcaccagaactgagaaatatagatgcgtgggtatgtgtgtgttataatttacgtacattttatttcaggaggaaatgagaatgtttaggatgcgagnccaagaagtggtgaaagaaaatgaagaattgcaccaagagttaaataagagtagtgctgttaccagtgaggaatggcaagtggcattgtgtttctgctcttttgctaatttaaaacaaatggtaacaggaaaatatgttataaaattatcaaatacataattacattcttaactaaaayattttacgrgagagtttctaagaaattaataaggtacaataaaaccctaataaattattctaaacttacattttcaagatgacttttaaaattctaagtaggttctcaaacctgaaatacagttgctttctgctttttattttctgagttggtatttttctagggtgatttttccatctcagacctggagagtctsgtcccttcttaggccccagcgatggctcccagggtttcagaacagaaagctcaaaatggcctcccaaaacagaaagctcatgaggcttgcacgaccagcttccatccgcctgccctggcagattccctgacaactgaggttgccccacttccaatctgtccttcctccgaaagccccttctgcactcctcatcctctagggtcctactgtaatggcacttgtctatagcactgccttcaggagaggccattattgctcccttgtctctgtttcttttctttttttttttttgagacagagtcttgctgtgttggccaggctggagtgcaacggtgtgatctcggctcactgcaacctctgcttcctggattcaagcgattctcctgcctcagcctcctgagtagctgggattacaggcacgtgccaccacrcctggctaatttttgtatttttagtagagatggggtttcaccatgttggccaggctggtctcgaacttctgacctcatgtgatctgcccaccttggcctcccaaagtgctgggattataggcgtgagccactgcgcctggcgtctctgtttcttatgtttttttagagttagggtctcactctgtcacccaggctggagtgcagtggctcagtcatacctcactgcagcctcaacctcctgggctaaagccatcctcccacctcagcctcccaagtagctgggactacaggtgtgtgctaccatgcccagccattttttaaaattttttgtagatacagagtctcactgggttacccaagctggtctsgaactcttgggctccagtgatcctcccgtcttggcctcccaaagtgctgggattgcaggctggagccactgcacccggcccctttgtctccggttctgatgtagccttaaacacatgccctgtcccggtacctgccacactgcgcctgcctatcctgtctgcctccacatctgcctccatcttctcctttgtgaactcctcaggggcaggaaccaatgtcctgctcatttttgtgtgtggcccngcatctagcacagcaacagcaaatgcctgttaactgaattagagaaagtacatgtcttgaaaagcctaaaagcaatatccaggcaggactaagaaaacaaaaattactcactttgaatagctatgttatatttagtgttttcaaatgtcttaayatcactggaaaaaatgaagtattttctatatgtgatgtttagaaatctggaattgagtcaacagcattcttaccattggctytccctgattttgtggtcaccgatgngtcaggtgggactggctcaggcagctcctgggtcttggtgctctgtgacctccctggctgagcttggattttcttccttcagggttcctagtgtgtctcccctcgcaccctccttgaacagtggactggaaagcagcttagccaggctggggctcaagagaccttggcagattctggaaccccagattccttccctagcattgtatacagccacaaatccaacttgtctgcgtttccttaaaataaaaccagtgaaagaaaggaaagaaaggcaggccctgctttcaaatccacagccccgcagtgttccccaatcctgcatttgttgggatttgaaatctgccctttgctccagtgtgatggcccacgccagcatggggagagtgtcaggcttgctcagggcctccctggccgccagcctcttactttgaattcactgccctccagctgcaggagggtctctgggctctggagcatcacacttggtgggcagaccttgccgctctcggtacctgcacacctgcacggctgctaaacctgcatgcagcactcggtacacggacttcacacttcagcagacactttctttctttctttctttctttttttttttgagacagagtcttgctctgctgcccaggctgaagtgcagtggcgcgatctcgactcactgcaacctccacctcctgggttcaagtgattctcctgcctcagcctcctgagtagctgggattacaggcgcccaccaccacgcctggctaatttttttttttatttttagtagagacgaggtttcaccacgttggacaggctggtctccaactcctgacctcaggtgatctgcccgcctcggcctcccaaagtgctgggattacaggcgtgagccaccgcacctggcccagcagacgctttctgcttggttgccagtaatttctcaatgaacttctggggtgcaactaaattttgtatatttcttttcctaactccccctgaatcactgggtgacctcaggcttaatgggtctgtttctttctctataaaataagagggaggctgggcacagtggctcacgcctataatcccagcactttgggagactgaggcaggaggatcagttgaggccaggagtttgagaccagtgtggctaacatggtgaaaccgcatttctactaaaaatataaaaaatagccaggtgtggtggtgcacgcctgtaatcccagctactcaggagcctgaggcaggagaatcacttgaacccaggaggtggrggctgcagtgagcctagatcgtgccactgcactccagcctgggcaacagagcgagaccatgtctcaaataataaaataaataaataaataaataaaacaaaatwagagggagtgttaaaccaaatctgagattttgaactcttttttaggaatgggggattgatccctttcattttaaaaagaaatggctcaggcttagtggttcacccctgtaatcctaatgctttgggaggccgaggtgggaggagcacttgaggccaagagttcggggctgcagtgagctatgatcacaccactgtgcctaggtgacagaacaagaccttgtctcaaaaamacaaaaacaaaaacaaaacaattaaaaattagctgggcgtgatggcatgcacctgtagtcctagctattcagaaggctgasgcaggaggatcggttaagcccaggaattcaaggctacagtgagctctgatggcgccactgtactcctgtcctgcctgggtgacagaacaagaccctgtttctaaaaaataaaaagtgaaatgaatgaaggaagggaggaaggaaggcgtgaacaaatgaatgaatgaacaaataaagaaaaagtcttataaattagtccaaaatgcrgctgggcatggtggctcacgcctgtaatcccagcactttgggaggccaaggcaggaggatcacctgaggtcaggagttcgagactaggctggccaacatggtgaaaccctgtctctaccaaaacatactaatacaaaaattagcttggtgtggtgatgcatgcctctaatcccagatactcaggaagctgaggtggaagttgcagtgggccaagatttcaccactgcactccagcctgggcaacagagtgagaccctatctctaaataaataagtctaaaacataaaacagaccatcatggagctgcccagtttgtggcgggaatgaggaggctagcacagaccagttttgggcgagccccctcccaacagcatggcagcccactccctgggtgctggtagcaggcaagaggcacccccacagtgcccaggagccagtgcacaccactgttggggccacaccnttgttacagcctgactcctttcatcttgtctctctccttcctcctcctcacctgtagggtttcaagtggaaaatcgagattatttactgctttagtaartaaacttaacgcccagtgtactttgggtggtcagcatttcactagatgatttctaaggtcccttcagctcattctaatcagaatttgcgatcttgagggctgagctgggctgggttttacattgcactggaaggagaggatttgtttgtgctgagaggaaagctggggcagattcatacagttttaagaaaccatttcggctggacgcggtggctcatgcctataatcccagcactttgggaggccgaggcgggcagatcacggggtcaggagatcgagaccatcctggctaacatggtgaaaccctgtttctactaaaaatacaaaaaaattagccaggyggcgtggtgggcatctgtagtcccagctacttgggaggctgaggcaggagaatgatgtgaacccgggaggcagagcttgcagtgagccgagattgcgccactgcactccagcctgggcaacagagcaagtctctgtctcaaaaaaaaaaaaaaaaaagaaaagaaaaagaaaaawgaaaaaagaaaccatttcaaagcctgctaacagagtcagttttttttgtttttttgttttgttttgttttgcaaatatgctactgattacaaaggagtattttaaaattgaaatgggaactttctaaattctttaaacatgttccatatgggcttcagaataatatagtgggcagcaggactagaggtttatacagatgaaacctcatcagccatttagtgactgttcaagctgggtattgtgcacataggagtctcctactctatcctctttacttctgtacatgtttgaaattttacatctgaaagcgttttctgaagcagtccgtaattcagacttcacggctgtccttcctcgcmtgactgcaaatggcaggatttgctgctgtgttaatatgtttaacatgaagacatgacttgatattcattacctgtaatgcagccattgcttccttttagattccagagtgtttctgtaaccattcagcacctgaatcacagtatttcatcttgtaaatcaattgcaggcgtcagcttcagactcaagcaaaactggttttagaggaaaacaagttgttgctggagcagttggagattcagcaaaggaaagccaaggacagccaccaggagcgcctccaagaaggtgaggtccttccagtgaggactggtcatgcattgatgtcactattgtcattttacccttctatctctstcctgcckggggccccagttgaaaatgagagaagtcatgttttgcatttttgactggaatgtggctgtttataacctttccacrtcactaccctcaatgcatagattgctttttcagactccacagtgtctctcatcatcccatgggtttgtaaatsactcgtaggtaatagtgctagactcagcagaactggttttggggtaaaatagtaccttagaaatgggaatgatcacgtgaggtaaacatctgaaataacacagggtctcttcccagatgtttgttggatgcgtaagcagaaccattcactttctaaacagttcccctgtgtccttccttccttcagagctgcgggcctgggaggcgacatcactgcaggttagatttccatcaaacaccttccgagagtgtccctcttcccatctcttcccatgcattcccccaacccctaggagcctcatagtctgtgacagtgcacaactgtaagggggccaggttaagagtcatcgcttctgctttaaaaccgtaattcatgagtacaaaagatagtggcattttttccctttgctttactgatttttctttcttagtgaagaatggcataggctgggaagctgaaacacaagccatcttgcatgaggctgtggcaccctgagaagcagatggaggttttccctctccagctgcttttggaatggcagccccttccacagcatggcaggtccatgaacagcccctgctgttgctgcagttgcagggctagcacttcctgtttctgagaaccaggtcgtgtttaaagatgagagcatctcccagagatgcacacaggagtttcctccatgtgatttctcctgagacctgcatggcccaggagtatttgcctttactccggcattgttaagaggagaggggaaacagagttgtggagcctcttatctttgttttcagggttagggatgacattagtttcctatttactgagcttaattttcttgaatataccagatctgaacagaaagaggatttctggtcacatggggcagggaaaaccttttgacctctatgattcagtgagttgcctgtgctattttcccattgcccagaaacagcsattcactttgaccaattagatattttctttttattttttttgagacagtctcactctgtcgcccagactggagtgcagtggcatgatctaggctcactgcaacttccgcctgccaggttccagcgattctcctgcctcaacctcccgggtagctgggattacagtcaygcgccaccactcccggctaatttttgtattttcagtaggggtgtttcaccatgttggccaggctggtcttgaactcctgacctcaagtgatccacccaccttggcctcccaaaatgctaggattacagrcgtgagccactgtgcccagccaccaattagatattttcatagagtagagagatgtacagttttatgctataataaatacctctaagtgctagtgtcggcagacgcttgggaattattacatgcaaccatgtaacacaggatgaaaatatttatgacttactttagatacaagacataaaataaaagtttaatgacgaaagggaaggagaataataaatccagttcttagtttggccatgtttgatgtccttaaaaatcttgaaaattttgcagctttagggacaacgttatgacatatacttacacacctgggtgtgatttaaggctttactcttaggaaagtcagttccttgaagactggaatcatgtttggtaaaatattatagtggattttattttaaaaagtatatatttagtgagtgcttaatgtagagatagtaatttcttttggcttttttggtttttgtttttggagacaaggtctcgctgtgtcatccaggctggagtgcagtggcccagtcacggctcactatagtcctgaactcctgggctcaagcagtcctcctgcctcagcctcccggatatctgggaccacagacgcatgtcaccatgccctgctaatttttaaatttttatgtagagatggggtctcactatgttacccaggctggtctcaaactcctgaccccaagcaatactcccctcagcctcccaaagggctggggttacaggtatgagtcactgtgcctagtatggatagtaacttctaaggacaaagcctttggtgttaatttataacactccaaaatatctttttttttttttttttctgagagagtctcactctgttgcccaggctgaagtgcagtggcgtgatctcagctcactgagccttctcgcctcctgggttcaagtgattctctgcctcagcctcctgagtagctgggattacaggcgcctgccaccacgcctggctaatttttgtatttttagtagagacagggtttcaccaacttggccaggctggtcttgaactcctgacctcgtgatccacccgcctcagcctcccaaagtgctgggattacaggtgtgagccaccacgtccggctcaaaagatctttaaaaggtcatttttatcagctgactctcattagtatttcstaatagccaataattgtgttttgtgaggtcttctgtgccaagtttttatcctcctcttttgattttcagtttctaagctgactaaacaactaatgctcctggaggcaaaaacccacggccaggaaaaggagctggcggagaacagggaacagctggagattttacgtgccaaatgccaagawctcaaaacacactcggatggcaaaatcgcagtggaagttcataaatcaattgtgaatgaattaaaaaggtaaggatttaatgttttttctttttttttttttttcttttttcgagacagggtcttgctatgttgctcaggctggtcccaaactcctgggctcaagtgatctgcccatcccagcctctcaaagttttgggattacaggcatgagccactgygcccagctgatttaatgactttttgagtataatgagtcactctgcctgtggttataggcagaatggagagaggttgctcagttctttctgggtttcttcacctatggtcatgcacagcatagtggcacaggtgtctgaaagtgagactgggactttttttttttgggacggactctcactctgttgcgcaggctagaatgcagtggtgcagtctcggcacctgtaacctccacctcctgggttcaagtgrttctcctgcctcagcctcctgagtatctgggattacaggggyggctcaccacacctgcctaatttttgtatttttggtagagacggggtttcaccatgttgaccaggctggtctcaaactcctgaccacaagtgatctgcctgccttgacctcccaaagtgctggaattacaggtgtaagccatcacgcccagcctgactttttttttcttttaataactttggtaataaatggtaaattaaagtagagcctggctctccttgagggctgcagtctgcactttgggtgtttgtgatttttttttcatactgttttggcctgtgttagttttagaaccaaaggcaatttaaaatagtggaactgggctgggggtagtgcctcatgcctgtgatcccaacactttgagaggccaaggcaggcaggtcacttgaacctggaaatttgagaccagcctgggcaacatggcgaaactgcatgtctaccaaaaaaaataataataatacaaaaactagccaggcgtggtggtatgcgcctgtggtcccagctacatgggagatcgaggctgcagtgagctgagatcacgccactgtactccagcctgggcaacagagtaagaccctgtctcctatctcaaaaaatgataaataaataaaatagtaaaactggaaacctagatatccagtaataaggaattagttaaatgaaaggatatatccttgaaatggaaggaaatgcagtcattaaatatgatgtgacacaagatcctttttgacataggaaaatagccaccatatgtctgtttttttacaatgttgctcaggctggtctggtctcaaactcctggactcaagcagttctcctactacctcagccccacaagtagctgggactacaggggcgtgcctgcctggccacaatatattttaagtaatgagtttaggttttaaaacagcacatagaaaatgattacaattttattttttaagacgtgtgtgtggccgggcacggtggctcacacttgtaatcccagcactttgggaggccgaggcgggtggttcagctgaggaggggagtttgagaccagcctggccaacctggtgaaaccctgtctctactgaaagtataaaaattagccaggcatggtggcaggcacctgtaatcccagctactcgggaggctgaggcaggagaattgcttgaacctgggaggcggaggttgcagtgagctgaaattgcaatactgcactccagcctgggggacaagagcgagactttgtctcaaaaaaaaaaaaaaaaagtgtgtgtgtatgtgtgtgtgtaaccaaccataacagtttgcctgggactgaggggtttcccaggatgtgggacttatagtgctaaaattgggaatgtcctaggcaaagtgaaatgagttgatcattctagtatgtatgtataaatgtatgtgtttgtataattacatgtgtatgtgcgtgtatatatatacctatgtatggtatgtatgtaattggtaattggccaattggtaatagtccgggtaggaggattgcttgagcctaggagtttgagawcagcctgggcaacattgtgaaacaacaacaacaacaaaaaaaaaatatatatatatatatggtggctattttctcatgtcaaaaagaatcttgtatgtgtgtgtatgtaagagagagagatatggtatatatacatatggtatatatgataattatgtataggaaacatacataattaatatgtgtaactaatatatgtataattatataatattttgtataattatatatgaatattttatatatttatattttttattattatatatttatatattctattttttaaattttttttaattttttttgagacggagtctcactgtcgcccaggctggagtgcagtagcgctatctcggctcactgcaggctccgccccccggggttcacgccattctcctgcctcagcctcccgagtagctgggactacaggcgcccaccacctcgcccggctaattttttgtatttttagtagagacggggtttcaccgtgtcagccaggatggtctcgatctcctgacctcgtgatccacccgcctcagcctcccaaagtgctgggattacaggcatgagccaccgcgcccggccatattttatataaattataaaattatatgtgtgtagctatataaaattacatatgtactgtaagtacatagaaaaaaggcagaatgggaaaatattaatagaacatatctttggcagatgagattgtaagtgtttcaaccagggttttcgagagaagcaaccaataggatagtgagaaaaagagagagagtgagatttcttttaaaaattggctcacacaattgtgggggcaggcaagctcaaaattcatatggcaggccagcccattggaaacccaggcaggatctccatcttacagttttgaggcagaactccttcattgagaaacctgtttttgatcttaaggccttagattaggctcacctacattactgagagtaaatctcctttatttaaagtcaactgattgtaaatgttaacgacatcaacaaaatacttcacagcaacgtctagtgtttgagcaaacaactgggcaccatagccgagccaaggtgacacataaaattaaccatcacaatgagtaattttaattttcttttttttcctttttttttttttgagacagagtcttactctgtcacccaggctggagtgcagtggcgcgatcttggctcactgcagcctccacctcctgggttcaagcaattctcatgcctcagccccactcatagctgggattacaggcatgtaccaccacatccggctagttttgtattttgttggccaagctggtcctgaactcytggccttaagtgatccgcctgcctaggcctcccaaagtgctgggattacaggtgtgagccaccagcctggccttttgtatgtttttatatttccaagtgtcctattcacttttgtartaagggggaaataatgttttaaacggtgagcctttcagctcaaaatggttgactgaatacctattgacttctgtttctctccaactcctccttctccctccatagygttggtgtggggcaacaaatgagctagtgcatgtgaagcttggtgcttaagtaaatgctagtgattccaattactggagcctggttttgactctgctattacatgctgactaagccagactcgtgcttttctttttcttttttgagatgagatctccctctgtcacccaggctgaagtgcagtggtacgatcttggctcactgcaacctccacctcctaggctcaagctatcctccgcttcagcctcctgagtagctgggaccacaggcacgtgccatagcacctggctattttttgtatttttattagagacaggatttcaccatgttgcccaggctgatcttgagctgggctcaagcagtccactcaccttggccttccaagtgctgagattccaggcgtgagccaccatgtgtggccagacatgtgcttttttgttgtagtagaggaaggaaacatttttgaaatcatgttcatctttataattttatttttctcaaacatctgctcctgcgaccaatgtgtttttgtggcwgtgtcataactacaaaaacatacagccatgtaccacataacaatgcttcagtcaacaatggaccacatatacgacagtggtcccatacaattataatggggccaaaaaattcctatcacttagtgatgtcacagccattgtaacatcgtagagcaatgcattactctcgtgtttgtggtgatgctggtgtaaacaaacctacggcactgccagtcctgtgaaagcctagcacatgcagttatggacagtacataatacttgataatgatagtaaatgactgtgttactggtttatgtatttaccctactttttattgttattttagagtgtmctccttctacttataacaaaataaagttaactgtaaaacaggctcaggcgggtccttcaggacgtgtccagaagcaggcattgttatcacaggaggtgacagctccatgtacgttactgaccctgaagagtttccagtgggatgagacatggaggtggaggacagtgacattgatgatcctgtccctctgcaggcctaggctcctgtggcatttgttcttcatttttttaaaaaatgtgtagaaagttttaatagaaaaaagcttgagagtaagaatataaaattagaaaatatttgtacaatgtgtgttttaagctgtgttataaaaaagtcaaaaagttaaaaaattaaaaagtttataaagtaaaaagttacagtatactaaaattaatctattattgaagaaagaacaattttaaaaataatttaaatgtagcctaattgtacagtatttagtctacgagagtgtacagtaatgtcctaggccctcacatgcacccaccactcactgactcacccagagcaatttctttccagtcctgcaagctctattcatggttaagtgccctgtacaggtgtaccatttctctctctctctctctccctccctccctccctctctctctcgytctctctctctctctctctctctgaggcagagtctcgctctgtcacccaggggctggaatagtgcagtggcacgatctcagctcactacaacctctgccttctgggttcaagcaattcttgtgcctcagccacctgagtagctgggattataggagtgtgccaccacgcttggctaatttttgtatttttagtagagacggggtttcaccatgttggccaggctggtcttgaactcctggcctcaagcattctgcctgcctcagcctcccaaagtgctgggattacaggcatgagccactgcatctggcctatctcatcaatctaggttgactggtatttcattagaatatgtgtaggtgtgggggtctttttttcattcgctgcagtgggtacctctgcagtgaatccaccaaggtcttcagaggtctgcagatgcccttcagctattcacttcttcctttctggtgtctctcgtatccttctgaggttcctgatgacctaaggctggacctcctggatgggtcctccacttctagtaccttttctctccatttcccaatcgtttgtttccttagttctgagagattcctcaaatatatctttcagcccttgtgatattttttaaattctggtaatcatgtttagtctggctcttatttagtgactgtactttcttttctcatggcattttgttcttttaaaacttccttagtcctctgttatctcagtttcccttgagcttctctgcttatctggatctctctttcatgttgcaatttctttcatcatgcctaatgacccttgttgcttgttcacatctagtcatctgttctgattttaggaagaggaactactggtacttggtgtgtactgtgtcagttgagggattttctgccctggtggttccctgtgcaggcatctccctggctgctgagcaggcctctgtgtatatagataaggtgcatgcaatggtcagctttactttaggatacaggtctcccacaagccaggataaaggcttccctttgtagatacaacctgtccccttaaatctttagctstccccaaaagagtttgctaaatttccttagagaagtgggttgacaccttgtttttctcccaccttcatcttgagtaagcccaatctttctagaaaatagtaaaagcaaagagagccatctctgcttccacatgtgaccgccagtccaatccaaagccaactgacagctcaccaggaacatgagcttgtgccatttcccgcatcattgttccttccatgcagggttgccaatgggcagagaaagcaagacaaaatacccattatttgccttcttttcaaccagggtaggtgaaagaacacatacacaccacacctcgaggcttgccccacacaagttcaatgagcccttttatccctacacaaaaatcttgtcctcatgacctcacctttgcctgaggcataaccctttcccaaactcctccccagacattcccccggtgtgagcgctggttcagcagctgctttgctgataaatcagtgagtattctgcatgtggcctatctctattatgatgccaacatgggaaggggctccctagtggaggctgtcggagggcacttctgctcccttgccctccgaagtgccctccaaagctccaaggtgtcctcagcttctgtagccaaaacaaaaacactcagtttcctactcctcattttgtctatttttcactaggtcttcatggaattccacatattcgagctctgatgaattcctgcccctcttccatgttataaattctctctccaaacaccgccccttccgcgggacagcccattagggtcacactccyggctccatccttctcattcctctacccttgacccatctatcgactctgagcccaaagctgttcagccaaagctgccataaaggctttccctccccagccagttcattctgagccacaaaggtctttctccaatttccactgaaaaaagatttggtggcatctttgttattttaaaatggtcatttctccccctgccttcaccattaatgacttctttttaaactttttataccttctttacttacatctagggggctatcaaaacacaatcgtgtgtcacttaatggggatacattctgagaaactcatcattaagtgatttcgtcattgtgtgggtatcacagagtgtgctcacacaaagccacatggcatagcctcctgcacacagaggctagatggtggagctgtttgctcctaggctacaaacctgcacagcatgttactgtactgaacactgcaggcaactataaaccaatggtaagtatttgtgtatctaaacatatctaaacagaaaaagtacagtcaaaatacagtagaaaagataaaaatggggccgggcacagtgactcatgcctgtaatcccagcactttgggaggccgaggcaggtggatcagttgaggtcaggagttcaagaccagcctggccaacatggcaaaagcctgtctctactaaaattacaaaaattggccaagtgtggtggcatgcgcctataatcctagcactttgggaggctgaggtgggcagatcacttgaggtcaggagatcragaccagcctgaccaacatggtgaaacgccatctctactaaaaatacaaaaattagccaggtgtgttggcacatgcctgtagtcccagctgctcaggaggatgagrcaggagaatggcttgaacccaggaggtggaggttgcagtaagccaatatcacgccattgcactccagcctgggcgacaaagtgagaatccgtcaaaaaaaaaaaaaaaatagagaaaccacagacatgtttggagggaaagcatttatggactgtcctcagaatgttagactaaaatgtgtgatctttattctcttcttttagtttaagatatgatctcatcttgtctcaggctggagtgaagtggctcratcatggctcacttgcagccttgaactccaggctcaagcgattctcctgcctcagtctccccagtggctgggactatagtcacgcgccatcgtgcggggctaattattaagtatttctgcagcgatggggtcttgctgtgttgcccaggttggtcttggactcctgttctcaagtgaccctcctgccttggcctaccaaagygatgggattatagtcatgagccaccatgcctggcccctggtctttcttccttaagccacagggaataaaagtgtttcatttcatctgggagggttttaagaaagtcctgggtgaggccaggcgcagtgactcaagcctgtgatcccagcactttgggaggccagggcgggaggatctcttgggcccaggagtttgagacagagaagctctaaaatttcttcagggaactacaaaacatgacatagtggatttgaaaaagaaacaaatagaatttttagaactgaaacacacaatagccaaaattaagaattcttactcttaaagatgttgtttatatatatattatatgtatgtatatatatttatatatgtaactattagtatttatatatatatctatatatgaggataataagatggagagagacttgcagtcaggaggactgctttagatacagtgttcaagggaggcccctgaggaggggatggttgattcaaggcaggatgcctgagaagcaagaaggaagtaaaatgaaagtaaatgatagtggtaaatatatagataaatgtaatgaacactaagtctataaaatgataatatctttggggatttaagaatacataaaattaaaaggcacaacaataatagcatataatcaggcacaaggcacatggagtttgtgttctaaagtctttatatcattagaagaggataaaagtgttgactaattttataatttgaaaatatgcatgatgaaatttctggaaacaatgtatataacttttaaactagtatgggggtaaaaagaatgattaaaaaacaatccaaataagagcaggaaaatgaaaggtgggcaaggggcgaatagaaaacaaaaagtaaaatgttagatttaaagccaaacataccagcagtagatacgctaaatggataaaatgctccagttaaaagacaaagaatgtcacagtgtaaactaaagcacatctgtgttgtctttaagatatatgtcccaagcataaggatagagaaaggtcaaaagtaaaagggcaggaaaagcagtactactcaagtacaaaccaaaatagacatggtagatcttaatctctaacaaggtagatgttaaggtaaaaaatactacttaggccaggcatggtggctcagtccagaggttcaagaccagcctgggtaacatagggagaccttgtctctgccataaatttaaaaactaactgggtgtgatggcttaccgtctgtaatcccagctaatcaggaggctgaggcaggaggatgacttgagcccaggagtttgaagctgcactgagcagtgattgcaccactgtactctagcctgggcaacagagtgagaccctgtctcaaacagaacagacaacaatactaagcaaagaggatgattcacaaagataaaaggctcaatttaccaagtagaattcacacaaatttaaatttgtgtgcacctagaaataatttatgtcaatacatttgaaaatttagatgaaatagtcaaattctttgaaaagcttaccttaaaactgactcaagaagaagaagaatacctgaatagtcctataatcattaaaagaattgaattaaaaaaaaaaaatcttcctttgaaaactccaggcctggataccttcactagagagctctacaaatattcaaggaagaaataatttcagtcttacataaacctttctagaaacagaaaaagaattaatgctccttaatctaatgaggttagtataaccttgataccaaaacccaacagtgatcgtataagaaaggaaaattacttttcatttcacttatgaatgtagatgtaaaacttctattaaattctaacattctaaagttctattaaaaaatacagctacaataaagatcacaccaaatagggaaatgttgaaagctttcctattgagattggaaacaatacaaggttgccctctgacaccatttctgacaacattaacagcactggctaccaagtggtaactgacacacgtggcatgaaaaacttagaaggtttgggaaaagggaaaacaatagtgtcattattcataaatgacataattctatctgtagaaaacaaatctacaaatcattaaaaataagaggttttagcaaaattgttcaaaacagaaaatttataaaaattaattgtatttctttgtaggaaaaaaatgtgtagaaaatggtattttgggccaggcctggtggcttacacctgtaatcccagcactttgggaggctgaggcaggtggatcatgaagtcaagagatcgagaccatcctggctaacagggtgaaaccccatctctactaaaaatacaaaaattcgctgggtgtgatggcgcatgcctgtagtcccagctacttgggaggctgaggcaggagaaccgcttgaacctgggaggcggaggttgcagtgagtggaggtggcgccactgcattccagcctggtgacagagtgagactccatctcaaaaaaaaaaaaaaggaagaaagaaaatgatattttgaaaactaaggtaatgataggctatcatcatgagaaaaaatttttttaattaaaaggaaggaaccattgacaaagcttcacaaatagatgtggaaagatttacagtacttccgttgggaaaattatgaaactttattgattacatgatttcactgggtgaagaattccaagctgacaggtttttggtagtttgtgggtttttttccattcagttttaaagatgctggctgttgatagtcttttggcttgcgtcgtttatgatgaaaatctgctgtcacggttatctgtattcttctgaagataacgtgtgttttctctgaggcttcttttaagaatttttcattgtcactgtttttcagcattttaattgggatatgccttagcatggtttctttctttctttcagacccttttttgcacagggtctggctctgttggacaggctggagtgcagtggtgcaatcactgcttgctccagccttgacctcctgggctcaagtgatcctcctgcctcagcctctcgagtagctgggactacaggcatgtgccactgctcccggctaatttttaaatcttttgtagagacagagtcttgttacgttgcccaggctggtctcaaactcctggccttgagggagcctcctgccttggccttccaaagtgctgggattacagtgggggaccccacacccggccagcatggtttctttactctacatgaagttcattaagcttcttggggctatcagtgtgtatttttcatcaagtttggaaatcttttggctattatttcttgaacggtctcttctgtttttccctctcacctctcctggactgcttgatgttgtcctgttgactgttctgttcacttttagcccacacttgtttctctctgggcttcaatcagacagtgtctattactatctctcttcaacttcacaaatctatccttctacaatctaatctgctgttagtcccatccaatatattgttcactttgtgtaatgatttttcccatctctgtaagaaagatccatttgagtcttttttgtattctccgtctytgtccccagcatgctatttttctcttctttctcaaatgtaggagcatgtttttctaaaaacctttgtttgccaacgccatcatctctctcacttctgaatctgttctgttgattttttcccctcctgatcatggatcatattttattgcttattctcatgcttgattgggtgctggatggtgtagattttatgttacaggatgttagacatattgcattgctttaaatagtgttagatttcattctggtgcacacttaagccactagagaattgttggattatttatttatttgtttactttcttttctgttttctttttttttttctttttgtagaaacagggtcttgttatgttgcccaggctggttttgaggtcctgggctcaagggatcctcccacctcagcctcccaaagtgctgggattacaggtgtgagccaccgcatgtggctaagctggattctttcaaagctgatttttgttagggtgggcccaaagcaacctctagtcttagggctaagttagccccactgctaagacagtaacactcttctaaggattctatccaatatctcttttattataaggcctttccattctgactggtggggtatgaactatttcctgttctttgtgcatgtcagaaattgttctgcctactgtttgtagtgtttctttcctaggctttacgcagtttcctctcacacacggacagatcagtacccagccaaagacccttcaaggtctctagagccctttctcgctccgtgaaaygccctctgccctgccctggaaattccagctgcmttgaccttcctgctcttggatctctggctcctgggctcagcaggtgtctgccagacaagaaggtggagggagcagttgcagcactcaccttgttttcccttccctttgggatcacagtcctgcctcgcctgttgtccaaagtccraaaactgttgtttcttctgttttgcctggttttttagctgaggagtaaatctggtctctgtaactctatcttggctgaaagcagaagtcttggtattttcaacattcttctttaaccttttatcgttaatccagttcaacaatttatccaataaaataatagttaaataagttttcagtgaaataaatgaatcttggattttgtatgttttacagttacagttgacaaaccttaaaatcatatattgttgtgtattcctgctgcgctggtaaaggatgcagcccctatcccaagttactctctatgcaaattcggtaacacccaagctggtgttcagcaaaataagtgcccctttgttctttgtttcttttgtcttaaaaacatgtatttataattacattattatggaaaarttgttttagcaggttttttttaaataaatctggcatttataaccatgtaaaaaatagagctatcttagattttttggaaggaatagggtatacacacacatacacacacacacacacacacacacacacacacacagagagagagagagacagagagacagagacataagccaaaactgtgggagaaaaagaggttagatcatcaccatcaaagaagtttgtggccaggtgtggtggctcatgcctgtaatccgagctctttggaaagctaaggcaggaggatcacttgagcccaagagctcgaaaccagcctgggcaacatagtgagacttcatctttacaaaaaatacaaaaattagccaggtatcatgtgtgcctgtggtcccagcaacttgggaggctgaggtaggaggattgcttgagtccagaagttcgaagctgcagtgagccatgattgtgccactgcactccagcctgggcaacagagtgagaccctgtctcacacagacacacacgtagtgtgtgcccagccacaccctctctccggtggtctagcagcttgrtcccaggtcctctarggcccaggatggggagatgtttccacagaggcattccaagtgacccacccaggggctggagggctgggctgttatcactcatcttcctcgttatgtgactgccccattttagcttcattgtgctggatacgagcatgtaatgtttttgtccttcagccaattacagaaggaagaagagaaagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggtttgtgtctttttttcctttaagttgcttttattttcaatagttaaaaaagacaaatggtctrggtacagtggctcactcctgtaatcccagcactttgggaggctgaggcaggcgatcatttgaggtcagaagttcaagaccagcctggccaacatggcaaaaccccgtctctactaaaaatacaaaaattagccaggcggtagtggcacgcacctgtagtcccagctactcgggaggctgaggcaggagaatcatttgagcctgggaggcagaggttgcggtgagccgagatcacgccactgcactccagcctgggcaacagagtgagaccctgtctcaaaaaaaaaaaaaaagacaaatgaagaatattccatttcatttcttttaatcttttctttttctaatagtggctataaaatggaaaagggtaattgaaattactggatatcagattataataagtattgttgctgttaaccaatgttaaccaacatttctaaagtctataattgaaatatggttgatggtcatattgataaccctaagattcaaagttctaggagctcttttctaaccatttcctaaaagtctactttggaatttctggatctttttttcgaaagtgccttttagaacataagccagaaagttaatagaataatacttaatgagcctatgggccaggtgtggtggctcacacctgtaatcccagcactttgtaaggctgagatgggcaggtcacttgaggtcaggagttcaagaccagcctggccaacatagagaagccctggctacttaaaaawatatatatatgtatatatacagaaaattagctgcgtgtggtggcgcatgcctctaatcccaactactcaggaggctgaggcatgagaatcacttgaacctgagaggcggaggttacagtgagccatgatcatgccaccgcactccagcctgggtgacagagcaagactgtgtctcaaaaaaaaaaaaaaaaaaaatgaacctattcattgttagacatttgcaactcctcttattcacttgagttggggtcactaattatgcttggtttcaaattaaattcagttacctcttctcaccttgaaacttaatagaagatttaggttgctgaagaatagcatttmaatgctaacatacttgctgtttttgtaatacagatattcaccatgccctagccatgtaaactaatgggctttttattctaccatttggggtaactctctaggaaatctcaaaagaaaattgaggtcctcaaaaagcaggtggaaaaagccatggggaacgaaatgtctgctcatcagtacctggcaaaccttgttggcctggcagaaaayataacccaggaacgtgacagtcttatgtgtttggtaagtttcctgaaggttacatcaagtaaactgcgagttaatatgcaaatgtgattttaagagtattttwaaaaatgatctattaaaagctttatccaggcattccctgacttacgatggatggttccacctaggaattttcgactttatgatgtatttattgggaagtaatcttattataaattgaggaactccttacaactcataatgaagttaccattgatactgaatgcccattgcttttacaccattataaagcttaaaaaatgtagattgaaccatcataagttgggaaccatctgctgtattgccaggattaaatgcatttttgatatacagtttgttcaatttatgatgggtttatcaggatgtagccctgttgtaagtctagaaccatctgtattttaaaatttcaactgtattaccctggcatggtgctgtgtgcctgtagtcccagctactcaggaagctgaggcaggaggatcatttgagcccaggaattcaagaccagtctgggtaacatagtgagaacccatctctacaaaaaaaaatttaaaaattagccaggcatggtggcatgcacctgtagtctcagctactcaggaaactcaggtaggaggttcatttgagtgtgggagttgaaggctgcagtgagctatgactgtactactgcactgcagcctggtagacagagaaagaccctgtccctaaaaaaaaaaaaaaaaatgctaattaaaccagtcttgagataccattctcaaaaaatgttacaaaacatttttttctttttaaacaattgtatctttttattaatgcataatatttttacattttaaaaaatattttaaatatatttacatgcacatgtgggggtacatgtgatattttgtaatgtgcatagaatgtgtaacaattaagtcaggtatttgggctatccatcaccacaagcatttatcttttttttttttttttttttaagacggagtctcacgctgtcacccaggctggagtgcagtggcgtgatctcggctcactgcaacctccgcttcctgggttcaagacatttttgtgcctcagcctcccgagtagctgggactacaggtgcatgccaccacacctggctaggttttgtatttttactagagacaaggttttgccacattggccaggctggtcttgaattcctggcctcaagagatctgcccacctcggcctcccagagtgctgggattacaggtgtgagccaccacacccagctgagcatttatcatttctgggtgtggagaatatttcaagtcctcattgctagctatattgaaatatacaatactttgttgttaactttagtcaacctactctgctgtcgaacatgataacttatttcgtctatctaactgtatgcttatacctattaagcaacctctcttcattcagccacctgccccccagccccccacaaacacacccatacccacatgcatcctagcctctggtagctatcattataatctccacctccatgaggtcaacttttttagcccccacatatgaatgagtacatgccatatttatctttctaggtstggcttattttacttaacgtaatggcctccagttccatccatgttgctgtagatgacatggttttgttcttttatatggccaaataatatttcattgtgtaaatagagcatattttctttatctgtttgtccattgatggacacttaggttcatttcatatctttgctactgtgaattgtgcagcaataaacatgggggtgtagatatccctttgatatactgatttccttgcctgtgaataaatacccagcagttggattgctggatcatatggtaattgtttttagtttgttgaggaacctccacactgttttccataatggctgtactaatttacattcccaccaacagtgtatgaaagttcccttttctccacatcctcatcagtgtaataaaataaagtaaaatttcaggccaggcatggtggctcactcctgtaattccagtactttgagaaactgaggtgggaggatcacttgggtccaggagtttgagaccagcatgggcaagatagggagaacctgtctctacaaataacgaaaaacttagccaggcatagtggtgcatgcctgtggtttcagctactcaggaggctgaggaaggaggatcacttaagcctaggaggtcgatcattccactgtactccagcctgggtgatagaacaagaccctgtctcaattttaaaaaagaaaagaaaaaaaatttcaggaccctctaaatgtattatgcaaagggggaagttaagccctggagactgagcaatgtagcttgttggctattctgcttcttataggttagttctcttcctcattgctgttgttttgtaaatgactaggagaaaccagagaccagaccttctcctccttccagtcactcatctatctataaagatgaactgcttgcttcctttattgttcttctacctaagaccagatggcacccatgaccccatgactgttatatcttcaatgtggaatgttaaatatacctttcctgaaagaaaaagactgcctcaactaattagattgttgtaactatgcattcagtcttacatagaaagacactgaaattctgttaagctttcctacatgtggtcctattagcgatcccaaacttgtgcacttcagaacacagacttctgttctttggaatctacttcctgggtggcctgtcctcaaactttgtgcttgaataaactctctttaaactagagtctcacccttttgattattttaggttgacatcagcmtctgttattttttgtctttttaatgatagccattctaactggagtaagatgatatctcattgtggttttgatttgcatttctgtgatgatttgtggtgttgagcatttttttcatatgcctgttgcccatttgtatgtctgcttttggggaatgtctatttagattctttgcccactttttaatgggattggttttgtttgtttgtttgtttgctattaagagttgtgttccttaaaaaaaaaaagagagagagagagacagagagaactgagttccttgtatatcctgggtattagcctcttgttgaatgaatattttgcaaatattttgtctcattcaacaggttgtctcttcattctattgattgtttcctttgctgtacagaagctttttagtttaatatagttccatttgtctatttttgtttttgttgcctgtgcttttggggtcttagccatgaaatttttgtctaaagtcctagagtgcttcctctatgttttcttctagtagttttatagtttcaggtcttagatttaagtctttaaaccattgtgagtggattttttgcatatgatgagaaatagagatctaatttcatttttctgtatatggatatccaattttcccagcaccatgtattgaagagggtgccctttccccagcgtatgttcttggtgcctttgttgaaaagcagttggcagtaaatatgtgggctcgtttcttggtgctttattctgttccactggccaatgtgtctgattttgtactgatactgtgctattttggttactatagccttgtaatgtattttgaagttaggtagggtaataccttcagctttgttctttttgctcaggactgatttgccttttcaggctcctttttggttccatatgtataaagtaggattgtttattctatttctgtgaaaaacgtcattgatgttctgatagggattgcactgaatctgctgattgctttggggagtctggtcattttaatgatgttaattcttcgcatccatgatcatgggatgtctttccattagtttgaatcagcttcattgtctttcatcagtgtttgtagctttccttgtagaaatctttaacttctttggttaaatttatttctaggtatttttttgtagctattgtaaatgggattgctttcttgatttctttttcagggaattcattattggtgtatagaaacactactgatctttatacattgattttgtattctgcaactttactaaactttttttttttttatcagatctaagagtcgtttggtgaagtctagttttttctaaatataagatcatgtcattggcaaagagaaaaaatttgactttctcttttctaatttggatgacttttatttctttctcttgcctgactgctcttgctaggacttccagtactgtgctgaataagagtggtgaaagtagtcatccttaactagtttcagttctgagaggaaaggctttttgctttcccctactcggtatgatgttagctgtgggtttgtcatatatggcctttattatgttaggtatgttccttctatgtctagtttattaagtgtttttatcacgaaggatgttgaatttttatccaatttttttctgtttccattggtgtgctcatatggtttttatccttcattctgctgatgtgatctatgatgtttattgatttgtgtatgttgaactgtctttgcatctcttgatcccacttgatcatggcatattatttttttgatgtactgttgaatttggtttgctagtattttgttgaggattttgcatctgtgttcattagggatattggcctgtaggtttctttttttattgtggccttgtctggttttggtagcagggtattgctggcctgaaagaattagagagaattccttcctcttaaatttttttggaatagtttgaggagaatttgtattagttcttctttgtaaggtttgtagaatttggcagaaaaaccatctggtcctggacttttctttgttgggaaactttttattaatgattcaatctcattatttgttaatggtctgttcaagttttctatttcttcctaattcaatcttggtagtgttgtcratgggccagttcaggttcttgacttcacaaaagaatttgagagctagtccaaagtaagagcaggtgaagaagtctattgcatagcagaagtcactctgagagacagagtaagagacagaccctaatattttaaggggatgccctttacaggagctgtgcatgcatattcataaagtattggtgaggtcaagtgtgaaaggtggaactatggttggtgcatgcactcagcatgtacatgctctaacatgtatcacatgtataattagcatataaaacctccacctagggtgtgttttttactattaaaatgaggaaaagctcactgtaagctaaaccttgtgcctagctgtacatgcaggaccctggagatatctttagccctgcccaggcaggaattggtagttaatagcttcttgggcttttggtgttgattggctggagattggggaagctacattacgattaagggatttttgttctttttcctaggccatattgggtatcaggaacgtgtaaccacctggtagttggctgggatcctgtgggactacttatcttgctaagataagttaggtgctgacatacaagggcgcacatgaaaggagcccactgagaaaggagcatgtggggcttcactaaaggggacaagtcagtatggtctcataactttacttatcctgcctctgtaggttgtatgttgtccagaaatgtatccattttctctaggttttcagtttgttagcagtggattttcactatgttgcccaggctaaccttgaacatctggattcaagcaatcctcctgcctcctgcgtcactgggactataagaacgtttcaccctgcctcacttagttctgctctgatctttgttttttctttctttctactaattttgggttctgtttgttcttgtttatctagttccttgaggtacatcattaggttgtttatttgaaatctttccacttttgtgatgcaggcatttattgctataaacttccctcttagcattgcttttgctgtatcccataggttttggtatgttgtgtttggtatgttgtgtttcagttttcatttgtttcaagaaatttttgatacccttcttaatttcttcattgacccaatcattgttaaggaacatgttgtttaattttcatatgtttgtacagtttccaaagttcctcttgttattgctttctagttttagtctaccatggtctgagaagatacttgacatgatgtcagtatttttaaatttgttgagcttgctttgtagcgtaacacacagtgtatgctagacaatgttctatatctgataagaatgtgtattctgccgttactggatgaaatgttttgtaaatgtctattaggtcattttgtctaaagtgcagttaaattcaatgtttctttgttagttttctgtcttgatgatctgattgctgagagtagggtgttgaagtccccaactattattgtattgtagtctatctccccttttagatctaataatatttgctttatatacctggatgctgtggtgttgggtgcatatatgtttagagtatatgtcctcttattgaatttatccctttattattataatattaccttctttacgcagtttttgacttaaagtttgttttatttcatgcaagtatagctactcctgcttgcttttggtttccagttgcatggaatatttttttatccctttactttcagtctgtatggatctttacaagtgaaatgtgtttcttgtaggcagcacatagttgaatcgtgttttttttttctgatatccattcagccagtctgtatcttttaagtggaaaatttaattaatttacattcaaggttactattgatatgcgaggacttactcctatcattttgttgattgttttctggttgttttgtgtatcatttttcctcttatttatcttattattctatagtgataacatttgagttccttctcttcctcatttgtgtgcttgctctactagttagttttatcatttcatgtgttttcatgatagtagatatcgtcctttcaattccaggtgtaggattcccttaagcatttcatgtaggatgggtctagtggtgacagattctctcagtgtttgcttatctgtaagtctttactccttcatttatgaaggataactttgctgggtatagtattcttggctggctgacaggttttttttttttttttttcttttagccctttgaatatatcgtctcattctctcctggcctgtaaggtttcttctgagaaatacactattagctgggcacagtggctcacacctgtaatcccagcactttgggaggctgaggcaggcagatcatctgaggtcaggagttcaagaccagcccggccaacatggcgaaaccctatctccactaaaaatgcaaaaattagctggttgtggtggtgcacatgcctgtaatcccagctactttgggggctaaggccagagaattgcttgaacccaggaggcagaggctacagtgagctgagatagtgccactgcactccagcctgggcaacagagtgagactccatctcaaaaagaaaaaaaaaggaaaaagaaaaaagaaagaaatacgctgttagtcttatgagagttccttatatgtaactagacatatatatatatatatatatatatatatatatatatatatgtctaaatatatattctaaatatatatgtctaaatatatgtatgtctaaatatatatatgtctaaatatatatgtctaaatatatgtatgtctaaatatatatatatatatttagaattctgtatttgacttctgacagtttgactataatgtcgtcgggagaagacctttttgggaacctgagcttcctatatctggatttcgaaatctcttgctagacttgggaagttttcaacttattttgttgagtaggttttttatgccattaaacttcttttcaccccttggaacaccagaaggcatgcttcatttttttttttaatttttctctctttcttttgctccttttctctctctctctctgtttctctctctctttctctctctctctctttcatctcactgagtatttaaaaagcaaaagaaattctttctcctgcttgatctagtctatcactgaagctctcaattgtattttttattttattcattgaattcttcagttccaggatttctgtttagttcttttttatatctgtctcttcgatgaattcctcattcatatcctgaattgtttttctgatttctttatagtgtttatttgtgttctgttatattttactgagcttctttaatatcattatttttaattctttttcaggcatttcataaatttctttttgttgttgttggaatctgctgttggagaattattatgttcctttggaggtgtcatattgccttgctttgtcatgtttattatgtcctttcattgatttctgcaaatcaagtgtaacagtcacttattctaattttttgtattggtgtatgtgtgtgtgtgtgtgtgtttgtgtgtgtgcctggggcaaccaacatggtgggacactccctgcaggctgtggtgaagaggatggggtgatccccaggccctgggtggtgtgcttgggttgctttggcaatggaggcattgggcaggggaagcctgtcttcagggcacatgcacgtgcgcagggctctgcggctggagggggtggggttgctgttagtgacaggggccccagccaggcaggtttcaggattggggagcacttgcttcggctcccttgctctcatgggcagcctcttcagtgcactgcaccacactcttctgggtatgcaggacactgtagggtagagtgctggggacccgctgctycactgggtccacctggtgcctcgccgctgcagccttccgggtgcatgtggggagatgtccgtggcgctccagggatgtggagatgcaggggctgctgggtcccagggcaggatgtagtctggtgggggctggactctcaaaatgatgccactgtgctgcagctrcctggaacctgggtcagtgtgggacccagcgtgagcccccgctctggagcagtggggtcacacagactccagggagctccctgcaccagtctcagggcctgcaggggttgaggggctcccctggggctgggatcacaggngtgtgtggtgagaatgtggacccctggggatctctcaccctttcccgacacaggggagcctctccaggctcccgaccaagacccatcctgtctgggctgtcgtctccctctccttcattgcgcgggtgccgcccagccctcccctgtcgagttcycgtggtctccgttagatgttctccgtgcgatgactgactcctgttttggttctcctgtgtggaggagtctgacatcctgtgcctccagccagccaccctgagccttcctcctgaaaacaggtttttgtttgtttgtttgtttggtttttgagatggagtctcgctgtgtcacccaggctgaagtgcagtggcacaatcttggctcactgcaacctccgcctcctgggttcaagtgattctcctgcctcagcctcctgagtagctgggactataggcgcatgccaccacacctggctaatttttttgtagtttaggtagagacgggatttcaccatgttagccaggatggtctcgatctcctgactttgtgcacctcagcctcccaaagtgctgggattacaggcgtgaaccaccgtgcccggctgaaaacagttttttaaattacaataattgctgataagagtgtggtcagtctggccatactttactggtgacttctgagtcctttccagagccttccagaaagcaatttgactttgacacagcatggatggagccttgaaggcactcaagtgtctggcccagcgctgcccctctgaaaggcagctgaaccctggcactctctgtggtagcattaagtgcccattttcccttctgctgctgtgtgtgctggccttcctcaccgggacatggagagggcaagagaaagcttgctgaaaaatctaaagggccgaacaaaccctttcatccagagatttcctgggaacctgcccgccacatgttgaggccactgtaaacgcaaagccgtcttgtttgtagggcaggacgtgcagggaatcccggtccctggggtgcaggccccatgcctctcccatgggccagggagtatcacaggcttccacaacgaagtcaggatcctcccagaccctcagacactctcctctcggcccacccmcartatttgtgggcccaggatggaaatacaaatggaggccactgactgtctccagatatttaaaagttacttgttgagccaacaaactgttagtaaaatgtgttcccttctcctgccttgacctttatcatggcctggctgtcaagtttagaatcctcaggcccctcagagtcaaagcggaaatgtagggtgtgggagagctgctttcttccatcctggctccacctgtcaccagggacttttgtgtccaagcagacacccgctatccatgcagggagaggcatgggagctgccaggatgtctgggcagggctcttggtcctctgtagccaggtctggagtggacacatccctacagccttgcaggccccttgaccctgggagtgcctaggccagcccctctagccaggtccaggggtgttagtggctgctctgccagtctctgccctgtcctaggactgagccacgtactcctgccctaccccatcctggtctccaggagctcgtgagagcccttacccaaccctgtacatacaccaacagtgggaggactccactctgccttgggaagtttctgctgatgacctctggctacaaatcactttcggtttccccaaattagctgggcatggtggcgcgtgcctgtagtcctagctacccaggaggttgaggcaggagaatctcttgagcccaggaggtggaggttgcagtgagctgagatcgcaccactgcactccagcctgggtgacagagcgagactttgtctcaaaaataaataaataaataaataaaacaaaaagaaaaaacaaaaatcactttcagtttccccaagtatgactgcaccatcttgcatttattacatttttgtgggagacacaatagtcttaggtactgagatctttttttttttttgagacagaatctcgctatgttgcccaggctggagtgcggtggcgcgatctcagctccctgcaacctccgcctcctgggttcaagccattctcgtgcctcagcctcttgagtagctgagactacaggtgcacaccaccaagcctggcctgagatctttttaaatcctgcttctagggtggattttccatgtgacctggagcaatttctctgtgacttagctttccttctggaaaatcaaacttgtcaccactagcctaccttggaaagaatgctcaccattacttattttattttagcatctgaaatagttaatttatagaatgtagcaggtcacgtccaacctggatattagtttaaatcattcgacttcaaatgatgtcatctctgctggatgtattgcctttcatgtatggcttggagaaacggcattgtgcattcatattatgttatccttaattttgaaattgttcaaatgagtcaagttatgagttgattggcctcttggcacttattccttggatgcgattgaaggaaagatagattccataagagtagagatgcattctggaaacctttgcagcctctcccgttcccctggtctgtggggctggaattcttctctttgtgtcgagcagggcaccccacatgccctgttcctgcccatcctcaactgttggcctgaggcccaggccctcacacagtgggtggggaaggggttgaggcaggacaggttgcagaatgaagattgtgagcagtagcagtaacactctttgcaaaataattgtttgttatttcaatttttctgtaaaactgagagcccatttatcacccttctccctaggcaaaatgtttagaaagtgagaaggatggagtgcttaataaagtcataaaaagcaacattcgcctgggaaagttagaggaaaaagtcaaggtaagtggttatttggcctcagagatttcattttcagatgggaatgcaggctcactgctgtggatttttgtgtttaagaaaatgacaccttttgyatgtgcatcactaatagtccacagagtaaaagtattgtaaggttttgctggcagaatagcacctctcacctcattcaataaactttggttcattcacacaataaaatactgcatagctgtttaagaaaaaaggatatgaagcaaggcacagtggctcacgctgtaatctcagtgactcaggaggcccagccaggaggatcgcttgaggtcgagagtttgagaccagtctggtaacatagcaagaccccaatctctacaaaaaatttaaaaagttagccaggcatggtggtgcttgcctgtagtctcagcttctctcgaggctgatgggggaggctccattgagcccaggagttcaaggctgtggtgagccgaggtcacaccactgtactccagcctgggtgacagagtgagaccctgtctcaaaaaaaaaccaaaaccaaaacaaaacaaaacaccaataaaaggagagacaggatctcactctgtcatccaggctggagtgcagtgacatgacaatggctcactgcagcctcgaactcccgggctcagtggatcctcctgcctcagcctcccaagtagctgggactacaggcaagcaccatggtgtctggctatttttttttttttgtattttttttttttgtttagagatgaggtcttgctatgttgcccagggtggtcttgaacttctgagctcaagtgatctgcctgactcggccctcccaaagtgctgggattacagacatgagccacctcacctggcagggaccctgtctctttaagaaaaaaaaaaaaagaaaggctgaaagggaaggggctatgccatgctgtttatgaggggactcggcatggaagtattgagtaatttaaaatccccctgtggggtttttcttttctctctttctttctttttttctaattttcctgctttttacttccaaaagagaaggagtgatcctcggagtagttggccttgcttggggaatccatagcgttaccatttatctgaacaggaatagtaaaaccggctcacccggaggagacacctgtgagcaggccccaaggtagacaggccagggcctcggggggaatgaagagaaaaggcttgagaaatcagaggtgacatttcaggaaatccctgcaaaatatcactcttcaaagggaggacatcaccttggaaatccggggctgtgacgagatctgggaactgagggatgcaggcagaagcccctccaaaccaggctgaattcagagagtgggagatggggctgcgaggtggagggtggtgggaacatgggaagtctggaaggacactctggcccaactgtcgctcccaccctcccaggaacctcctctcattccagaggaattcagaggccttcatataaaagcagtttaaggaaaaggaagaaaaatagaagcataagttcctactgacggaaactgctgaaaacttaccaggaaaagtgttgccgcaaaggagatcaaaactatactccaaagtgaaccyctaggtagctggctagagagctggagatagctggagagacaggacttcaggaggcagtcagagccaggaagaaatgtcacagagcagacacaggacctcaggaagaggcagcaaggcctaggagggtgtgggagggaactgacatgacccagggaagaaatagaagggacagagaagcggtttaagaaatgcagtctgaattctatggagacagatgtcataacagcgcaataagggatatgcagctagaaccgagaaagacagacaggaaagtggaaatggagatgtgcaaaggattcggtggacagtgatggagatctaagagactgacttctagagcctccaaagaagaaaccaaaacagtggcttattctgctctaaactgtaactcataaaaacctttctgaaataaaagaagacttgaatctatgtcctgaaagggcacattatgtacctagggaaaactgacacagaatggacccagaaaattgacaccaagacatacgactttaagataaagaaaatggccaggcacagtgactcatgcctgtaatccaagcactttgggaggccaaggcaggcagatcacttgagcccaggagtctgagaccagcctgggcaacatagggagaccccagtctctacaaaaaatacagcaattagccaggcttggtggcacatgcctgtagtcccagctactcgggaggctgaggtgggaggattgattgagcccaggagtttgaggctgcagtgagctatgttcgtgcctctgcactctagcctgggcaacagagcaagaccctgtctcaacaatgagtcctgccaaccaagagttaattggggaaacttcggcaaaattaacttgtagtgagcgaagaatatatttaactgtaaaataagacttagagcgggaataaggctgatagaattgtatgtaaatgttttctgacaatgtagtaataatacaaccaaggaaactgatgggcaaagggggaaggaaggtagaaagtagattgcacttgctgatttcttrgtaggtaataagagtcaagggatatcattaaagctgaaaaaccaagtggtacgagcttaagcatacttaagcaggtgaacagaaggaggggaaaagtgaagaaaacgttgtcatgagctaatgtattgttacttttgttagggaaccaatggatacgatctaaaaacaggggactaagaacatgtaatataaaggcgtaagaataaagccaactacaagaatcgagctttattcctaaatagtggaattagagctgggcagagtggcacgtgcctataatcccagctcctcaggaggctgaagtagtaggatcgcttgagaccaggagttcaagatcagcctgggcaacatagagaccccatctctaaaaaaaagtttaaaattagccgggcttgatagccagcgcctgtactcccaactctgcaggaggatcttgagcccaggagtttaaagctgtagtgagctatgatcacaccactgcactccagcctgagggacagagcatggagcaggatcctgtttctaaaaaaaattgttttaatttttttaaatggtagaattataacagcaaaaaagcaaagaaaaagactatattagtttaaaatcttttaaaaatatgtacataaaacaaccaaacataaaataacaaaattgagaccaaagaaatgtgtcctatagrtaaatgtaaattagcttaattcacctattagggaaaacaatattttttggattggctcataaagcaaaatgctattccacactagacccaagagccaacctaaaacaaagtattcatgaaggatttaaattgaaaggatgggtagagataacccagatttctgcaaacacaaagaaagtaaaggtcgaaatcttaacatatgccaagatagaattcagaccaaaagcactaaatgacaccaaaaaaaagggggagatttttataatactaaaagactacagttaataatatatagtatgagctgggtgtgtgggtccctgtagaggaggctgagcaggaggatcacttgagttgagtctgagagttcgaggctgtagtgcagaatgatcaggtctgttaayagccactgcactccagcctgggcaacatagtgagatcctgtctacatcatcatctatagtaattgtgagtatctatgcgctaaataacacagcagcaaatttatgaagtgtagactacaggaaatacaaagaaaaatggaaacttggtaataggagctataatccacctctcttaatccaagactgatcaagatgttaaacaaaataagaaaatagaagatttaacaacataatcaacagggtatatttacatatatataaaagacacaaaaattgatcattgcttggctacaaagaaagcctcaataaatccctaaagtagaaataatgtaggcrtttgttttttgtttgtttgtttttagacagagtctcactttgtygcccaggttggagtacagtggcgtgatcttggctcactgcaacctctgcctcccaggttcaagcaattctcctgcctcagcctccccagtagctagaattacagatrtgccaccacgcccagctgatttttgtatttttaatagagacagggtttcaccatgttggccaggctggtctggaactcctgaccaggctggtctcgaactcctgaactcaggtgatctgcccgcctcaactttccaaagtgctgggattacaggcgtgagccaccgcacccggccagcatttgttggtcacaaatattaaaaacagaaattaataagcaaaatcaaaaaacaaaaagttatttcacttggaagtgtaaaaactgtgcactaaacaattcttgggtcagagagaatgtataaactgagtgtcagagcttcttataaaaaaatgagtctgtgggactacatgtcagactctctgtgacaataattttagaaatgctcggccgggcgcggtgtctcacgcctgtaatcccagcactttgggaggccgaggcaggcggatcgcgaggtcaggagattgagaccatcctggctaacatggtgaaaccccatctctattaaaaaaaatacaaaaaaattaaccaggtgtggtggtgggcacctgtaatcccagctactgaggaggctgaggcaggagaatgatgtgaacccgggaggcggagcttgcagtgagctgatattgcgccactgcactccagcctgggccacagagcaagactctgccgtctcaaaaaaaaagaaaaaaaatgctcacaggaaaattcagaaccttcagtactatacagtaaaaacgaaagaaggaaagtaaatagcgggctttcatctcagctgtctgtttggtgacagagagtgacagcccttgttggattcttcartgaggctgtcttgtcaaggtgaaacagtgctgaccagtggcagcattagttcttaggttaccagttgatgcagggataagagttgtcctggaaaaaatacagttgtagattaatttgcaagaacatccagtttgttctgtgatggtaattttttttttttttttttgagacagggtctcactgtgtcacccaggctagagtgcagtggcgtgatcacactcactgcagcctccgcctcctaggttcaagttatcctcccacctctgcctcacaagtagctgggactacaggcatgcactacaacgcctggctaatttttgtatttttaatagagacagggtttcaccatgttggccaggctggtcttgaactcctgacctcaagtgatccgcctgcctcagcctgtaatagtgctgaaattasaagcatgaactgctgtttccaatggtgatattttatgttttcatttatttatagcatataaagaactaggctttatatacattaaaatttggttttattgtacctgaaattcttttgtcactttttatgacttttatgatccagacttgcaatcccagaccaaacttatccggggttgctagattttaaaggctctgacacacaaggagtgggtagggagcacagccaggaggcacygtccaccctggcctggcagcgtcccctcaytcacagagtccttcccccgaccagggctacaagaagcaggcagcactgaagctgggggacatcagtcaccgtctgctggagcagcaggaggacttcgccggcaagacagcccagtaccggcaggagatgyggcacctgcaccaggtgctgaaggacaagcaggaggtgctggaccaggcgctgcagcagaacaggtggggcatgcgccctgcgccatggcccgcagagatgtctgaatgtctgattgagggttctgckaaaaccctctgggcctgttttatttgttccattgtttaattttgtttctacattttactctgatctgaatgtaatattggtctcragttttatttgctcctcatcttctttattcttttaaaaattcctcttgtttgaaytggacttccggaatcaatgcacacctctaattgcctttctctttttttctgctgccttccatctcactgatatttttattttgtctcattttctttttattttattttttgagacagcatctcactctgtctcccaggctggagtgcagtggcacgatctcggctcactgcaacctccgcctcccggattcaagcggttctcccacctcagcctcctgagtatagctgggattataggcatgagccagttttgtttcattttcttgagagattttattaatttttgattaggtattttatttctgttatttctattattattattattattactacttatagacagggtctggctctgttgcccaggctggagtgcagtggtgtgatcatagcttactgcagcctcaaactcctgggctcaagccatcctcctgccttagcttcccaagtagcagggattacaagcatgagccactgtgcccaacttttttaaactcttcattcactgcagtcagggcctggggatccccactcatggggaacagtgtagactcactccagatccatttgagagcaggccggtggctctagtccccaggtgatgcctggcctttcagaacaggtttcctttgaagatctgcaggtctcccacccacccctcctttctttgagggtccttcacatcctccacttacctaccttcacagtgcctctagtaggaagagaaacttggacaagagtgggtcctgagattttctgtcactcttgatctgcacgatctctcagtctacaaacatccagggtttggcattgacttttgtcctcaaagcaactgatactttgtctgcctctttggtttcagtttaggcttcattttttctgcccttagagactgcctgttctttcgagttcagccatacatttaaacatgattgctataatttaccaaaatatcttcagaaaaccaaagtctggggaattttttttttttttttttttttaaatacaaggtcttgctctgttgcctgggctaaagtacagtggcacaatctcagctcactgcagcctcaaatttctgggctcaagtcatccttctgcctcagcctcccgagtagctggaaatacaggtgcatgccaccacgtgggcccagctaatttttaagttttttgtagagatgaggtctcacatgttgcccaggctggggcttttttagacatagtttaattaagttgttcttaccacacagtgggcatcaggggccttggaaggaaggaacgttcacaagaaaagtgactctggccaagtgggcacatcactggcctccctgaacttcagtgtcctgctctttaaaccgtggtgcgaagtccacctgcaaatccagtttccaacattttccagaaccatctggcagtgtccgggaaggagctggcctctccagcctggccatgctccccgatggggctaagcaccttgtgaggtgtggctsgtgtcctggtctattcccagtggactgtggccctgtgaggatgtggccaccttcatctgtcctgtctccccagcacaccacagggcactgcatcctggttctggaaaygctgccctgtggctctttccaacctcacatgcctcggcccctcagggcctccccatcccggcacatgggccaggccaatcttctccatcttggcaatgagtcttatctcctcaggtcccccacctcaccccctgactcgctcttagctctgggctgtatggagcggaagacctgtggaaggtcactgagtgctggccaggtcacagtggacaagcagacgggacacaggaggggctgtgtgggtgcctgtggccaggccatcgtgctagagcgtctggctggccaaggccagccctgcagttcctgcagttccttattcgacacgcccaagttcattcttgagagaaaacagggattgcactggcgccaaagtcaagggcagaacatagagggaagagaaatgcctgtgccgtcctgctgctccccattcccagggcactggccgcttcattccacactgagccccagcctgggctgtcctgctgctccccattcccagggcaccagctgcttcattccacactgagcgcttgcttcagaacccaggcaccgagggctctgttccctgctgatagyrttcttctgttttgagttcttgctactttgggattcatatgggctctatattatttttaaaattgtgccattttaaacttatttccctcagagaaatggaaggtgaacttgaagttatttgggaatctaccttcagggaaaaccgaagaatccgagaacttctccaggacacactcacgaggacaggcgtgcaggacaaccccagagctctggtkgcccccagcctcaatggcgtctctcaggcagacctgctggacggctgcgatgtctgctcctatgacctgaagtctcwtgcccccacctgcyagaatctgcgggagcccgtggtgtagcctcctctggcctgaaaggtctgcctcacacaggccttccctgcagggcagcccatggtggcagccggaggtgcgtaagcccactgaacgctgcagggcagggaagaaataaatggtctcatagtttaatccattgataacattttgctttattttttwwttttttttttttttttagagctagggtctcactctgttgcccatgctggagtacagtggtgcaatcatagctcacggcagcctcaaacatgtttgagatccttctgcttcagcctcctgagtagctgggacctcaggtgtgcactgtcaggcccagctaatttttttcttttttgttgagatgaggtcttgctatgttgctcaggctggtcttgaactcctggcctcaatctgtcctcctgccttggcctcccaaagtgcgggaatgacacgtgtgagccactgcgcctggcccattgtgctttattttaataacgtgctgctgaaatctgttttagccagggcatgttctctggccacattgccactgagatgagttctatgacacccactgctctggtgagtaggtggcctgctgagcaggcctgccttccagctcctagatctgcagctgggaagtgctggaagggttgggcgggcagctgagccctcgtgccatgtgtcagatggggaagtgtcacccgaggagccaggccatggcaccggccctgatgatagctgtgcgtgagctctgggggccttttcttgtttggtcaaaaaaaacaaggtgctgctgctgttcatgccctctaagttgtacaaaccttttctgccctctcccctagcccttctctatcctcctgagcaagtactttattctcttttgtttagttgttacttttgtttgtttgttttgagacagggtctcactctgttacccaggctggaatgcagtggtgcaatcaccacagccttgacctccaggctcaagcgatcctcccatcccagcctcctgagtaggtgagatgacaggtatacactaacatgcctggctaattttgtaaaaaaaaaatttttgtaggccagccatggtggctcactcctgtaatcccagcactttgggaggtcgaggcaggcggatcacccgaggccaggagttcgagaccagcctggccaacatggtgaaaccccatctctactaaaaatacaaaaattagctgggcatggtggtgggtgcctgtaatcccagctacttgggaggctgaggcaggagaattgcttgaacctggaaggcggaggttgcagtgaaccaagatcacgccattataccccagcctgggcagcctgggcaacaagagcgagactttgtctcaaaaaaaaaaaattttttttttggtagagatggggtcttgctatgttgcccaagctggtctcaaacgtctagcttcaagcaatcctcctgcctaggcctcccaaagtgttgggattataggtatgagccaccgcgcctggtctgggaaggtaattgattctggagccacacagctccccacccatgtaatgagagccctggctttgagctaagatagagtccctgccccactgccaccaccaagaagcataccagggggccatggttctgtcccatgtgtgttagatgacgtgccacctcctcaggaaaattaccccagccgctcaggaccattcagtcccaggcatgctggagggacttggggacattgggctacaaaggaccctaactgtgggactcaggggtggcaccctgcagcatctccttttcagagcccctcgcagtgaagtcctgccttgtttcaggtgggaaggaggccccagtactggtccttggtcatgtgtagaagttctacgtgtgatctttgattgccagacggaagggtgagatagaaaatcatagttcttttatgactctataagcttgttcaacagttgaatcattgtaatttaattttattttacaagcggtagaaagactcactgggattgaaaactgtgtatcatctccctaggagatgacctaacaaataactgtgatgctatttcaaaggcatttacggccgctctgcagcctcctgtagacaggctgacaggcggcggcagcccagcgtggctgcgcggggcaggagtgcttgtcagcaggaatgctgctcccgccatcgtgacctagagaaccactgttgacatccctgtctttctgccttttatgcaaacattttattcttttgagaagtgtccacttttgttcttatgtttctgctttaagtttttcacacagtgcaaacatactttgcaagtatggggactcctggatggcactgtgaccagggcaagggcaggtgtcccacagacactatcttctgcccagcctcctgctgggtgccataggaaatgggcagagaagccacgagtccaggatgccaaggagggcggggcaggcaaggcagagaggcacctgggtgcttgtgagattccaggaaaggacagaaacattggggtgcttctgggaggaactggcacgccccggcccttgcagagtggacaaggtttcaggagctacagaagggtggagagggcccccaggagcacagcaggcactcagagcagcaggagggggtttggtcagagcttgggtgggaaatgaggccggactgcacagaggagaactgggtctgctgggaggggctcctccttccccatgctgcaagtgtctggtctgagcagggaacccttctctttcttggtcctggtgaggtttcatacggcattggaagattcctggtcaagcagctgtagaacatgacccaggcacgcgagtgagccttgctggctttgccattatttaaaagcagccctgggcatggtgatggcgcctatggtttcagctactcaggaggctgaggtgggaggatcacttgagcctgggaggttgaggctgcagtgagctatgatcatgccactgcactccagcctgggcaaccaggtgagaccctgcctcaaaaataatacaataaaaagtaaaagcagccctggggaaatggagacagtggacaaagcaggctggggcaccaggtgtgcatgtgggtgtgagtctgtcatgagagctgtcctgaatgcccttaacgccactgaactgtatgctggaaaacagtgacaacagtggattttgttatatagacaattaaaaaagaaataacacccaggcctgcttcctgagtgtttgtgtcattttactttcccaccaccaacctccgcgcaagttccggttgctccgcatcctcatcaatgcttggtggtgttgtcaataactgtgttgagaggacagagatttaaggccgagggtggcctagcatttagcctcgagcgcagctgtcactggctcctcaccccctcccctacctgtatcgttggcgggaatgaaaggcacagtccccagtgtgggtggctcaggagagccctccctgggcccaagcagctcttccagcagggagggcttgagccggatacagatcccacagcaggaggctgagcctcttgggatggggctgggctgacatctgaattcttgagtaagactggaaacatcatccactcaaaacttggctgggcggcatggggagggctcagtgtgcccaggtttgtggcacctctctgctgggtcacagctgggcaggggtccacaggtaaggagtggctgcagccaggagtgggagaggggatgggtacagcttgttaggcctctcttggttttctcaaggtgtgagtccatggccccaaagctgggcaggaaacctgctgcccttccagcctcccaggcttggctttttttttttttttagttgagacagtctcgctctgtcacccaggctggagtgcagtggtgcgatctcggctcactgcaacctccacctcctaggttcaagcaattctcccacctcagccccccgaatagctgggattacagggtgtgtctcaccacgcccatctaattttttttatttttagtagagacagggttttgccacgttggccaggctagtctcaaactcctgacctcaagtgatccgcccacctcagcctcccaaggtgctgggattacaggcatgagccaccatccccagcctcaggctcggctcttttcctcatttttgactaggggtggactgggtaggagggttttggagagaaagaagaagggcggcttttgtagttgatattcacctgcagggccctgctgggctgctttgcaggcccaatgtctgcaaacaacaggacagaggtagtgaggacccaggctgggctatggagacttcaaacctacggagcgcatgaggctgcttcctggaactgggcatgccacctgctactgaggacccaggctggctccccgcgtctgtgctgggtgctctgggccgccatccccttgttccacagtccacccgtgtgtcagcactctacagagggtatagatgagacagggagagtgcactgaggtgacagcattgctgccttgggtcatcaggagcctggagcatctatttcacctggtcaggagggtcctgagtattttattaaagaataattctttgaaagtgaagggtctgtgtgtagtatatgtagcataccagggctgggttgcaagcaacagaactatactgcccaatgttaagggaaagaaggaaatattttggaaatgtacactctgtggcttccaccatgttttgagaaggacagaagctgcaatagccttggggtgagggtctcagtagttgaacaccgtcagcctaccctgtgcttcactcaggtagcaaatcctgggagacaatggcctcttggctgacctgacgtcctgagccctcctgtgtggccagagaagtgaggtcttttggttggtagcccaccagtgtcccacagaaagggacagttccccccaagttgtggatgctgggcagacagaaacaagattacaaaaaatggtaacttcctatgttagagtctccatctgtcacccagactggagtccagtggcacgatcgtagctcactgcagccttgaactcctggactcaagcagtcctcctgccccagcctcccaagagtagctgggactataggtgcacaccatcatgcctggataatatttttaaattcttttcgtaaagacaggcgctcgctatgttgcccaggttggtctcaaactcctggcctcaaacagtctccctgcctcggcctcacaaagtgctgagattacaggcgcacagccacagcacccggcccccaaaatagtaactctttattaaagatgtttgatgacacagaaccctctttccccaaaatcagcagcgatcacaactttcatcatgtgtggccaccgtggttgagaaaagaggcagcgaccatgaatcgtgacgaggtcggtggggaagggagcaggatgggaagtcgtgttttgacagcatgctgcaactgtcttccccacgcaggttatttaatgcaaaaccatattacttggaacacataaaaatgatggacaaagttcgaaggcagaattgtactattccaatagttgttggatatatatagattgttcctagataagagttttgaaattatgtttatgctttccttgctaattgttttatggctagacagcacgtccctgacatcgaaaggctttgcacatcgctaactcatcacaagttcttctggttggaattcaggtagtaagggaacaaacaactcttctatctgtggtagtatgccagttatttctgtcttttgggtccccctccaaatccccaactgctaccgtcagcagcagtgggaaggaatacaagaccgagtgaacttaatgaataggagaaggtgaaaacttgaaggcaggtctggaacaagctttcagcggtaaaggaagattcagcctctgcctgaatgtttgcccaagaccttgcctctgtcacgaggacagtgaattagagaacaaggcacccagctgggcagcccagaggctgtgcagaaatggactgacactatgggattaaagacgtctttaaaaccatcacaggaggccaggtgcaatggcttacgcctgtaatctcagcactttgagaggctgaaatgggaggatcacttgagcccaagaggtcaaggctggagtgagccatgatcacgccattgcactctagcatgggagcaagagaccctgtctcagacacaaaccatcacaggagaaggaaatgttggggctcaggacacaccacccccaaaata

SEQ ID NO: 10869 - DNA, 231732 bp, Homo sapiens
  misc_feature (1)...(231732): n = A,T,C or G, or insertion/deletion polymorphism (see Tables 1-2)
aagtggcacttaggctctcaatacattctcttctgtgcttcttctaggagtgggggtggtcctagaagggaacaggctgactgataaagccaatttcccttagagggaacttacattttaaagggagagatgggaacgactcttccccacatgtacctaagtgcaccctttagggtcaggtgcgtttaggtaagagttcaggctaggccagaaaagggggctcaggactcaagctctggcaccactactcacctcccaggccaggggaggcatgtgggaggtgcttcgagtgtgcactcagcccttgctcatgtccctgtgcccactctcccatccttttcctaaacttcctccctctaacaccccaaaatggctgacagaccaaagaagtcaggaatccaacttagactctggaatagactctggacttcagtttgctatctttgagtacaagtagggtaggttaaaacaaaagcaaaaacctagtctcctcagaaaccaccaccaccacctcctcctttgaatcagttcaataagcagaatctttggcttccccagaatgacatgtggtaaaaggtaagtttgtagtgagaggcccgtaactgttattacctttacaaaaagtattttgttaaaagagacccccgtccccacacttcccttgtactttctttttaaaaattatgaaagacaggggccaggcatggtggctcacgcctgtaatctcagcactttgggaggctgaggcaggcagatcacctgaggtcaggagttcaagacctgcctggccaacacggtgaaactctgtctctattaaaaaatacaaaaatgggtcaggcgcggtgggttacacctgtaatcccagcactttgggaggccgaggcaggcggatcacgaggtcgggagatcgagaccatcctggctaacacagcgaaaccccgtctccactaaaaatacaaaaaattagccaggcgtggtggcaacgcctgtagtcccagctactcggggctgaggcagaagaatggcgtgaaccagggaggcagagcttgcagtgagctgagattgtgccactgcactccagcccgggcaacagagcaagactgtgtctccacaaaaaaaaaaaaaaaaaaagaaagaaaaatacaaaaattagctgggctggtggtgtgtgcacgtagtcccagctacttgggaggctgaggcagaattgtctgaacctgggaggcagaagttgcagtgagccgcgatcgcaccactgcactccaccttgggtgacagagtgagactccctctcaaaaaaaaaaaaaaattaccaaagacatgacagttatcaccttatagtaaaaaatgtaattattaaaaatcttttcccccagcctgggcaacatagcaaaaccccatctctattaaaaacattaaaaattagctgggtgtggtggcatgtgcctgtagtcccagctacttgggaggttcaggtgggaggatcacctgcccaggaagtcaaggctgcagtaagccatgattgctccactgcactctagcctgggtgacagagtaagaccctgtctcaaaaaaaaaaaaaaaaaaaaaaagaaaaaaaaatcctatccctagatgtagaagaggatatttagagctcttttaaaaaaaaattagagaaagggtctatgttgcccaggatagaatgcaggggatagtcacaggggcgatcattgcatacaccacattccaggcttggaagctcttttctttaaacctgctggagaatcccatggcccaggactgcaggttcaactaaagatcctacagtggcatcaatcttatatttttgacaacctcctatttcatgttcattgctgtaagttctctaaggctatgaatttacacatttctgttaagcactgtaatgccaagtcacacgggcatccagtgacacaaagtctagcaggggctcttgaatatagggtgtcatatcttggtagactgaaggcatggtgcaggacagttgagtacacttacctgaccattccctatgtccaagcacatgtgcagcttcgactcgcctctgtgataacgatagacatgggttgcccctccttcctctggcacagatgaataatatttctagagacgtaatgtcaaagatgttagctaaccaaattgtcttgtcaaattttcaaaaaaccctgatatttgggcaaagtgcagttaaggagggaggcaagagagcaaaggtgaattacctgccctcttgacaggcctctgaagtcatgcaacaaaccttagcccacccaaagtggctgcagagaaagaaatgcatttggcatccccgtgctgccacctgctgcctccatagggcaagaacgctggctaactaaaggtgggcaggaccatgctctctgccaggttaaacaaatttcacatctttgcccccatgtccaatgcacatatcctttcatttcctcccctaaaaaatgtggatgaacggttccatgtttattgtctaagtctcagaccaggacacgggaagagaggggtacattttcctgagatttagaaacacagcaggaaatgaaacaaacccaagagctgctctgcagcccttttctctgtgcttcctgcgcgtgggggagtggagggagaagtctctaatttaagaagaatcttccgaaagatcggaaaacagttacatttctcttgtctgcttccttcctccccctcaaagttagccttagacttgcccttgataatgactaatgacatcacagccctgcttgttttgaacagggtaggcacactgtctaaaaaacatgtgaccagaagaacgagaagctggggaaagcacttgaggacacagacctaaagatgtgttttagtggctgcttcaaactgtggagacaaacccagtacacaattcttaattctatctctagaaagccaagaggttctgaggctccatttcataacagagacttgaactgaagcatgaactgaaaacaaaaatgaagaacagcaatttgctaaacctcaaaccaaagacaaatattattccttttgctgaaccatgaaccaagggtttaatcactttacagtagagttgaggctattgatttttgtaaaaccactgaacaacacaaataagataaaaatattccctgaagtattcctctttggttggaatcctattcttggagtcagggattcttataaaagatgtagaaagattagagttttttgagatcttaacatatgaaactgaaaagcagggcagaaacaaggtattctcttccatctcctttgtggatcagcctccttaaaaccatgtaggactcaccaagtgttaagactgcatgaggccagagcctgctgtaattcctagaagacagtgccttccatgcaggtaatttccttgaatgttttctggcctgccctcaacattccctaagtatcgaaagatgacttggctgggtatggtggctcaagcctgtaatcccagcactttgggaggccaagatgcgcggatccctcgaggtcaggcgttccagagcagcctggccaacatggtgaagccctgtctctactaaaaatacaaaaattagccaggcatggtggcatgtgcctgtagtcccagctactcgggaggctgaggcaggagaatcgcttgaaccaggaggccaggaggtaggggttgcagtgagccgagactgagccactgcacaccagcctgggtgatggagtgagactctgtctcaattaaaaaaaaaaaaaaaaggtcgggcacggtggctcacacctgtaatcccagcactttgggaggctgaggcgggcggatcacgaggtcaggagatggagaccatcctgggtaacacagtgaaaccccgtctctactaaaaatacaaaaaaaaaaattagctgggcgtggtggtgggcgcctgtagtcccagctactagggaggctgaggcaggagaatggtgtgaacccaggagggagagcttgcagtgagccgagatcgcaccactgcactccagcctgtgccacagagcaagcctctgtctcaaaaaaaaaaaaaaaaaaaaaaagttaaaaaaaacccctaatatttaacttatttgctatgaaattcggcaaataagctattttccccccactagactgaaagatcactgagggcagaagaccttttctgacttttcattgctatattgtcagctacagggttaggcattcaataaacatttattgggtgaattctaacttggatttaccccctggtttaagtccttgactgattacaatctgaccgtgaaggctgggcaggagaaacaggtagtgtccagattctccgtaaattccagaaagatccaaatgtggtccatcagcaggtgatggggcatagctttggttcacaccaacttaccccacactgacttgaagtatagtccatgaattcagccattgttctgaaggaagcactaagggttgggggtctctcttctctctatttgaataaatggcacgtcacaggttagctctaggattccctactggagaatgaagccattttggaaatagtctcctttttacttttggaaaggctctgcaagtttatgtcagaaagaacgatgttattgagaaagaattccacctctaaaagatagacatgcaatttatccaggatctaagagacaggcttgcaggctttcctctattatcagatgatagctgtaagattttttttttttttttttttgagacggaggtttcgctcttgttgcccaggctggagtgcaatggcgcgatctcggctcaccgcgacctccgcctcccgggttcaagcgattctcctgcctcagcctccctagtacctgggattacagacatgcgccaccacgcccggctaattttgtatttttagtagagacgggatttctccatgttggtcaggctgctttcgaactcccgacctcaggtgatccgcccgcctcggcctcccaaagtgctgggattgcaggcatgagccaccgcgcccggctaattttttttttttttttttaagtaaccaaccagggctgaacactaccgttattctacagctacccaacaagaatctgtcaaatgtaaagcgttttgaaaggacttttccattcattgttctgatcctttccagcttccgctaagggaaggtttcctcagctgcttctgcgctgcgcacccctggctcccagcgggctaccgcggcgcgaaggactggggcggcccccggcacagcgaccctcacctctcccgggagaacgcgctgcgggccggctgccggctgtttctctaggtggggcgcctcccgggcaaggacccccatgcagcctttgggacgctccagggcatgccagtccaccgccctcctcttggccctctccagcacttctagagccagccttgctgaacgctgcagggaacgtcggtccaccccattcagcgctgcggccgccaaacagttgtccatggctccctgagtgggcacacaacgtacaaacgccggcgggtcagctgggccgcggcgaccctgctccaaatccgggtgggagccccagcctcgacctccctggagaccaccgctcctggtccgcccccaacgcacactccagcgggagcccagccaggactaggcctagcgcgcccgccccttccattttcatctaccccttccgctacttagggagccccctcacccggctcactcgtcaaggcgcatgcgcgcaacgctatcctaggaagagggaccaggcctagcgctcccggcggcgccggcgcagctgggccattggcggaaggcgggagaggcgggagaggcgggagaagtgggggaggcggggcggctgggcggccaaacacgccttctgcgtcccagccttggcgtctgcgcgcgagttgcctggttaactgctgagcgctggaggcggggcgccgggcgctgggggccgggggtcgggggtcgggggccgggggtcgggggtcgggggtcgggggctgggggctgaggactgagtcgagccagcagcccagggcatctgtccacgctgtcagaggagcctctgggcgtggggctggcccttagagggctactgcgctgcttaacttggtgggtataaaggcaggtctcctgttgagctaaaaaattatggggtaccagctaggtaggcaacatagcgagaacccgtgtagacacacacacacacacacacacacacactagccaggagtggttatggggtaccagctaggtaggcaacatagcgacaacccgtgtccacacacacacacacacactagccaggagtggttatggggtaccagctaggtaggcaacatagcgacaacccgtgtccacacacacacacagtagsaggagtggtggcgcgcatctgtagtcccaggtactcgggagggtcgaggtgggaggatcgcttgaacccgggaagcggaggttgcagtgagacgagatcgcgccactgcactccagcctgggcgacagaggaagacttcgtctcaaaacaaaaacatcatggggaataaggcaagtgcctcccgcgcctctttctgcttggtctacattttggggtgtcgctactcttgtttgaggaggtgattaggccaaactgtgtggctgccaaggtggcctttggagaagggaacagctcgggattgaggcgagacggaggcggggctgtctgcagatgttcctggcccccggggcagggggcgcctgagaagttgtagggtctctcataatccctcagcgcagctctctctcccctccagtgggaagtacggattcacatatttttggagacctgttctcttggggtctgactccatcttttaggaagactgcaccatgtttaagtaaggaactgtgaatgcttacttaaaccatgtttaagtaaggacctgtcactccactccgctggttatttggtaggagatacagcccaggctctcactgctaattagtgactcagccgcaccacccagcgcaaagcaaagcgccgatgcttaggaaggtccactttgagggacacgctcagtgggggtcactttaaggaacacaaataaatcctcctttaagtctcctctgtggttcatgaaaaaggagagaaactccatcctcacctagtctcaacagatggcttgatgagcaattatcaggtaccaggtgagtagtagccgaccaatacgacctccttctatgctacttaacttttgcaaatttcctgctttccccttataaaaaagaataacagtgagtgaaaccctacattattcttgagatgatttttttttcattttattggtattccaaaacatttccttcaataagggtttatcaagtgcctcctttagaacatagtggttatacgtgcatggggtcctgtatatccactcgggagagctggtttgaattctggctctgccatctttttttttccatttcttctccttctccttctccttctccttctccttcttcttcctcctcctcctccttcctcttcctcttcttcctcttcttccttcttccttcttcttcttttttgtttaataaagaaacgagggtatcaccctgtcagccaggctgaagtgcagtggcacgatctcggctcactgcagcctcgacctcctgggctcaagcgatcctcttcttcagccaccacgccctgcaaattttttaaatgtttcgtagagacagggtctccctatgttgcccaggctctctgccacttttttgctctgtggttctgggcaaacatattacttctttgagcctcacttttcctcatctctatatctggggattccaatagtactaacttctttagactgagcttcttgagggaagggactgtatctgtagtgtttagagtttaaggtgcatctagtatttactattttgtctgtcacagtaaggactaaaaatagcccttgaatgtgtgaattgggttgccattaggattctgtgagataattcctgtaaaatgcttagcacagtgcccggcaaagataagtgctccatagacttagctagcattagtatgtgccaggcactgccctaggagttgtggagaacagaatgtggatcagactaaaggagaataaaaaagaggaaagaatgcacataaaatctataataccaagaacaaaatattcggacatgccataagattgacacagataaaatgctatcaagcttaggagactatgttcagctgggaggatcaagaaaggttttgcagagaatgtagttttcaagctaggccttgaaggatggcctaggaatcagtgagagaagaggtagataagataccrgttaactgcttttacaataagtgtggttggagtgggacagaatttggtcctctttattttttatggatttcaaggttttagcacattcctcatagggttattgtgaatatcaagtaagttaatatctataaagtgcatttatagtacttggtacatagtaggtgctcaataaatattagctagtattattatcttaagcttcagcctggtctcccaaaatatgctctcacttacccagtatcatagccacacctcatctcatttgtctctcttccccattctattttagtcattccagttgaggcactactttctttttgtcaggtcagctctttgaaacttttcccagtggttcccagttgccacctctgttgccatagccttaaaaaaattttttgtgtgtacttttccaatctaatttaaattatgtgtagttatggtttcttctctcccaatagcctttcaattccttgaaggcagaaactgttccttatttgtccctaaacattccaggacctgttaagtagcgggtgttcagtagccatttgttgaaattactctgatttaatttttaagttaaatagacttctgttagcccacataaagaggtggctttgtggtggctcacacctgtaatcccagaagttcaggaggttgaggtggaaggattacttgaggccaggagtttgacagcagcctgggcaacatagtgagacccctgtctctattttttaaaaaattaaaaaactagcctggcatggtggctcatacctgtagtcctagctactcgggaggttgagatgggaggattgcttgagtccaggatgttgaggctgcagtgagctatgatcgtgccactgccctccagccggggcaacagagtaagaacctatcttaagaaaaaaaagagttggcttttctattaaaaaaacacctacctacatgaactttaatgaatgtaatgaatattcaattgtaactacattttctcagaatttaacatttagaaatttatgggaaagaagatgcttgaaatgaaactgaaaccaaaagactctaaattaaatctttgcatttgtttttatttttctatttgtaaatatatttgtaaatatatttttatatgtgcatatttataattttaaagattcatcctgtaaaccacagattgagagacttgagagattcctttttatcttttttaagattggctgggaataatgatagaacatgacctaccatcaggccccttgtggatcaaatatagcccacgccaaatgaaagccactggtgagaactgaaaatggaattgtaaatggagagagggcaactaattaggaatgtgcctggtcaacagggaaatagactgtcagtattgacagaaaaataaactattgatatgagtttttaatgacttctatcttcacaagggtaaattcactaatgagaacanatgaaagttagttgtcagggttctatgttttggaggagatgcgttggaagaggtctttaattgtgaaatggggaaagagactggtgctstatttgggactttttgaggagaaaaacaagtccagtgaagagcaatgtaaattccttttctttatgtgaagngggccaaaaagggttaaaaacccaggatgcaaaagtgggtactgtgccagagttagacagtgatttatactgtacataccagaaactgtataaatcattttatttgacaaatggtattgttatttctccagcagacttaagagctttggaatcatcacagctttgtaaggtagtattacagactgagtcattagatcattcattttgcctgattacatcatctcactgggttattgggggaatgaaagaaactcattatcaaaattgtcatcttgatgatgtagattaaagaaaatgaatcaaacttctgagaattaactttcacaatctgtttaaaattgactgggagttaaaaaaattggttgcagagcaggaatgattgaaatcttgtcatttttaaaagtcagagatcaaaggaatagtatttggaagatatttaatataaacagttgaaatttatgtagagtttttttttttttttttttgaagacttcttggctgggcgcggtggctcacacctgtaatcccagcactttgggaggctgagatgggcagatcacgaggccaggagattgagaccatcctggctaacacggtgaaaccccatctctattaaaaatacaaaaaattagctgggcgtggtggcaggagcctgtagtcccaggggaggctgaggcaggagaacggcgtgaacctgagaggcagagcttgcagtgagccaaggtcgcgccactgcaccccagcctgggtgacagagcgagactccatctcaaaaaaaaaaaaaaaaagaaaaaaaagacttctttattgaggtataatgtacatatgataaaatttacctgtcttaagtgtatatttcagtattttttgtaaatttacagagttgtcaacatcaccaaagtgcagttttggaacactgtcattacctgagaaaaatccctagtgtataccatatgcagtcagttctcagctcctgcctctggtcctaggtgaccagtcttctgcttgctgtcttatgaattcgccttttctggacaattcatatagatggaatctgataatatgtgacctttttttgcctggcttcttttaattagcataatgtttttgaggctcacacatgtcgtagcatgtatcaatacttcattcttttttatgactgaatactatcccgttatatgaatatattacattttgtttatccatttactggttgatggtcatctgaaatgtttctggtttggggctattttgactgataatgcatagtaagactttgtgtggacacatgttttcatttctcttgggaatacagacttgagccgccgcacccasaccagatgtatgattcataagtattttctcccaggctgtgtcatgtatttcattttcttagtggtgtaatttgaagtactaacatttaaagttttgatgaactccaacttattaatttttttcctttataaattgtgcttttggtgttatatctaagaaatctttgcctaacctaaggtcatgaaaattttttttgaagattttttctatgtttcctcctaatagttgtatattttagtttttacatttaactctatgccattttgcattaatttttatgtgcattatgaggtaagggtctagattcatttcttttcatgcagatgttcaattttctcagtatcatttgtataaaagactatccttttctcattaaattcccttggcaactttgtcaaaaatcaattcaccataaatgtaagagttagcttttagactttaaattatgttctattgatctatatgtctgtccttatgccatattatactgtattgattattgtagttttgtagtaagtttggaaattgggaagtatatcaactatgttcttcattttcaaaattatttttatattctagtacagtcattatttccataaaatttaaattcagtttgtcaacttctgtgtaacaactgttgatgttttgatagagattatattgaattcacagattaattgaggaagaattgcaatcttaacaatattgggtttttgaatttatgaacatggaatgtctgtccatttatttcagttttctttattttttttactaatattgtgtagtgattagtgtacatattgcacttcttttaacaaatttattaagtatttttatgctgttgtgaatgaaattgttttctcaatttcattttcagatgaaattattactagtgtatagaaatatagttgactttttcatattgatattgtatcctgtaaccttgttaaactcatttacttgttctaagaatttttttgtggattctttaggattttctatatactggatcagatcttctgtgaataaagaaaggctaacttttttcttttcaatcaggacttctttttcttgcctaatcgcactggcttgaacctgtagtacaatgttgaatagaagtggcaaggggaacatctttgccttgttcccaattttagaggcagaacattcagccttttaccattaagtatgatatttgtttttttgtagatactctttattaggttaaggaagttctcatctatctttaaaaattatttttaattagcttcttcaggttgagaagaagtttccttctattcctggtttagtgaaagtttttatcatgaatgatttttgaagtttttcagacgttttttgtatgtccattgatgtgatcatgtggtttttattttttattctattaacatgtgttgaatgaattgatttttggatattaagccaatctttcgttgttgaatttggtttgctagtattttactgaggatttttctgtgtatattcatgagggatattgatctctagttttcttgtttctggtctttgtgtcttttggtattaggataatattggccttatagaatgatttaggaatgttctatttcttggaagagtgtgtagaattggtattattcttaagcatttgattaaaaccatctgggcctgggctttactttgtgggaagatttttaattactaattcaacttttttccttgttttaggtctacttatattttctattccttctttttttttttttttttttttgagacaaggtctcactcctgttgccaaggctggagtgccgtggcataatcacagctcactacagcctcaactccctgggctcaggtgattctcccaccttagccactcgagtagctgggactacaggcatgcatcaccactaggcccacctaatttttttrgtactttttgtagtagagatgtggttttgccatgttgcccaggctggtcttgaactcctgaactcaagtgatcttctattccatcttgagtcagtttcaatacttggtgtctaagaatttgcccagtcacttaagttgtctaatttgttgacaaaaagctattggtaatattccctcacaatcttttttatttctttaagatctgattatggtaatctgtgccttctctctcttgcttttttttttttttttttaacatcttggtcagtctagttaaagttttgtcaacttgtaatatcctttttttttcttttgagacagtctcactctgtcacccaggctggaatgcagtagtgcaatctcagctcactacaatctccgcctcccaggttcaagtgattgattcttctgcctaatccacccaagtaacagggattacaggtgcatgccaccacacccgactaatttttgtatatttagtagagacagggtttcaccatgttggcctatgctggagtgaaactctgtctcaaaaaataaataaataaataaaactttaaaaaatacagatggccaggtgtggtggctcatgcctgtaatcccagcactttgggaagccaaggtgggtggatcatgaggtcaagagatcgagaccatcctgtccaacatggtgaagccccatctctactaaaaatacaaaaattagctgggtgtggtggcgcacgcctgtagtctcagctactcaggaggctgaggcaggagaattgcttgaacctgggaggtggaggttgcagtgagccgagattgcaccactgtgatcaaatgtaaattcagccatctcgataataatgttaaatgtgaatggtctcaacagcccattctataagcagagattgtcagactggcttagatccaactgtctgtctacaagaaacacaacttatagtcaaacacacaaataagttgaaagttaaagaaaaagatataccatgtaaactataagcataatattgctggagtaaagaaacagaatcctgcagataccttgattgtagtccagtgaaaaccatttcagacatctgacttccagaaccttaagataataaacttgtgttgctttaagcgactccccttgccaaaaaaagattgctgaagtaaatgtattaacatcagacaaaatagacttgaagacaagaaatatcactagacaaagtggggcatatcagaatcacaaaaatgacaaatcattacatctggaagatatagcacttgcaaatgtacatgaccctaacaacacagcctcaaaataccaaagcaaaaactracaaaattcaagcaagaaatagacaattcaacagtggtagttggggacttcaacacctcactctttttttttttttttgagatggagtctcactctgtcacctacactggagtgcagtggtgtgatctcagctcactgcagcctctgcctcctgggttcaagtgattctcctgcctcagcctcctgagtagctgggattacaggcgcgtgccaccacacccggctactttttgtatttttaatagagacagggtttcaccgtgttggtcaggctggtcttgaactcctgacctcatgattcgcccacctcagcctcccaaaatgctgggattacaggcatgagccaccgtgcccagcccaatcctcagtcttaataactgatagaacaaacagaaaatcagcaaagatatagaaggctaaacratactgtcagccaccttgacacctataggaaactccatccaacaatagcacaatacacattcttgtcaaatactcccagaacattctccaaaacagaccattattaggtcataaaacaagtctcaatgaatttaaaaggactgaaatcataccaggtatgttctctacccacaatagaattaaattagaaatcaacaatagacaatttggggaatctacaaatatttgcaaattaaacaacgcataggtaaataatccatgggtcatagactaaatcacaagggaaactaggaaatgttttgaactgaaaggaaacaaagatgtgatatatcaaaatgtatgagaggcagctaaaactgtgattagagggaagtgccaagctttagatgtctatattagaaaagaatataggtcaaatcaataacctaagtttctaccttaagaaactaggagccgggcatgctggctcatgcttgtaatcccagcactttgggaggctgaggtgggcagatcagttgaggtcaggagttcgagaccagcctggccaacatggtgaaaccccgtctctactaaaaatacaaaaattagccagatgtggtggcatgcacctgtaatcccagctactcgggaggctgaggcaggagaatcacttgaacctgggaggtggaggttgcagtgagctgagattgcaccactgcactccagcctgggcaatagagcaagactccatctcaaaaaaaaaaaaagaaaagaaaagaaaagaaaagaaaagaaagaaaaagaaaaactaggaaaagaagaacaaactaaacccaaaggaagcaggaggaagggtataatgatgattaggtagaaatcaataaaatacaaagtagaaaaatagagaaaaatcaatgaaaccaacagttggttctttgaaaagatattaaaatttgggccaggtgtggtggctcacgcctgtaattccagcactttgggaggccaaggtgggcagatcagttaaggtcaggagttcaagaccaaggtttcactcttgttgcctaggctggagtgcaatggcatgatctcggctcactgcaacctctgcctcccagattcaagtgattctcctgcctcagctgctcaagtagctggggttacaggtgcccaccactatgcctggctaatttttttgtatttttagtagagagagggtttcaccatattggccatgctggtcttgaactcctgacctcaggtgatctacccacctcggcctcccaaagtgctgggattacaggcatgagccaccgcacccggcctttaaaaaaattttttagtgattgttctaggaattagaatatgcatctttatttgtcacgatctacttctttctttttttttttttgagacagggtcttgctctgccacccaggctggactgcaatggcgcaagtgtggctcactgttgcctccacctcctaggctcaagtgatccccccaactcaacctcctgagtagctgggaccacaggcacacgccaacacacctggctaatttttttttttttttttttgagatggagtctcactctgtcgcccaggctggagtgcagtggcacgaccttgggcactgcaagctccacctcccgggttcatgtcattctcctgcctcagcctcctgagtagctgggactacaggcaccaccaccacacccagctaattttttttttttttgtatttttagtagagacggggtttcaccgtgttagccaggacagtctcgaactcctgaccttgtgatctacccgcctcggcctcccaaagtgttgggattataggcgtgagccactgtgctgggccaatttttacattttttatagagatggtgtctcatcatgttgcccaggctggcctctaactcctgggctcaaacagtccacccatctcggcctcctaaagtgctgagattacaggtgtgagccaccatgcctggccacaatctactgattgatataaacttaatttaggtgaaatatagacacttctgtccaatataactccatatccccccttctcatgctgttatattacattcatatatgttacagatccaacaagacagtgttacaattattgctttatatgctcttatggcttttaaagaagttatgagaaaaagtgagaaacatatgtatagagtcctttatattaaccaatatatttactatttctgatgttctacattcctctctgtagatttgagtaactctaaaatcactttccatcagcctgaaaaacttccttcagtatttcttgtaaggcaagctggcaacaacaaattttttcagtctttgtttatcaactgtctttatttcaccttcacatttaaaggctataaggctatttttgctggatataaaatttttagttggcagattttttttttcctttaaacactttgatccctgctttcttagtctctgttgtttctgataaaaagtcatctgttaatttgattgtggtttctttgtaaatgatgatccacttttctctgctgcttacaagattttctctttgtgtttgcctttcaacagtttaaccttggtgtttctaggtatggacctctttgtgtttatggtacttggagttcttttgatcttcttggatgtgtagatttgtttttcctcaaatttataaagttttcagccatttttttctgtccctttctctttctcttctttttctgggactctccttatacatatgttagtatgtttggtggtatctctcaaatctctgaggcttgttcatttttcttcattctttttcttttcttttcttcaaatygtataatctctattgatctatctatcttccagtttactgattctttttctgtaatctgaaatttgctcttgagcccctctagtgaattttcatttcaattattttcttttcactccataatttgtttygttttataatttatttttattgatattctatattgtcactgttgccatactttaatttttaaaattttgttttctttagttctttgaacatatttacaacagctgccttgaagtctgtctgctaagtctaacatttgggcccctacagaaaaagtttccattaactgcacctttttctatatatgggccccactttttgtttgtatgtcttgcaattttttgttgaaaactgaacattttagatcagaggtcaacaatttatttctataaatgactggatagaaaatattttaggctttgtagtcaatgtggtctctattgtaatgtgaaagtagccatagacaatatgtaaatgaatgaaagtagatgtcttccaataaacctttatttaaaaaacaagcagtaggccataattgggccatgagctgtagtttgctgatcgctgttttaaataatgtatgatggcaactccagattctgatttccatccctacctaaggatttttgatattgctgctgtttgttggtttatttgtttagtgagttaacggggttgattctgtagtctttctttcctgtagtgtgtagctactgacatcttttcttaattttttcctttctaattcttgtttttattttattttacttcattttattttattttttatgagatggggtctcactatgttgtgcaggctggacttgaatttctgcgctgaagcagttgtccctcctcagcctcttgagtagctgggactacagatgtgtgctgctgtgcccaatttggttttatttttaaatctctttcctaggaattgcccctgggtcaacatagctagtggtcagctaataactgggaagagattgtacttaaacatcttgagcctagtaaggctctactgtttgctaattaatctgtgtatagtttggggaacacctttaaagttcagtcaaggccatgtggctatggcttatgcctataatcccagtgctttaggaggccatgacaggaagactgcatgataccaacagcttgaggccagcccaggtaacacagcaaggccctgtcttcgcaagaaatttttaaaaaattagctgggcatggtggtgcatgcctgtggtcctaactgtgggaggattgctggagcctaggagttcaaggttatagtgagctgtaattgtgccactgtgctccagcctgagcaaccatgtgagaccctacctctaaaaaaacaagaacaaagaaatagagttcagtcaagtctgccccaattttatttctatgtatgcaaggcttcacattcagccattgaaatctgtagcccactgtggtctctcctgggcatgtgcataaccgtgcccttgtacacagccttccagaccaccaagggtatcaggttccactatggctgtctttttccctagatctgcctattaaatttctggctggtctgttacttttcccaaccaaaactacagtttcagccagcaatgatattgactttccctgatcatttactaccaagatcacatgtttctgacaatgtcctatgcaccaaattacattgcagagctgctgattttcatggattttactgtcctgatagaactactatgttggagctgggggtagggagtgtagggattgcaaaaactcaaaataccatagattcatatttttcttaccaaggttcaatagtttgatttttttcctttataaatgctttttaatttgtcatgtgcctctggttagttagttagtttgtttgtttgagatggtgtcgtgctctgttgcccaggctggagtgcagtggcgcaatctctgcttactgtaacctctgcctcccgggttcaagtgattctcctgcctcagcctccagagtagctgggattacaggcatgcaccaccacacctggctagtttttwaaaaaaaaaattttttttgtattttttgtagagatgggcttcgccatgttggccaggctggtcttgaactgctgacctcaggtgatccacccgccttggcctcccaaagtgctgggattacaaggcatgagccaccgagcccagtctcagttttcaaaatcctgaaatgattgttttaacagttttgtacagatgttctttgacctaggaaggagttatatcctgataaactcattttaagttgaaaatattgtaagtcaaaaatgcatttaatacacctatctgaaaacatcgtatcttagcatagcctaccttaaacatgttcagaacactcacattagcctaaagttgggcaaaatcatctaacacaaagcctattttataataaagtgttgaatatctcatgtaatttattgaatgctgtactgaaagtgaaaaacagaatggttgtgtgggtattcaacatatggtttccactgaatgtatatwgctttygcaccatcataaagttgaaaaaaccgaagtcaaatctttataagtcagagactacctgtacagttttattgcggctttatgttaaacgatttgccagcctcctcactatgccattctggaagtgttccttgtgtagagttttagtgacctaaaaaaggtcacagtatttcccgacagatccagcagttttcaaaaattaatatattccaattcctgytcccttccaattttatattcctcctaaccttttttgtgatataattctggactctcttaaggcttacttttatatattcttttaggataaagcttatatttattccttccatcaatatttatttatttgttccatggacatttattaaacctcttctgtgcattgatactggaatgtatttccactccaggaagctctaacaagtagagtaggtagccagatctccagggttagtattataccagttctagagaaaattttatatctcctagcttatactaagtttacctaattataattatgggtatactctatttaataaaygtaagttatactgtgattatattactgtttgcattcaagtatttatatccctcagttttgtgacttctttttccagtcatataccataccctccacattttttttccaatttctaaaattgtggtaaaatacacataaaataggccggtcatggtggttcatacctgtaattcgagcaccttgggagccagagatgggaggatctcttgaggccagaagttcaagaccagcctggtcaacatagcggaacccccatctctaaaagaataaacctttctttaacaaaaaataaaaataaaaaataaaaaaacacacaaaataaaatatagttttctaagcatttttaagtgtatacttcagtggtattaaatatattcaaaatgtgcaactatcaccaccatccatctctatacttcttttcatcttgtaaaactgaaactctgtattcgttaaacaataattgtctattcttccctactcccagcccctggaagccaccaatctgtcttctgtctctattattttgactactgtaagtacctcatataagtggactcatacagtatttttcttctcgtgactggcttatttcatttagtataatgtcgtaaagtttcatccatgttgtagtatattgcggaatgtccatccatttttttwaaaattttttttatactttaagttctagggtacatgtgcacaacgtgcaggtttgttacatatgtatacatgtgccatgttggtgtgctgcacccattaactcgtcatttacattaggtatatctcctaatgctatccctcccacccccctaccccacaacaggccctggtgtgtgatgttccccttcctgtgtccaagtgttctcattgttcacttcccacctatgagtgagaacatgcggtgtttggttttttgtctttgtgatagtttgctgagaatgatggtttccagcttcatccgtgtccctacaaaggacatgaactcatccttttttatggctgcatagtattccatggtatatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagaaatgggatcactgggtcaaatggtatttctagttctagatccttgaggaattgccacactctcttccacaatgtttgaactagtttacagtcccaccaacagtgtaaaagtgttcctatttctccacatcctctccagcacctgttgtttcctgactttttaatgaccgccattctaattggtgtgagatggtatctcattgtggttttgatttgcatttctctgatggccagtgatggtgagcattttttgatgtgtctgttggctgcataaatgtcttcttttgagaagtgtctgttcatatcctttgcccactttttgatggggttgtttgtttttttcttgtaaatttgttggagttcattgtagattctggatattagccctttgtcagatgagtaggttgcaaaaattttctcccattttgtaggttgcctgttcactctgatggtagtttcttttgctgtgcagaagctctttagtttaattagatcccatttgtcratttttgcttttgttgccattgcttttggtgttttagatatgaagtccttgcctatgcctatgtcctgaatggtattgcctaagttttcttctagggtttttatggttttaggtcgaacatttaagtctttaatccatcttgaattaatttttgtataaggtgtaaggaagggatccagtttcagctttctacatatggctagcaagttttcccagcaccatttattaaatagggaatcctttccccatttcttgtttttgtcaggttcgtcaaagatcagatggttgtagatgtctggtattatttctgagggctctgttctgttccattggtctagatctctgttttggtaccagtaccatgctgttttggttactgtagccttgtagtatagtttgaagtcaggtagcatgatgcctccagctttgttcttttggcttaggattgacttggcaatgtgggctcttttttggttccatatgaactttaaagtagttttttccaattctgtgaagaaagtcgttggtagcttcatggggatggcattgaatctataaattaccttgggcagtatggccattttcacaatattgattcttcctatccatgagcatggaatgttcttccatttgtttgtgtcctcttttgtttcgttgagcaacggtttgtagttctccttgaagaggtccttcacatcccttgtaagttggattactaggtattttattctctttgaagcagttgtgaatgggagttcactcatgatttggctctctgtttgtctgttattggtgtataagaatgctgtgatttttgcacattgattttgtatcctgagactttgctgaagttgcttatcagcttaaggagattttgggctgagacgatggggttttctaaacatacaatcatgtcatctgcaaacagggacaatttgacttcttcttttcctaattgaataccatttatttctttctcctgcctgattgccctggccagaactttcaacactatgttgaataggagtggtgagagagggcatccctgtcttgtgccggttttcaaagggaatgcttccagtttttgcccattcagtatgatattggctgtgggtttgtcataagtagctcttatwattttgagatacgtcccatcaatacctaatttattgagagtttttagcatgaaaggctgttgaattttgtcaaaggccttttctgcatctattgagatagtcatgtggtttttgtctttggttctgtttatatgctggattatgtttattgatttgcgtatgttgaaccagccttgcatccgagggatgaagcccacttgatcatggtggataagcttttcgatgtgctgctggattcggtttgccagtattttactgaggatttttgcattgatgttcactagggatattggtctaaaattctctttttttgttgtgtctctgccaggctttggtatcagaatgatgctggcctcataaaatgggttagggaggattccctctttttctattgattggaatagtttcagaaggaatggtaccagctcctccttgtacctctggtagaattcgactgtgaatccatttggtcctggactttttttggttggtaagctattaattattgcctcaatttcagagcctgttattggtctattcagggattcaacttcttcctagtttagtcttgggagggtgtatgtgtccagaaatttatccatttcttctcgattttctagtttatttgcgtagaggtgtttatagtattctctgatggtagtttgtatttctgtgggatcggtggtgatatcccctttatcattttttattgtgtctatttgattcttctctcttgtcttctttattagtcttgctagtggtctatcaattttgttgatcttttcaaaaaaccagctcctggattcattgattttttgaaggtttttttgtgtctctgtcgccttcagttctgctctgatcttagttatttcttgccttctgctagcttttgaatgtgtttgctcttgcttttctagttcttttaattgtgatgttagggttttagatcaattttagatmtttcctgctttctcttgtgggcatttagtgctataagtttccctctgcacactgctttaaatgtgtcccagagactctggtatgttgtgtctttgttctcattggtttcaaacaacatctttatttctgccttcatttcattatgtacccagtagtccttcaggagcaggttgttcagtttccatgtagttgaacggttttgagtgagtttcttaatcctgagttgtagtttgattgctctgtcgtctgagagacagtttgttacaatttctgttcttttacatttgctgaggagtgctttacttccaactatgtggtcaattttcgaataagtgcggtgtggtgctgagaagaaagtatattctgttgatttggggtggagagttctgtagatgtctattaggtccgcttggtgcagagctgagttcaattcctggatatccttgttaactttctgtcccgttgatctgtctaatgttgatagtggggtgttaaagtctcccattattattgtgtgggagtctaaatttctttgtaggtctctaaggacttgttttatgaatctgggtgcttctgtattgggtgcatatatatttaggatagttagctcttcttgttgaattcatccctttaccattatgtaatggccttctttgtctcttttgatctttgttggtttaaagtatgttttatcagagactaggattgcaacccctgcctttttttgttctccatttgcttggtagatcttcctccatccctttatgttgagcctatgtgwgtctctgcatgtgagatgggtctcctgaatacagcacactgatgggtcttgactctttatccaatttactagtctgtgtcttttaattggcacatttagcccatttacatttaaagttaatattgttatgtgtgaatttgatcctgccattatgatgttagctggttattttgcctgttagttgatgcagtttcctcgtagcattgatggtctttacaatttggcatgtttttgcagtggctggtaccggttgttcctttccatgtttattgcttccttcaggagctcttgtagggcaggcctggtggtgacaaaatgtcttagcatttgcttgtctgtaaagaattttatttctccttcacttatgaagcttagttggctggatatgaaattctgggttgaaaattcttttctttaagaatgttgaatattggcccccactcttttctggcttgtatagtttctaccaagagatccactgttagtctgatgggcttcactttgagggtaacctgacctttctttctggctgcccttaacattttttccttcatttcaactttggtgaatctgacaattatgtgtcttggagttgctcttctcgaggagtatctttgtggtgttctctgtatttcctgaatttgaatgttggcctgccttgctaggttggggaagttctcctggataatatcctgcagagtgttttccaacttggttccattctccctgtcactttcaggtacaccactcagatgtagatttggtcttttcatgtagtcttatatttcttgaaggctttgttcatttctttttactcttttttctctaaacytctcttctcacttcatttcattaatttgatcttcaatcactgataccctttcttccagttgactgaattggctactgaagcttgtgcattcatcacgtagttctcatgccatggttttcagctccatcaggtcatttaaggacttctctacactggttattctagttagccattcgtctaatcttttttcaaggtttttagcttcttctcgatgggttcaaacttcctcctttagctcagagaagtttgatcatctgaagccttcttctctcaacttgtcaaagtcattctccatccagcttgttctgttgctggcgaggagcttcgttcctttggagggggagatgtgctctgatttttagaattttcagcttttctgctctgttttttccccatctttgtggttttatctacctttggtctttgatgatggtgacgtacatatggggttttggtgtggatgtcctttctgtttgttagttttccttctaacagtcaggaccctcagctgcaggtctgttggagtttgctggaggtccactccagaccctgtttgcctgggtatcagcagtggaggctgcagaacagtgaatattgctgaacagcaaatgttgctgcctgatcgttcccctggaagttttgtctcagaggagtacccagccgtgtgaggtgtcagtccgcccctactggggggtgcctcccagttaggctactcgggggtcagggatccacttgaggaggcagtctgtccattgtcagatctcaaattccgtgcttggagaaccactactctcttcaaagctgccagacagggacatttaagtctgcagaggtttctgctgccttttgtttggctatgccttgcccccagaggtggagtctacagaggcaggcaggcctccttgagctgcggtggactccacccagtttgagcttcctggccgctttgtttacctactcaagcctcagcaatggcaggtgcccctccctgagcctcgctgccaccttgcagtttgatctcagactgctgtgctagcaatgagccaggctccatggacatgggaccctccgagccatgtgcgggatataatctcctgttgtgccgtttgctaagaccattggaaaagtgcagtattagggtgggagtgacctgattttccaggtgctgtctgtcacagcttcccttggctaggaaagggaattccctgacccttgcgtttcccgggtgaggcgatgcctcgccctgctttggctcatgttcattgggctgcacccactgtactgcacccactgtctgacaagccccattgagatgaacccggtacctcagttggaaatgcagaaatcacccgtcttctgtgtcsctcatgctgggagctgtagactggagctgttcctattcggccatcttggaaccacctgtccatcctttttaaggctgaataatattctgttgtatgcacataccacatttgcttatccattcatccattgatggacatttttgttgcttccacattttagctattgcaaataatgctgctatgaacatgggtttataaatatctctttgagaccctggtttcaattttttgggtatatacccatggttgaattgctggaacatatggtaattctatttataactttttgcagaatcaccatactgttttccacaatgactataccactttatattcccaccaagagtgtacaagtgttccagtttctccatatcctcaccaacatttgttacttttattttgcctttgttttccttaatggtagccatcctaataggtatgaggtggcatctcattgtagctttgatttgcatttccgtaatgattagtgatgttgagcatcttttcatattgttattggctgtttttgtatcttattttgagaaatgtctattcaagttctctgcccattttcgaattatgttgttttttgttgtcgagttttaggagttctctacatattctggatgttaatcccttatcagatatatgatttggaaatatctctcattctgtgggttgcatttttactctgttgacagtttcctttggtgcccccaaatttttaattttaatgcagtgcaatatatcaattttttcttttgctgcctgtgcctttgtgtcatatcccagaaatgattgccaattcaacgttttgaagctttggccttatgttttcttctaagaattttattgttttaggtcttgcatttaagtctttgattcattttgagttaatttttgtataggcgttaggtaagggtccaagttcattcttgcaacaatggccaccagcctctttctctgcacatctatgatcagaagcagcaatcagcagacagagcacagatcactgacatttgaaggacaagatcctttttgcccatcstggctccagcaagctgtttcaggaaatgtgtacagctgcctgccatgggggtggtcatgggtagcgtccactacactaagagcngaaattgaccaaaattaaccacaatttaggtccaagccttttcctggaagtcacaaaccttcaatagactctagagttccaaaataattacatcagacagatgctgctgtgcaaatgttgtctagctggggagagacattccagcagcttcctactccaccagaatgctgtctccttctccacattttgtgcagagaacataactggcctccacacaaagtttatttttttctccccatccccagtagtaacgaaggctaagatgttccatttgggagggaggggcagattgggtgtatactggaagtcacagatggtggttgtggatcatggggagggacctcagggttgaggtggctcaaattgttatctgaggtgccttggctaaaggatattatagcaggtagagaggtatgtcaccttttatattactttattcctttgattagggaagttttgctcccctttgtgaccaggcaagactgggcataaggtatgtggggcagaggatccttctagtatgagaaagaagaaagagaagatgtgtggttaggattggagctgaatagaacatgtggctggtggagagagaaaaggtatggaagggctgagtagactttatgcaagacagatttatttggttgacagtagatattatcagttaacacatatattatcatcctttttgcagttaagtaaagtaaaataaggtgaggtaggaggattattttagtaaagatagtagagggattttcaaatccattttctgttatacagtggggagagagggaaaatactagcaaatgtttcaggcaaattgattctaaacctggttctctgactaacttaatctttgactacaaccaaattgtttaacctgcytaagcattattgctagcacttgtgaaatgagatgttagaaaaaaatgaagataatgcaaaatattttgaaaaattatttgctatataaatgtaagaaagctttatcattctataatgccaaaatattaagagctgctgcaaaatgaaaatttattgtaagataaatcttcacaggccgggcgtggtggctcaccgtgctgtaatcccagcactttgggaggccgaggtagatggatcacctgaggttgggagttcaaaaccagcctgaccaacatggagaaaccccatctctactaaaaatacaaaattagccgggtgtggtggcacatgcctgtagtcccagctacttgggaggctgaggcaggagaatcgcttgaacccggtaggtggaggttgcagtgagccaagattgcaccattgcactccagcctgggcaacaagagtgaaactctgtctacacycctgccaaaaaaaaagataaatcttcaccaaaatcatgatgaaaattaatggaacggtaagatttaatttactgcaaaaatccaacagacatgtattgagtacatgtttgttgagccgtgatgttcatgtatgttaaaagtgacggacagaccactgatttaattgtcataaatcctacaggtactatcatctaaaatttctcggtgcccttttctgcttgttgtgtctatgatgctagtttaactcagtacatttgctttataaaaagccagagaaagatgatagtctgtttatctaggttctccaaagcatttcctgccaggcagttgacatgtagccttggcacaatttcaggaaactgtttgcttctgtttaccctttccagatacagcatctcctaagaattgaggtgaggaatctcctttaacttttttacattttagaagtatactttattctaacactttagaatgctcttcatgtaagagcaatgaaaatctttgtgtctttaaattaaaaaggatatgttttagtgcttcactagtagaaaaggcaaagccttaaagcaagttaacctaataagatgtactcagaagaatatttctaggctgggcgtggtggctcacgcctgtaatcccagcactttgggaggctgaggtgggaggattgcttgaccccaggagtttgacaccagcctggacaacatggtgagaccttgtctctacaaaaaaattttaaaaattagcctgatgtggacctgtagtcttagctacatgggaggctgaggcaggaggatcacttgaacctgggaggtcgaggctgcaatgaaccatgattgtaccactgcactccagcctgggtgacagagctgaaactctgttctccccccgaaaaaagttagaaaaaaaaagaatattcctttcctggaatattgttcacattagtctctctttcagaaaattcaatgtaattatagctgaacatacaaaacttattaattatgggatagttgtcaccatttccaaaatccttctttactatgaaaaagaacccaccactgaatttcttcagaatggtatgcttttcttgattcaattataatatttttctttttatataacatttcagaaatattcagttaagtggcatagacattatatttgaaaaataagttactcaacatttttattccttattgggagccaatttgtttctaaatgttttaaatactcattatgtagttagaaatgcaggaatgtattatagctttattgcactcccagagtacatgttaattaagtatgcataaatatatctttgagagaatgtggtggcaaatgtattaatttagagattgaaagcttgaggtgtggaaagatataataacaatgcacatactacagttaattgtgagcaaatttatatcctttctgcatattgttgtcacataaactaatcatctcttaattactttgtccttccagaatgaattaaaaaagattctataattttagccagcactaganctataggcagccgtgggtggggaagcaggataagaaactgtgatgagactgatatgcatggcatgggacaggtggcaagagaataatttagtttgtgatcaggcctaggcctggggtcaggaaccagataagcatttcagattggtagcatatctgtgacccaagattacaacaaggccatggatcagagccaaatggcctctgaatggcaaggatcatggcaagsaacaggtcagagacaaagcggaggaggttgtcacacaggtaccaatgggattggtagatggggaagaatgagcaaatatccagagttgggagtctcaaagttaagttctgccgttagaaaatggccccttagtacttctggacaacatagatctcttcccatcttcctttcctctctttacaaggtttcagacttagttggaagacatgactctggctttaacacactgatattgaagacttatgggctgagatgaatggctccctgtttaagagaatcagaagtcaacatagcttgcagagtaggtctagagagttctgccttaaagggtggagtaataaagccaaaggattcagcaaaccaagggtcatcattggtaccatgcatgaagagttatcttcatcttgtgaaattggtgactttgctccattctgtgacttatctctgttttgaaaccatattaactcctaggctgcctggtcctgtaaccatcgatcactgaatgactgccttaacccaatcctgtaaacctaccacaacttaattcttagaatttctagctgaatatactagaggaaataaagaataggaaatctaaatcagatgtggtggctcgtgcctacactctcagctacttgggaggcagaggtgggaagattgcttgagcccaggagtttgaggctgcagtgagctatgcttgcaccactgaactccagcttggatgacagatcctgtctcaaaaaaacaaaaaacaacaacaacaacaaaaaaacaaaggaagtccgaagaggattttttttttttttctgttagtagactagtattagtatccttttagggactgaccccatccccaccttcactgaattgcctgtcatggagaaagcccttaataaatgttggttgaatcgtgaattagagggtcttcaagtgatcaaagtaactgaatgaaaggagtgagagagcaacttctgacacaggcatagagcctgaatgcattttgaagatgtgagagagatggaactgtatctctatagaggaaaatctaagaagtcaactaagatacaaagaaattactgacctagccaaggctatagaaccattgagggcagtactggaaagaatggggtgtcttcatttctagatttcatgctgtgcacactaaacaaatggkttgtaaagattcaaaacatcgcttaagtcagccaaaaatgtttttctattaatctaaagtttgagtaagtgaaattttgaagacgatggtatctaattgataacttccttactccttaacctgtagataatctccctttttaaagtgctcattacagtagtgattatgtagagaaaaagcttctgatgaaaatgtggtataaaattgtattctttgttcagcaagttaaaacaagctggtctgtaagcaattattatcttcatcaaatttcctagctctaatgttttggcttcataggcccagcacgtatgccttctcaaacaattggatggttttaaaacacttatgagatgtttgtgcttatatcttaacatagcatcagttcaacaagaaaaagaaaaagaaaatgtaagatttggcattagggcttagtttgaaaaagaaaatcaaaccaaactaaagaaaacaaaaagcccctaatgacacttaatccctgcataggaatgaacattcttcattcagcttcataatgcccttagtagcagtgctctagttaagagttcagaagtgtctttcttttcttcactctttaatcacttgacatttttggaaaagaaatttatcagaatgcttgttggctaaccactattaatatttttatatgggtcatatattctaaagagatctctttttgccttttctttggttttatttgtagttatcccaaatgaaaacaacaacaaaatgtgttctgtattctaagagctgttcaggtacccatctgggtgarcagatgatttaaaactgaattagctttttgaattctgtgcaagtaactctgtgcaagttactatgaagaatgcgcctttgtataagcttgggaatgtttattttaaaaataatatttaaaaattatttgattgattgagacagactctcactctgtcgtccaggctggagtgcagtggtgcaatcacagcttactacagtctcaaccttctaggctcaagagatccttccacctcagcctcccaagtagctgggatcacaggcatgcaccactattcctggctaatttttgtattttttctagagacagggccctgctgtgttgcctaggctgatctccaactgctgggctcaagcagtccactcaccttggcctcccaaagtgctgggatcacaggcatgaaccacagtgcccaaccaaaaaatgataatcttttaaaattaaaaataaccatagatgcattttgaaacttacataatatttttctagtgggttaggtttctggttacattctatgattaattaattattacatagtcaaatatttatactgtatgttcacctgaaattattgtaattcaacagctatttattgagtaacagccatttgctagaggttaaagatggaacttatactgatagataaataacccatgctttcaagaggctcacaatctggcagtcagcagattggctcatggtgagcaatacttatgaacaatggttaygggctatgaagygagccttgggtgccaagggagagagtaatccattctcccaaggagtaggaagaagtcggagaaggctttattaaaaaggtgacatttgagttgggcctatcagagatgttacctttcataatattttctgggaaataacaagttgtttatgagattggagcataggatgccagaagccagcaatgtaatgtaaagtttgaggtgtctggaacatctaggtgcagatatccacaaggtagttggaagttcaggtctagaaattaaaagagagaagtcggagctagagataatagtttggcaatatcagctaaattgaattgaaaccatgcaagtagataagatgtccaggatgggctgtgtagaagagagccaagaaaaaaaaatccaattaaagagtatacagagaaggagatagtaaatgaaggccagtgaaaaagagtggtcatagagacaggagttgatagagatattaagagaatagagaagttaagtaagaagctcaagatgctctagagaaaaggaacaacaagaacaagactggccgggcatgctggctcacgcctgtaatcccagcgctttgggaggctgaggtgggtggatcggtcacttgaggtcagaagtgcaagaccagcctggccaacgtggtgaaatcctgtctctactaaaaatacaaaaagtagccagccaactgtgatggcaggcgcttgttaatcccagctactcaggaggctgaggcacaagaatcacttgaacccaggaggcagaggttgcagtgggccgagatcatgccactacactccagcctgggtgacagagtgagactgtctcaaaaacaaacaaacaaaaagaacaagacagagcatttggaaattaaaaaatcatagttgaaattttaaaaattgatagaagaatcagaagaaaaaatttacaaaatttcccatacagtagaacaaaaagacagtaagatggacaattaggagatcaaccaaagaggtccaacatagaagtcacaggagttgtagaaagagaaatttgagaaaatatatgggatgaaattattaaaggaacagtacaggaacatttactggaactatagaacatgagcctccagattaaaaaggcccacaagtgccttagaacgatgtttgaaaaagtacccatactaaggcacatcactatgaattttcaggaaaatatcctacaagcttccaaagacataaaaatatatacattatatttcccagctggtaaaaaaaaatttacctcctctgcagcctttcacagaaaaccactggaggagatactcacaaaaatgaaggggaagaacaggaaacaggaagacatgagatgaaggaaacaggagattcaacatgggtaagggtcgttcttcaaaataagtagagtaagcatgcttctgagacaggagatgsgggaatgaagatacatttggacatggtaagggaaagttgagggaatttacatttctcctttctcagtggtgaaggcaaggttacctcctgagagtgagtagttggaagttttgggaagagacaggcttgggacagttgctgtggggaacaagaagaggatcgaaatcactaggaataaaaggattgttgagcagtattcagtattaggaggaggtttgtagtgaagcctgtcagttttatttattattttttagagacgaagtcttgctacctctaggagataacargcgtgaccatagccactgtgacctcgaactcctagcttcaagctatcctcctgcttcaaggcttgtcaattttagaaatgaagatagtttttctgtcaggcagctttagtgctgtttattggagatcactttatcttgagatgctctgaagatgcattttgcaacacaaactgaattattgtcagaaaatgatttatttcttcacagtattgaaatctctattctggaaagctgaggctcttagcaattacatataataaatcacatttggtagtaaaaactacacacacacacacacacacacacacacacacacacacacacacacagttcaaagtgacagcttccagtgcatctgtaacctaggctttttgagctcttaaatattttggctcttcaagtcttgattagttgaaagttgactgatgagtacctaggaggaaggaattaagaagagcatagaatgccaattatcctaaaagaaaaggaaaaaggaagcaaagaaggaaaggagatgtaagagtttgaccttctaggagactgaagatggctctgtcctttgtctgtggtatgtcaaccatgttccccagcataatggaaatgttggggtaggctgctgcttagttagcaatagagtagatgcatgaaaactaccaccaccattctattggtacctaaatgttcaaagtaataactctgactgtacaaawgttaatgtgactaaccttttcataacttactatttcaatcgaaactccctaagcatttatcgttccattattttattagaatgcttatttgaattcactaagcatgtgaatttggtcatctctgactgaagttggtatctcctccttgcctctaacctctagtctagaatttcccataatttttttttcaatcatatgtacctagcatagagactctgattcaggatatctggagatgtcttggaccagagcattgcattttgaaaagcttctcgggtgatttttttttctccagaggacaaatattttattctttaaagaatttataaaggaattggaagatgactacagttctctttgggtgatttttgacatgcaccaaaggttaagagctacttttgtttctagagttattttcctcaaatgcacatcatgtcactcttctcaaaaatattgtctctccacatccttcagaatcaaattcaaattccttcatattgccttcatatccttcctagatctgatcctgtatcagtcaggaggagctaagcttatgctgcaataacagcttctcacatttcagtggcttaagacaatgaggatatttcatacatatccagcatggccagcatggatcagtagggaggtattggtttattcagggatccggtccgctacagtctcacatggctttgggtttatgtggcagagaagagaggcatggacatctcttaccccttcttcaatgctttggcctggaagtgacatgtgtcacttctgctcacagcctgttggctagacaagggttggacagtcacatggccctgcctaactgcacagtgactggaacggtagacttctgtggactgggaagtataacagtgagcattagtgagtctacctttttaaaaaatgtttgaggtgaaatttacacaacataaaaaccattttaaagtgtataattcagtgacattaattatagtcacaatattgtgcaatcatcacttctagttccaaaacattttcaccactctcaaggagctcccatacccactaagcagttacctcccatttctttctcccccggagccctggcaaccatttatcttctgtctctgtggattgatggaatcatacaatatgtgactttctgtgtctggcttctttcacttagcataatgttttcaagtctcactcacattgcatgtatcagaatgttattcctttttatggtcaaataatattccactgtatagatacaccacatttaaaaaatccattcatggctgggcacggtggctcacacctgtaatcccagcactttgggaggctgaggccacctgaggtcaggatttcaagaccagcttggccaacatggtgaaaccccatctctacaaaaatacaaaaattagttggtcatgatggcaggtgcctataatcccagctatttgggaggctgagacaggagaactgcttgaacccaggaggtggaggttgcagtgagctgagatcgcgccattgcactccagcctggacgactgagcgagactctgtctccaaaaaaaaaaaaaaaattcattcaattgttgatggacatgattatttctaccttttggtcctgtatatagtgctgctatgaacttttgtgtacaagtagttgaacaattgttttcagttcttttgggtatataccsaggagtggaattgctggtcacatggtaattctatgtttaactttttgaggaaccaccaaactgattcccacttaatttacctttttaacttcctacttcagtcaaatgaggaccagtcactgttcttacagctggtttctcattttcatggcttaggcaattcctttggcttaaaattttctccccttcttttctaatgactgaaatagaaattctgacaatcattgaaggttcagttccaaccctctttctctaaattctagtaagaatctctactagttctgcaaatycccatatttcctcctctttatctcttgtatgctattatttttgagtagttgtttattaatgcctttatcactagattttaaatttgcttacacaacttattacttttattccccccagtgtcaaaaacagttttgtgatgtttaataaatgcttattgaatgaataaacaaatgaataaggagctacagatacaatcgtgatttttttgggggggaactatggatttctgttttgccagtaagatggagaatgacaaaatgatattaaatttcacaagtctggtttcagggatgcatgttgggtaaaattcagtgaattcagtgacaaatatagatcattattttatctggagataattcattaaatctaagactgataccattagaacaaagattggtaactagtgtttcaaatgagtaaatttttagactttaatttcttccaataaaaaattatcttcaggctggttcaagtgcagtgatgtttacaactaattgatgacaaccagttacagatttctttgttccttctctgctcccactgcttcatttgactagtgtttaaaaaaaaaaaaaggccgggcacgatggctcacgcctgtaatcccagcactttgggaggccaaggcgggtggatcacaaggtcaggagattgagaccatcctggctaacatggtgaaaccctgtttctactaaaaatacaaaaaaaattagctgggcatggtggtgggcacctgtagtcccagctactcgggaggctaaggcaggagaatggcatgaacccgggaggtggagcttgcagtgagccgagatcgcaccactgcactccagcctgggcaacagagtgagagtccgtctcaaaaaaaaaaaaaaaaaaaaaagtatcttcaagcccatgagagaaggaagaaggatgacttagcaagacagaggagtgaggggaccatccaggttggatgagcctttctgagcttgtctcctgtccgtctaaaggccacctgacatctctcatttactctcagatccagcctgcccagcatcagcagtcaagctgccttattactttcttttcttttctttctttcttttttttttttttgagacggaatcttgctctgtcgcccaggctgatgtgcagtggcacaatcttggctcactgcaacctctgcctccggagttcaagcaattctccctgtcttagcttcccaagtagctgggattacaggtgctcgctaccatgcttggctaatttttgtattttttagaagagacggggtttcaccatgttggccaggctggtcttgaactcctgacctcaggtgataggcccaccttggcctcccaaagtgctgggattacaggcatgagcccctgtactttatctaaatgagtattagacagcttgctatctggaacaaaaccccaaacaacatagcaggataaaatcaaataaatggattggagtgaacctttttgtgagctgatatagaaagagaactttgattggatgtatcctgtcttctgtacacttagtagggagggaacaaaaggcactgcatggtatccaaggcaggaaatataatctactataaaaaagacataagtaacacaattcagtttacttattccttatatattttaagaaaatgaataatttatttttaattttatattaaaacctcagtaatacttgaaatccaaatgagatttaccagcttgacaagattaaagtatatatatgtactttagtataatatagagatggggtcttgctatgttgcccaggctggtcttgaactcttgggctcaaacgatcctcctgtctcagcctatcaaagtgctaggattacaggtatgagccaccatgcccggcctatagtatatcttaattcttctcttaagatcttgattaataaccctgtaacttatgttaatgatattaaccaggagtactacatttatttttctcctttaattctgtgtagatctaamtaaaataataaagtgttgaatatctcatgtaatttattgaatactgtaccgaaactgaaaaacagaatgctgtatggggactcaacgtatgctttctactgaaggaatattggttttgcaccatggtaaagtcaaaagattgtaagttgaaccaccatatattggggatcatttatatatttttaaactgtttctgaagtttttacctggtgtatatcttacctacatataaaaaattttttttaggtcaaaatgtcagctaggtgtggtggcttatgtctataatcccagcactttgggaggctgaagtgggaggatcacttgaagccaggagtttgagaccagcctgggcaacacagtgagactcctatctctatagaatagagatttttaaaaatctctattttaaaagattagccatgtgttgtggtatgtgcttgtagtcccagccactggggaggctaaggtgggaggctgcagtgagctctgattgtgccactgcactccagcctgggcaacagagactctttctcaaaaaaaataagaatagtaaaattaaaaaaaaaaatcacagtgtcaaaaatttttgcatgcaaattttggtttctgggcttcctactcagtgcaatttagaaaatttagtagttttttttttttttctttgagactgagtctcactctgtagcccaggctggagtgcagtggcgcgatctgggctcactgcaagctctgcctcctggattcacgccattctcctgcctcagcctcccaagtagctgggactacaggtgcccaccaccacgcccggctaattttttgtatctttagtagagacgaggtttcaccgtcttagccaggatggtctccatctcctgaccttgtgatctgccctcctcggcctcccaaagtgctgggattactggcatgagccacggcgcccggcctagaacacttaaagtcatctaggctaaccacctttcccagttgtctgctttagagaaaactggttgtttggatcatgaagcataaataaggccccacagccccaataccttttctttgagacagggtctcactttgccgcccaggctgaagtgcagtggtgcaatcataattcactggagccaggacctcctgggctcaagcaatcctcccacctcaatgtcttgagtagctgggactagaggtgtacataaaccaccatgctcagctaatttttttttttttttaaagactggggtctcactatgttgctcaggctggtctcaaactcgtgagctcaagaggtcctcctgccttgacttcccaaaataatggcattataggaatgagccactgaacccaaccctcactgcccctttaatgaatacatataatattacaggcagagtacctaggaagaaatcattgtttcgtgagtgctagacctgcaaacctgaaaatcttcctagaaaatcttaacccttctgtccttcaaaggaaaaaacaaaacatgccaaagcaaaatccatgaaccagaaaacccagacaactcaccatgcttaagtgcaggatttaaaatagcaaaaggaagtaaagctcatctttgtgatgtcaagttctattttggtatataacaaagtagttgaattataaggctctcaaggttaaaatattaaacagacccttagctacaagatgtgttgccaggcatctgtatggaatataaccatgtaatcagggcatattgtacttctctgcacaaagagaaccaaagctactgcttctaaagattaggaaactttcattagactgacagaagaccgtacagaggaaatggcttgcgggtggaggagacgtatgagagaggatgaaaggaacagtattcataactatccaaattagagccaggatgtttatgctcaaatcttgtcttggctctgtgttgatgggactgaataatggaacatgggaaagtatatctcagacccctaaattaggcagtaaatttaccaaattcctcctacaagcgcttcctattttcagcagtctctgcacatttctcaatatatgctgtgattaaagtccaaagctggctaatgctaatgatcccttcctcttttttgttgctagtatccttccatggcgatttcattctgttgtttataagtcacatgtctctacaacaggattgtaaccttatgaggagtgtttttatttatctttcatttattcagacagcatatatttactgtgcgcttatttcatgctgggcactgtgctaggcagataggatgtaattattagcaagacaggctaggttgctgtcctcaaagagcttgccatctcttatacatagtcgaccttgtttgtcaagtgatgtgaacattacgttaacgcaaattactaaattactactatttaaaatatagcattaacaccatttctgatgtcagtgtctctaataaatatttggccagtattaagatgaactaatagtcacatatatgaagtttagactcaaggctatatttagactatatttagacaatttaagggatgttaacttttctttctgagagagcagatctaatgaagtttttttcctaagaattaaaacagttccatgcataacttacaatggaattggccaacaaaaagaacaagtatttatatctaattattgccctcttacattgcttcagcacatataagaggcagcagcagcagctgccaatgatgaaaataattattgtcctgggtctgattagagaaaatcttgatgctgtctgttgagttgtctttccttagagatgttacaagaaaaacgggactttagtagtagaggttctaatagttttgaaagtgggagacttaagaacctccttacagagctcagagagctgcaggtagaatttacctggaggctggctaaattctgtggcttgcctttacattcatgagttctcttgttccacgtttggggcagaaccatcctaatttgagattggagagattggaaaagactggagagggctaagttcatccaaatatggcccaggtctcctgaggtgttcaagcacttcagtgaactagagtagaaactcacttagattgtgagtttggagaaaaacttgttctgattaaagtaaaactgttctgatttttggagtaaaacctgtgctgatttttggcctttgtgttttcaatgtgcctcaacaacagctgaaatcttgggctttcctaatgtagaagcaactcaacgaggaattgatttatttttcatgcgcagactgcatcacaccgcatataaggccttctgctagaaaggccaaactgtcctttggcctcagtattttggagacaaagagttaatactagtaattcctgtgtaatatccttttttggcaaaggaacagtagactttatcagtttggttcttgccattacttgtgttcgatcttgaccaagttaaattatttccaggatgtatctttttttttcyttttttttttttttttagacggagtctcactctgttgcccaggctggaatgcagtggtgcgatcttggcttactgcaatctctgcctcctgggttcaagggattctcctgcctcaaggctccctagtagctgagattacaggcgcctgccaccactcctgctaactttcgtatttttagtagagatggggtttcaccatgttggccaggctggtcttgaactcttgacctgaagtgatccgcccaccttggcctccaaagtgctgggattacaggcctgagccaccgcgcccggcctcaggatgtatcttaaactcattatttttgatgcttkccctgcagctgagtaaatacctctttaggatatgtgacaattgaactggcttggattttggaacatgtcctggccttggagcctgcttatgttcatacacactggttccttagaaatgtaaatttgtaaagtcaatgtaaaactgaaacttcaaaagtcaattttcattgctgctgttgtgcatttctattatcaaattttatttacagtgatttacgtgagtaaaaaatggattacacgatttcctaacatctcactaagtatgggtttggatcttaagtaatttacatttttcttttccaagttgattgttatactgggctaatgatttccttcaaattccactaataaatcacagattctcagtgctgttattccattgctttattattaaatggcacccttttctagtttttgnttttgcaaaccagtggagtatttaaagtaaaatttcagaatcccttttggagctttcggttgagaccaggctccttggaaccctagtgctttgggagttctgctnctgctgcagtaccaaaagtagcttctttgaatttcatttgggttttgtagggctcccccgaggcccgagaactgggagaagggaaagagctcatcggtttgtttgaaggccggcgggcggtgcaggcagcttttcccagactctcccagctccggcttttcacgcataccagaagagccgcttttttcctccagtgattgaaaccatctggactccaggggggtcacgtgtgtatgagaaaatgacataaagtttcagaccccgttgtgctttgctccagacccagacaactcttggtcggatggtgaggaggtgagggccgtccagtttgggggccaacttctcctccctgctgcccccggcccccgcctccctcacccctgtcccccaccctccctcgcacactctcggcgcggctttctcgctgcctccggcgcctccgagcgctcccctccgccgggctccagcagcccaccctctctgtcttgggtggaggcgcacatcctccacgccccctccactcaaatctgcgctccctcccctctctctccctgcagcccggccgcagcccggggcgcggatgcctgcccgccgcccgccctctctgcaggagcggctcctcctccgggccgcgcggctcccggcgagaccccatccaggcgccgcgcccggcccggctggggaacgcagaggtaagcgcctccgggccgggtggccccggttcccgcgtgcgcgcccggtcccgcccctgccctcccagcccttttccctctgctcccgactcccggccccggcagcggtgtccagctccgtgagtacgcgcgtgggggccgccgcaggcgcagaggagcggggctggtggggtccgccctcccgggcggtcagtagccgccggctctgctttccggcccggcgggggccgcgcggttgggggtggggaacctcgcggccagagtccggcggtgaagagctgcctggtgccgagcggagacccgatctcgggacgtcctgggagctggctctgcgcaccgccttgcctctcggtggcggcattcgagctcctacctggagctgttgcagcttgtatgcaggctccttgaagaacgcgcgcgcgcgcgcgcacacacacacacacatacacacgcacaacacacacagacacacggaactcaaacaaaggaaaattaactttgcatgctattactgcaacaagttaaactatgtttatttgtggatggttcactttttgcccttgtgcagacacgcactaagtattaaagggtccacactctagtcaacgtttatggcacgttatccaataatttagtaactgagtagagttcaagagacaatgttttcaagtgtttctaaagagggcttattgcattttcctgggatctttatatgaaagtagttgatgattaatatgaataaaataacttcttcattaagtgagaaaatttgccttagtacagccttagtccagctcttgcttttattaccaaccaggtgtttctgctgtttggatagcagggtcttgggaatggcaaagaggtcattatcccatctgcaagactgttttcagctacctcttagctgcacacactgcaactggccattttgggatggggccacagggttaaaacccaaagggctgcattgttttgttttaatatttttcagaaggtgaatcccttaattgattttttttttgccagaattaggggtttctaaaaggttagacgtaatctggggtccagaaagctaatccaagatagagactgaattgttcacagcctatctcccttgctgaattaaggaccgcacaaggccagaactcaagaagagcctgttgaatgcatgaagtgaaggcttcttaaattctgctggtctggcagagagttcctaggtgactaacatagatgtaaccctcctttttatttatctggcatatattttttatttaaaaaatttttttctttttttttttcgagacggagtctctctctgtccctggagtgcagtggcgcaatctcggctcactgcaacccccgcctcctgggttcaagcaattctcctgcctcagcctcccgagtagctgggattataggcgcctgccactacgtctggctaatttttgtatttttagtagagatggggttccccatgttggccaggctggtctcaaagtcctgatttgaggtgatccacccgcctgggcctcccaaagtgctggaattacaggcgtgagccactgggcccaggctatctggcaaatattacctttggaaaaactccccaagatagggggaagaaaaattgttcaagtgtatgtatgggaaatgttatcccctaattgggccagaagggcacccattttggtagacaactccaaggcaactcttaccttaaaagtatttttttactgaacgcttagattggattggcttggtaattagggaaatccttggtcttgagtttgtggactccttggggaaagagaagtgacatttgagtgaaggataatttcagatcaattggcttagaacaggaatgtccaatcttttggcttcccggggtcacactggaagaagaatcgnctggggccgcatgtaaaatacactyactctaaggatagctgatgagcttaaaataaatcgcataaaaaatcataatatttttaaaagtttacgaatttgtgttgggccacactcagagccgtcctgggcggcccatgggccgcaggttggacaaacttggcttagaatctaagaattataaagctcaaggagaaaatgattctgaggcagggcggtttcatagaagaggggagagccttgaagcaaagtatgcttctgaaactggtggagagttgctggggaaagctttcaagagaatggagagcagaccatttggactggacctagagagaaaagtaatagcatctgctctatgccacctgccagctctctcnttcatccttcagtgttgtgacataggtattgttgctcttgttttaaagatgagggaattcttgtttttaaaaagacaagatcaaaaagatacgtaactggcttgggatgacacaagtggtaaagtggcagagctggaattycaatgcctggctctcagactaacatgggtgctttcacagctgccttctccaaagagcagtgggaggtccagtggaagccgaactgtggtcaggttgaattctggctcaagggctggaactttatcctgtagacattgtttaggttttaaagatttttgagaaaaggagctatgggtaaagcagtgattttagaagattaaggtgacatctatgtacaggaatgtgacatgctcatcacaagtcatgtgcaagtcataattnctaatgaggaggttcaaaaaggaaatgtagccaggatatctgggtgtttcaattcctgtctcacttactgtaccctgcagcgagtagcttggttcactgggtaaagagctagttggagtgaccacggggctgctctggatcagaaaagagctgaatcttaccaggcatangctgaaatggaatgtgtntgtggatcaatgccactgctggtttgtcctttatgttcccccatgtttcgcaatgctttggttttttctttcatgactaccctgagaggtagatcaatgttgtaatttgtttaaaagcttttcctcgccctaaacatcttaggtaagttgatgtgccttttcctctcatattctcttatttcttaaaaatgctgaattttggccaggtgctgtggctcacacctgtaatcccagcattttgggaggcagaggcaggcagattgcttgagctcaggagttggagaccagcctgggcaacatggtgaaaccctgtctctacaaaaaatacaaaaattaatcatgcatggtggcatgtgcctgtggtcccaactattcaggaggctaaggtgggaggatcgatcacttgagcccaggaggttgaggctgcagtaagccatgatcatgccactgcactgcagcctgagtgacagagtgagaccctgtctcaaaaaaaaaaaaaaaaaaaaaaaagctgaattttaaaacttggtactagtaaggtaaaagtgaatttagattacctttcttaattatgagaaagattaacataaaatatacatttatttcactttgtgttatggaggaaaaacaggaggcctttgtagagttcctgcgtggggatttagaagggataggaaagccaggatttagagatgtgcaaaggtcttcctacccctccacatttcttaccagttaatcgtattgttcatgtatacagcttatggagcttataaggacattggacacccacatttatagccaggccctttgattctcggcagataatgggctcaggaagggcagcagtgggtggagacattttactagaattagtctgccgctttgaatacaatctggatttcttgctatttcttgtgcaacctgtacgccgtttcctctgaacttgctagtgctctggagacttggttgtttggccaaggaatatcccctagcaggagggctcactaaggaggggcagcttgacaggcagaaaagtgatgtttgtcaactaaagaagttttcttttaattaatgttagagtcacccatggttttttgtcaaataaaaaatgcgaaatcaaaatatgatctcggttctccacacccatttttacctttaagagcctctcacaccttggagagcttgccttactgaatggggttttgataggtgaaattatcaccaggacctctacatgggtcaggatatgactcagtttgggttttggacctctgaggaatgtgacccctcttagtgtaggggatttggagtacaaaaacctgggttaaagttccagctttgccatttattcagaagttcctggaatttgatgtttgagagatctctgagctcagttttcctagttcttctagatcagggtaatcccttagggccagatagaggtggtcacaccctgattagcaccttggttccttctcccagtttgtattttgtgtcacctgaaagtcattttattttctctgtagcctctggttataggttatgtggtcattcctccagagaatggcaaagctcattgttggttggggatcatttggtatgtcttcccgggagaatgctcttgaacctagttttgagagttggggcctcaagaagagactttggcaatgcccttatttaaatgtyagaaatgtttggttgcatttttgatgcattgcttacatagttaatgtttttgtatttggtacttgtcattttaataatttattaaacaggtgatttaggttttctaagatagctaagagcttagaaaaataggactgcaggtcgggtgcggtggctcacgcctgtaatcccagcactttgggaggccgaggcaggcggatcacaaggtcaggaggtcgagaccatcctggctaacacggtgaaaccccgtctctactaaaaatacaaaaaattagctgggcgtggtggcgggcacctgtagtcccagctgctggggaggctgaggcaggagaatggcgtgaacccgggaggcggaggttgcagtgagccgagatcgcgccactgcactccagcctgggcgacagagcgagactccgtctcaaaataaaagaaaaaaaaagaaaaagaaaaatagggctgcaatatcctctttaaaaatagtctaaattattttttagtggggatggcatttggacaattccccaggactggaatatccctttgatactcagatgtaatctcctagtatggtagaactttgactattttgacctcctccacctccaaatatccttaaatctttctgaagagatttaatctctcttaaagagatctcacaatttccctgggaaacactttctaaggaaggtttccagattgatgatcacagattatctccttgtagttagcttttcttttaatgtttcctacttttactgttttcctgtccctcttcaatgcacacatgttcacagagtgaacaaattgtctttcctggactccaaaggcagctaccaaatgtacagactgtcccatctgtacccatcctttccttcccttcctctggctaaacaagctgagctttctctgttttccttaacaagtctctctttttagacctatgattatacttgttgctttgtgttttgttttatgcaggaagttcatatcagatatgttggcaattagagctttcaaactggaaggagccttttggagtaaaatatatatatwtttttctatcagcataagtaattgtggaatatatgtaaactctggagatgatcttttaaaaaaattaccatcaaaagaattttactcaagtcctttaagggcttaagaagaatccagcctttgcgagattgcactaaaagtaacagattagcccaattaaggcctatctagaagtctgggaatcatttgtttaaactggaatttaggatctccatgcwaatatgatagaaataatctgcttaaccctttgttagtagcattagaaataagcccctttttatgggactcttaatgataaaaggtcatagtaattagaatatgctgggaatttgtccctgtttgttaatgttttggaaactcctttgagtaggcaggggtcactttgggtggcttttttctttctttgatgtgaagttgggatcttggatgtaaatttagccaaggrcaagtttgaatttagattttttaaattttttccgtcttgttccattcttccttttggaggcggctaactagagtggggtaaaaagtgcctttaatcagagtcagtgtcctgagactgtcagacactggtctctgggaagtgctctgtatcactatcatttatatacttttcctttcttgtgtcctayagtttttgaatatctcctgcggaaaaagcactggggtgtgtacgggcatctgtttattctcttattacctttcttcagtgaatatgcttaatgttaggggtttgatgaatcaatgagtggatgaagttaagaaattagatgraggccaggcctggtggctaacacctgtaatcccagcactttgggaggccaaattgggaggattgcttgaagccaggagtttgagacctgcctgggcaacacagtgagactctgtccttatgaaaaaaatacaaaaattagccgagcgtggcggtgcgtgtctgtggtcccagctaaacggtgggctgagatgggaggattgcttgatcctgggaggtcaaggctgragggagccgagattgtgtcactacactccagcctgagcaacagagtgagcccctgagtgaaaataacaacaacaacaaaagaaattggatgggaaattagttttggatatgagtgttgggtacctcctgatccaaatattgctgttgggaagcaactgtttttacaacactctggtctctggaagctgagatgacctctgttaaggctcatcatgtggggatatattttctagtgagtaaacagggcctagtcagttattttttctattagtcatgttggattacatttactgttgccgggaactctagttagcataatatccccttgaattaggaagtgccactcaatagctgtctttctccaggactgcctggagaagcttttcttgaaagtctggtcttgcctcttgagccagggatgagtgcattctaagtacttagacccaaaaggcttcttctactgggtccaagtcccaggggaatggaaattctcttgaaaatagtataattgtatgggaggggaatcaaagctttgtacttttcagtagtcactcgaatctgtacatagatacctggagataaagaaaacccaacttgcaaatgagtatttggtgctgtgggttaacatggaaaaatggcacttaaggtcaaagtatattaattgaatccttcttgtccagttaatcagcaatatcagttgtgaggattccgttttgctatttttcccccatttgtatattgacaggtcactcttttgaattagaatagcactcaggaccacagtgtttgcataggaagtggcgtaagaggcaggccgggcgcagtggctgacgcctgtaatcccagcactttaggaggccgaggcgarcggatctcaaggtcaggagatagagaccatcctggctaatatggtgaaaccccttctctactaaaaatacaaaaaaattagccaggcgtggcagcgtgtgcctgtagtcccagctgctggggaggctgaggcaggagaatggtgtgaacctgggaggtggagcttgcagtgagccgagatcgtgccactgcactccagcctgggtgacagagcaagactcggtctcaaaaaaaaaaaaaaaaagaaagtggcgttaagagtcatggggcgtgggtagaggccactttatatcttgtttcagagggccatttaaaattttttttaattaattaatttacttacttatttttagagacggggtccccctatgttgcccagacaggtctcgaactcccaggctcaagcaatcctcccacttttgcctcccaaaatggtaggtttaaagatggaccatttttaaaacctccatgagtagctcagtgatcagaattagctagaaatagctctgccaaaaggtattggcaaaataacatctagcagcctttgtctatttcaggttaggtttgttcaagaaagccaatttgggagcagtatgatgtgcccagctctgtctacatttgagtcgcctacatagttcccatgtatttgtcactatttctggtccctggagggctggggtagatctcaggatatgaggctcagacttggttgaagccacatcaagagctgtggtcctggtsggtcagcgttattttctgcggcttatcacccaggctaggcgtgtgggagcatgggtgggtaggacagggaagaaaaacagaagaccagatagttctgtggaaactgaataaataagtgaaaaagttggccaggcactgtggcactcrcctgtaatcccagcactctgggagcccatggcaggtggatctcttgagctcaggagtttgagaccagcctgggcaacatggtaaacccctatctctacaaaaattagaaaaattagccaggcacagtggcacacacctgtggtcctagctactcaggaggctgagatgggaggatcacctgaggtgatcacctgaggttgagattgcagtgagtcgagactgtggcactgacctccagcctggatgacagagtgagaccctgtctcaaaaaaaaaaaaaaaaaaaaagagtgaaaaagttaatctttttcccctcactgacttggacctttgttctgttggaaacccttatcacttgaggtcattttatttatgtatttatttttaaatgtttcattattattatattttaaaaatatgtattttttatttcaatagcttttgtggtacaagtggtttttgattatatggatgaattgtgtctgaaattttagtgtgccagtcacctgagtagtgtacatggtacccaatatgtagtctttgtaacccttcatctcccctccctccctcccttcctcccccttctgtgtctccataatccattataccactcgatatgcctttgcatacccatagcttagctcccacctataagtgagaacatacagtatttggttttgcattcctgtgttacttcacttagaataatggcctccagctccatccaagttgctgcaaaagacattatttcattctttttttatggctgagtagtattccatggtgtatacataccacattttttaatcactcattggttgatgggcacttaggttggttccgtatctttactgttgtgaattgtgctgcgataaacatatttgtgcaagtatctttttgatataatgactcatcctttgagtagatacccagtagtgcaattgctggattgaatggtagatctatttttagttatttgagaaatctccatactgttttccatagaggttgtactaatttatattcccaccagcagtgtataagcgtttgcttttcaccacatccatgtcaagatctattgttttttgactttttagtaatggctagtctggctggagtaaggtagagtatttcattgtggttttaatttgcatctccctgatgatttgttatgttgagcatttttttcatatatttcgtggctatttgtatatcttcttttcagaaatgtttattcatatcatttgctcggtttttgatgggaktgwttttttcttgctgaattatttgagttccttgcagattctaggtatttgttgtttgtcagatgcataatttgcaaatattttctcccattctgcgggttgtctgtttaatggttatttcttttgctgtgcagaagccttttagtttaattagttcccatttatttatttatttttgttgttacattcgcttttggggtcttagtcataaattctttgtctcacccaatgtccagaagagtttttcctaagttttcttttagaatttttatggtttcatgtcttagatctaaatctttgatccatctcgagttaatttttgtatatggtgagtgatagggatccagtttcattcttctgcgtgtggctagccagttttcccagcaccatttattgaatagggtatcttttcccagtttatgtttttgtttgctttgttgaaggttagttggttgtaagtatttggcttatttctgggttctctattctgtttcactggtctgtgtatctacatttataccagtaccattgctgttttgttactatagccttgcagtataagtcaggtaacgtgatgtctacagatttcttctttttgctcaggattgctttggctatttgggctcctttttggttccatatgaattttagaattgttttttctaatattttcgaaaatgatgttagtatttggataggaattgcattgaatctgtagattgctttggrtagtatgctcattttcatgatattgattctytgatttcatgagcatggggtgtatttctatttgtttgtgtcacctgtggtttctttcagcagcgttttgtagttctccttgtagtgctctttcaccttcttagttaagtatattactaggtattttatttgtttttgaaggtattaaaaaggattgagttattgatttgattctcatcttggtggttgttggtatatagcagtgctactgatttgtgtacgttgattttgtaacctgagactttactgaatttatcaaatctaggagtcttttggaggatctaggcatcttttagggttttctaagtgtacaatcatatcattagcaaacagagatagtttgacttcctgttttccaatttggatgccctttatttctttctcttgcttgattgttctggctaggacttcctaaggtcattttataaatattcatagtaactagttgaaggcactgagattcctgtaccttggcgggaagaaccctgctggatgattctctaggtgtttatttgggttatgcccattttctttccctcttttcttcctaagttttgatgctcctgtttttctgggaatattttggcttcattgtttaggcttttttaagggccatggggaattctggggacaggggcaggtgtgacatgttgctaggtatgggaggtttttacagcttgagaaatttccaggaaagaagagacagaaaactttgttcacaaagcatgtggacaggaagtcaggtgggaaaatggcatggcagatggtgtaacttctttggtcagcatgcctgtctctgccaagatgggactgatagggtagtgggggtagtggggcagtgctgaggatataacttataattcacattattccttgaagagaagatggttctttgttttaaaaggaagtatagtgccttacattgatttctttgaaatatacatgatataatccatgaatgagtatttgcaaaacacgtggccgggcgcggtggctcacgcctgtaatcccagcactttgggaggccgaggcgggtggatcacgaggtcaggagattgagaccatcctggctaacatggtgaaaccccgtctctactaaaaaatacaaaaaattagccgggcgcgatggcgggcgcctgtagtcccagctactcgggaggctgaggcaggagaatggcgtgaacccgggaggcggagcttgcagtgagccgagatcgcgccactgcactccagcctgggcgagagagggagactctgtctcaaaaaaacaaacaaacaaacaaacaaaaaaaaaaacacgttagtgtttatctaaccctatgccaagcctggtagtagatatacaatacaactgagggaaagtgataacctgaacttagaacatataattgttacctaaagaatgatataaagcagtacatcatcaagctctaaattttgagttattgatacatacagggggtttggagccccagacaaggtttaggacgtgcaggcttatggcaaatcttgggccaaatggaggcctttggagcttttggagcgcccaagggctcagtcttcagyctgtttcttgtctctgtcttcacttttcttaggtgattccctggctttgaagtactagcatttatggaatgtttactggctgccagaggctgttgtaagggttttatgtgcactaatctagccttccagacaaccttataatataggtatttttattatccttgcttaaaggtgtagaaactgagacaagagatggactttcttgagctcacacagcttataagctggagagccaggaaatgacctagtttgggtgaccagccaagccctcgactggttcagaatagccatcctcagctggtcctggctcctctgctcctgtctttgcagtctcttctccacatagcaatgagaatatatatattttttaccctcatatggaatgctatcacacttagaagtacaatgcacatttactaccaagttcttgtgtggtctaagccccagctctcccatctgctcctgccttcctcccatctcttctgtctcatggcctttgcctgctcctaggatgctcttctccttgaatattgctggtttgtcacccagttcatttgagtgtgggctcgagtgtgccacctcagggaggccttctctgcccatcctatgtaaaactgctccgagtcactctttaatcccctcctttctttttcttcctaaaattatattacatatttctgtgtttttcctgtctgctttcccaaataaataaactccatgaagttagggacttgatccatttgtttactgatatctttactttttagaataggacatggaaggttttctttaaatatttgttaaataaatgactaaatggtatcttttgcattcatttgctgttcatgacttcacttgggtaaaaatagtggagaggaaagggaggtacaggtgataactacaggctgggtcctaactggttttatgtttattaccaaggctttgctatcataacatggccaagaaaatgctcagaaatcttggttgaatgaatgcactgtgtaatttgttctggattccacacagaggggacagaatagtgtgggctgaagtgctcagagaaatttcttggaggacctgcagactttgaaggagagattggatttggtcgagcatataggaatcgaagaatacttttttttaaaggtggaagggctatagggtgaactagtccaatctttctgtttatagacaggaaactgagcccagagaggtgtaggacctgcccaaaggcacacaaccagttgatgtcagaaccacgtctggcatccaggtgttttgactcctaatttagttccctttcttctacacagtgctgccttcagaatccaggaggactctgggggttggggagtaaccaggggcagcatgagcaaaggcccagaggcagaaaagatgttggcttgtatgggctggaaataggtggtctattggaatcagcaggtttataaaggagcccatcngagacagaccaggctgaatcagatcctctgggatcttgaatgtcatcttgaagactttgagtttggaatgagtgggaggcatgtgaaaatgctttgactattgttctgtctttctctacagggatggtgacagaatggatagtytagaaaatggattggaattgaggaggaaactagaagctaagaggagttaggaggcccttgtaaraatccaggtattattgctaagggcctagtatcattttagttatttctgtttctgtttttagagatttgtggtggtttttggagaagatgacataaaattatcaggcaatatgtgtatactcagctttctaatagagtttggggataagaaggaggagacctggtattttgccttaattctgtatgcggctataaatgacattttagtatccagatgataattcttctaagaaacctgggccaggttaggacaggagggatacaagataacattatactgatgtgaaaatagtgatggggctaagtgcagtggctcatacctgtaatcccagtgctttggcagactgaggcaggagaattgcttgagcccaggagttctagaccagcctgggtgacatggtgagaccctgtctctgcaaaaagtaaaaaattagctgggcatggtggcacacatctgtagtcctagctactcgggaggctgaggtgggaggattgcttgagaccaggagttcaaggctgcagggagccattattgcaccactgcactctagcctgggtgacagtcaagacctgtctgaagaaagaaaaaaaaaaaaaagaaaatagtgatagagtgaggagagactgaaggaacagacggaaatgaatgggagcagctgcccagagagggcctgggcctgcctttccatcaggggagctgcccaatatagtggttggggagtcaggcatccagggacttccaaccaaccttgcacatttttttttggacacgtgtgaccagtggaagtaaaacctgtctcctgggcccacaaatgctttggacggataagttgtgctcaagcctaggcccattcaggtagtccacatatgttttcaaccagagctgatgagaacagattgatacagcctgtaccaggccagtgaattggcagtgtatgatactttaaaaatttttccatacccagaaatctttttccatctctaacaaaacactttgaaagtcagcataaaagtgagaacacagacttttaaataatatcttctactggatctgaaagttttggatgcaagaaaaaaatcctggatcatttaacattcaatggatatttattgaggagcacttcttaaacaccagatactgtgctgggtactagagcttcagtcttttgatcatattgcatcaaatgttattaatggaacattaacatttgattctatttcatgttaagctcttttagccccaaacgttatacagcttggtccataaaccttcagttggttcagcctgttcacttatgtttgtgttcagttgttgaatgtttatgtgtaacaggcaacatatgttgggtgctcagacagttttgaagatgaacaagaattggagagagttctccaattctctagctggttgactggaatttaccaggtagatctggcagctgtctagtttgctgggattcctcccagaggagagtatagtcagcagcaatgtatcccctttccttattctgtttggattgggcccttccctttgccstttacaccttctccctaatccctgtctttaaatttgagacaaangaaaattagctcctttgtattaagtttgggcagctccatcaggacagcacttccctgatgatgccctaaagttagaaacccttccaggagaatctctgttgccatgtaatcccaaagaagagccttctcggcgtgctgtttcctccttcctatgaaagttgcttttgcctactgtgtggatacagggtgcacagcacttggtatttctcgggctctttgcatctgcctgctccgttggctcactgtggggatgctggcaggggcwtggtgtcttgttttcttagaatgaatgatgcagatgagcagcctctctagatgatgggaaaatttagcatgatccatcatgatccatcaggctaaattttcccgtcatctagagaggctgctgctcagaataaaagagaggaacataagatgggcgcccaagaggagtgctttattgagcctttagattgccagcctgarcgagatagtcttcccctccttgcttggcatctggagccagcttgtacactacacgtttgaggtttgctgttctcttcttttcttttctctcttctctactcttccctccccctcccttcccttttcttttcttttttcttttctttctttttcttcttttgagacagagtctccctctgttgcccaggctggaatgcagtggtgtgaacacagctcactgtagccttgaccttctgggctcaagtgatctttmcacctcagcctcttgaatagctaggaccactatgtgggccactatgcctggctaattttttcaaaaaaatttttttgtagagaagccgaggcaggcggatcacttgaggccaggagtttgagactagtctgaccaacatggcaaaacccatctctactaaaaatacaaaaattagctgggcgtggtggcacaggcctgtaatcccagctacccaggaggctaaggcatgagaatcggttgaacctgggtggaagaggttgcagtgagtcgagatcatgcctttgcactccagcctgggtggcagagtgagactctgtctggaaaaagaaaaataatttatagagatagagtcttgtcatgttacccaggctggtcttgaactcctgggctcaagtgatcctcccaccttgccctctcaaagtgttggaattacaggcatgagccatcatacccagtggctgctgctttttttgtgtctgtgagctcctttaatagaaaactacagaatagaaattatttccaactttcaactttaaattggttcttttaggccaggcactgtggctcaygtctgtaatctcaacactttgggaggccgacgcaggtggatcacttgaggtcaggagtttgagatcagcctggccaacatggtgaaaccctgtctctagtgaaaatacaaaaattagctggtcgtggtggtgcacgcctgtaatctcagctacttgggaggctgaggcaggagaattgcttgaacccaggaggtggaggttgcagtgagctgagattgtgctgttgcactctagcctgggtaacagagcaagaccctgtctcaaataaataaataaatacataaataaataggttcttttaaaaatgtaatatatggccagacatggtggttcacacctgtaatcccagcactttgggaggccaaggcaggaggattgcttgaggccaggacttcaataccagcctaggcaacaaagtgagatcctgtctctacaaaaaaaaaaaaaaaaaattaactgggcatggtggcattcacctgtaatcccagcactttaggaggctgaggggggaggattgcttgagcccaggagttcaaggctgcagtgagctgtgattgtgccattgcacttgagcctgagcgacagagtgagaccttgtctctaaaaaaaaaaattaaaaatatagtgtttgctttgcagtacattctaaaaaaataaaaacctcactttcccaacacccagagaaaaatcttagtcctctcctttctaggtctttctctacgcatacagatgtacatatttatattctttttctaccaaagtaagattatactatatatactgttttttattctatcttatttttcaattacgttcacttttctaattcagtaactttttattttaactaatactcagaccatattcagatttccccatagtcttmgtccattcaggatgctataacaaaatactttaggccaggtaatttgtgaacaacaaaaatgtattgctcacagttctggaacctggaaagcccaagatttggtgtttggagagggcctgctcttcataggtaggaccttctggctgtgtcctcacttggcagcggaggctaacaggctccctcaagcgtctttcttttcttttctttttgttttttgagatggagttttgtgctcttgtcgcccaggctgtagtgcaatggtgcgatctcagctcactgcaacctccacctcccgagttcaagagattctcctgcctcagcctcccgagtagctgggattacaggtgtgtgccaccacgcccggctaatttttgtatttttagtagggacggggtttaccatgttggccaggcyggtctcgaacttctgacctcaggtgatccacccgcctcatcctccctaagtgctgggattacaggcgtgagccaccgcgcctggccgaagcttctttcataaagacagcaatcttgcttatgaggacagagccctggtgatctaatcacctcccaaaggccccacctcttaataccatcaccttggggttagattttcacatgaattttaatcacgaagtttaattagcagtcacactcataaaagcttatcaggcccacctcccaaatgtgtcatgaatcgtccttctccttactgtcttgctgcctccaatccagccaaagtcttgaccctcttttgccagaatgcagctttcatttctcagagtgctgcctcagggtgttcagtcttctaggctgctgaacaaatgagctttctagaatagtttaattgtgatacttctttgctaaaagctctttgctttcttattgaggagtaacacagtaaagtacgcaaattttaaatgtatagcttaatggatttcaacgtttgcatacattgttataaccaccactccgatcaagatgtggagcatttctggcatctcagaaggtcacctgatgcctcttcccagacagtatccacattcctatcccaattnctcttctgttatcatttgttttttcttttctcttatttacttgtttatttactatttttgtaaagacaaagtcttgctatgtttcccaggctggtctcaatctcttggtctcaagccatcttcctgtgccttggcctcccaaagtgttgggattataggccactgaacctggcctgttttacctttttttgatccccatattaatgaaccacgaaagctctttattgattcttctttgacaggataattccaccctttaatgtgacattcagaagtctttgtgatctggcttttacttcagtcctccacttgcaccctgcccttctgccacgccgaaattgcatgtagcttgtcaacatagtaggcgctttcattttttgcacttgatagtctcttgccctcctcactttattctttggcaaattcatccttcaaaactcagctccaggcagaatcaaggccttctctgctctccagaagcaacaactgttatagggagttgcttttatacctataacgtttttctcctctactggtggctttgggctttcaggagcccagggataatggggcatttcccccctaattagttagttgaatttcatacaagtaattcatggtctttctagaaaaattggaaaataggaaaaagatcacccacaatcctactacacagagataattagtgtttatatatataccaaaatatatatgaatactttaaaacgaattaaaaaatattcacaaaatactaaatatttgatctactttaatctcctgttattgtttagtttgtccccccctatgtatttaaactattacagaaatgctatggtgaatatccttatacccatattttagtgcagttccttgattattttggggattcctagaagtaaaagggatgaacatttttaaggacttttgatgtgcttagccaaattgccctccagaaagtctttaacctgtgtacactgtacacttctactagcgtgagcgagagtgcctgtttccagccattcttgccaaactaaaaagaatgaagataatcggtatttgcaaatctgataagataaaaatggtattgcatttctgttttartttccatttcttggattgctatggagcttgaatattttctcatatatttaatggccgtttaatttctatttcttttatgatttacatgtttttgttattttatttttaaattgacaaataattgtatatatttatgatgtacaatgtgctgttttgatttatatatatatatatttagaatgactaagtcatgctcattaacatacattaccttacatacctatgtttttttgagggtgagaacagttaaaatctacactattagtaattttcaagtatgtgatgtattgttattaactatagttgccatgatgtgcagtagatctcttgaacttatttattcctcctatctctctgaaattttgtgttctttgaccaayatcaccccaatcccttcatcccctagcctctggtaaaatggttattttaccctctgtttctatgagttcaacttttctagattcggcatataagtgagatcatgtggtgtttctctttctgtgcctggcttgtttcatttaacatagtgtcctcaggttcatccatgttgtaggaagtgacaagatttccttctttttttatagctgaatagtattccattgtgtgtatataaaccacattttctttttttatttatctgttgatagacactcaggttgactccatatcttggctattatgaataatgctgcaatgaacatggaagtgcagatagctctttgacatactgatttcatatcctttggatatatgctcagtagtgagattgctggatcatatgatagttctatttttaatttgttgagaaatctccatgctgttttccagaatggctgtaccactttatattcccgtcaacctccacatcctctccaacacttattatcttttgtcgttttggtggtagccattctaataggtgtgaggtgttatctcggtgtagttttaatttgcatttccctgatgattagtgatgttgaacattttttcatatacctgttggccatttgtatatcttcttctgaaaaacgtctgttcaggtcctttgcccatttttaaataagttgttttcttactattgtgttgattccttatatattttgggtattaaccccttatcagatcaagcagttttatattttatttaatgcattttaccaacttttaaaatattaagaacaactcatatatactacatatgtttttcacagtttgtcttttaactttgttttccacatacaaaaatttttagtaatttaatgtgaaatttatcagtttttgtgtgtgtgtgtgtgactgggtatccctctgtcctccaagccagagtgaggtggcacgatcacagctcactgcagccttgacctccttggctcaagtgatcctcccacctcagcctcctgagtagctgggattatgggcatgtaccaccacacctggctaatttttgtattttttctagagacggggtttcaccttgttgcccaggctggtcttgaactcctgggctcaagtgatccacctgccttggcctcccaaagtgttggaattacaggcatgaaccacagcacccagccttattggtcttttcttttcttttttttttttgagatggagactccctctgtcacccaggctggagtacagtggggcgatctcagctcactgcaacctctgcctcttggattcaagcaattctcctgcctcagccgcctgagtagctgggattacaggtgcctgccaccacacctggctaatttttgtatctttagtagtgatggagtttcaccatgtggccagactggtttcaaactcctgacctcaagtgatctgcccaccttggcctcccaaagtgctgggattacagatatgagccaccatgcctggccttatcagtctcttcagtctttctgtctgttttttttttttttttttttttgagacagtctagctctgtcgcccaggctggaatgcaatggtgtgatctcggctcatggcaacctccacctcccaggttcaggtgattctcatgcctcagcctcctgagtagctgggattacagccatctgccaccacacctggcaaatttttgtgtttttagtagagacggggtttcaccacgttggtcaggctggtgttgaactccttacctcaggctatccacccaccttggcctcccaaagtgctgggattacaggtgtgagccaccgcgccckgcctgtagtattctcttcacctttgtatccctagtgcttagcagtgactgtcttattttaagtgttcagtgaatatttgcagaatggtgcaacccttgggggtccatgggtagaatttgaagggtctgcaacttggataggaaaaaaaaaattacatcattttcatccaccccgattgaaatttagtatttcttttttattatgaatataggcaataaaacagcagtaatggcagtacctgtgatttagccacccatagaaatcatggatatttccctggataaaccctgggttaagaatctgctttactgttttttttttcttgaggccattttatttttgtgtcaaatacctaagcaatacctggtactcagtagatacscaataaatattaatttaaaaaacttcttatttcaaaatatgcacaaaagtcaggagaactgattcagtatcttggctattatgaataatgatagccattgttcccatctgtataatgaactccatatattcttwatctgcttcaaatattattaacattttgccaattttatctttctcctccattcctggacattatgttatttacccaataatatttcgggaagcatatttgataagaactttaaaaatctataaccactctctcacatttaaccaaactaacaataattccttaatatcatctgttattcaggtcatatttaaatgtcctcagttgtctcaatgttgtctggtatttaaatgctgggcatggtggcacgtgcctgcagtcctattttattaataatgtgtttttgacaattgctctttccctatttaacattttattattatttttaatgggaaattattgatttgggttctttggtcttatttgtaaaacttaaaacatttaagtctcatttacagttgttcttggacataatttaaagtgaagtgtgtgatgggtaaatttcttcaggtatgatcaaagctctaagagatatttctttttcacttgctcaaagagtctactcaccttgttacactggaggtaaaaatactttctctgagagttttatatgcatctctggactttaattgtatcctttgcaaaattggaagaaatttggatttgggtcttctcagcctgctgagttttttctttttcttatgcttaaaaatatgagaatgtcatagtggtagtctctggttgatgattttgtacatcttttgtactcagagcaaatccttctgttgtttttagatagcatttttttctattaaactttatagatttgaggccatttgttcaaagactttgatcatttgcgggatagttctctgagctgcattccttcttgtgcttgtcatcttgtgcatgctttgaatcttttattgaaaaatatatttttgtattttatatctttttctgattagttttttctgtagcatcacttctgtttttattgcattcatcaattcatttagtatggaccttacgtttctgtttcttttgcagccagcacttgcgtagtctgtttcattgccttgagaatcaatatcagccattctgtaaatttgatgacaaatattgagagcttgctgtgaggaaggcattccattacagggattagcttttcttttctyttctatcgttaagctttgttttctttgactgcttatacccttttcctatatattcattcttctctgtttactgatctttctttcatagtttcaaactattttatttgtattgtatttactgagatttgtgagaaattcttttaaatatactattgagatcccactttatgttcgttataaaaggtaaaggaattgaggtattttgaattttgtaatggcgagtgtaattaatgatcacctaattataatccccccattttaggaagtgactttgtataagggaaacgaaattccaaattcccatttcattcttgttaagattagcttgaagggagagcctcccatgatgggagaatgctctccactagaacgtggtttgtaccatgtgggcgtgtctctggagagctggctcattggtgctacagcctcaggtagagcagcagctgaatgactgactctggagaagtttcactgagtggttagcaagtgtgaagccctaagccaaagactatgaaagacccaagaattcagaatccacatgtatataatgaacctttaattttgtgaaagagatagacatttggatgagtggcaggagacagtgtgtgtccattggaactgtaagcaagtaggtgtcccgcacagtaaagcattgaggggtcaccctgtgggacaggaacatgtctaagtcacaagccttatcttcagagaggcatcaaacacctacagcaaagagctaaggattaatatcaaaatacaaatggatcatggagcggtttagaaatattgcaggccgcctctggtataaacagagaatgatgagggtttagaggtagaagaactgactataagcagaagtgtttgaggaggctgcatggagaacaaggggcatcatcttggcccttggcaggttggcaggatttgacttggtgaagagaacgagaaaggggactttaactgggaggactactctggggcacagaggagggaagctgttttatgaaaccaggttcatttgttcccatctgtaggttctgccctgtccgcaagcagccgcgtcttggctcactcctcttctcccctcctccccattgtgatgaccatgagccttctcttggagtgtctgcccagtgggcccttcagcctgggcgctgctttggttcggatgatactgtcctccacttgtcttcttccaaggatagatagcgccctgacctctagggccagcagcctgttgggggatcttccttccaatgtcaccagccttaccagcttcttgagtatttattccttcataccacactcagccttcttctggctccttgctacttgttctcttagcatagacactgtcccctctccctttccccagacataggcttccaggttgcaattccatgagtgttcataacaagcctcagcagtacactttaggtcttactgtccttatgtcctctggcacgtccctgtctgtgttgctctgtggaccatggtttcccatctagaaaccattacttgcagtggggaatgatgcacatgaggaccttcgaagggcttgtaggagctgaggctgtgggaataaagtgtgggccctgattctgaagggacttgattcagtcstgaagagaaaccgtgtatttttggtttctagacactctgtaatttatttaatcagacctttattgagcacatttaggctgtcttcagtctctttctgttaaaatataacagtaattatccacgaataaacataatttaatgttaattttgataatgccactgttttrgtgggagaggcagataagctagtagtcttcagacagggmatattttctagatccttgactttctatgtcccctttccaaaggctgatctgtctgagaattcagttgcactcaaggtgtttcctttctcaatcactcttctcccactttacaaaaggaagacatagtcattattaatctggagtcttgctgtttgtgtgcctgatgtgtgaaagcctccagattaacaagcaaaggaacaattaggactattattaggaaagtgaatgactgkgagtagcaaatccttttctaagtcagatggtttccaattcttgctttcaacaaaattgaaggcattgtcagttggtagataattaaaaataatttttgattataggtcatgacatgattttgacttgtgattctaaagatactgatattgctatagcaaaatttattttacttctcccattcaagtactaacggggcctgaccctgcttagcttttgagatcagacgagatggcacattcagggtagtatggctgtagactstcacttctgtttagttatttatgtgaacaaggtttcttggtgcttaccactataaaaatgaaaaattaatgcattttgaataaaattttactttttatgtttaataatagtaccaatttctaaaccaattatgttttgatcatttgcatattcaaacaataaagataatgaaaacccaatccagaagaagaattttttttttaacatttacaagttatagcctggatgtggtggctcacacctgtaatctgaacactttggaaagccgaggcaggaggatcacttgaggccagtaattcgaaaccagcctgggcaacaaagcaagactctgttcctacaaaaataaaaaatagaaagaattagctgagcaatgtggtgggcatctgtagttctagctgcttgggaggctgaagcaggaggattgcttgagctcaggagtttgaggctgcagtgagctatgattatgccactgcactccagcttgggtgatacagcaagaccctgtctctaaaaaaaaataaaataaatagaataaaaaattgaggttataatcatagcagaatttaaaaatttatgcatttatatgtatatatgtataatactaatatatatattgcagagaagtataggttgatcagtaaaagattttgaagcataaatattaggataaaattctgaaaacgaaataaaaggaagtaagagttaacaaaaaggcatagtataaaatgtatgttcttttaaatagatgatccactatggcatttagagtccattggatcatttagattcatttaagagagtaatgttgtatttaatttaaaaatgtaaatatttatttatttttaataaaacatttttgtcgagacagagttctgctctgtcacccaggctggaatacagtggtgcaatcatggctcactgcagcctcgatctcccgggctcaagccatcctcccacctagcctcccaagtagctgggactgtaggcatgcaccaccacacttggctaacttttcgatttttttgtggagctgaggtttcactatgttgcctaggctggtcttgaactcctgagctcaagccattctcccacctcagcctcctcaagtgctgggattacaggcatgcaccactgtgccaggcctgtaaatatttataaaatgccaatatttagaatatggcagaaagtacgtctttactactggttgtgatgcaaaaatttaaatattaaatgtaaggagggtaatataacattcttttagggcacataagataaacagacatttacaatggagtatgatacagatgtttgaccagaggaaagcaaagaatgttgaggagaagatgcaagggaagcccatggccagagaaagcaaccaaaggaggtgccgtgggagcggcatcttgagggactgttggagttggcttagcaaacagaggagggaagccattctgggaagagggagtggtgtgtgcaaagggtctggaggtagagaatatcaggatcaaccttgggggaaagcacaggggtggcatgagcaggatggtgatttacggcagccagacagcgtattatttgtgacaggatttgtgtattccgtatgagaggagggcttggaaaggagaggcggtggtggggctggagatctgtggaggtagctgttgccaagggccaggcatgagcaagtgaggccaagaatgacccctgaaggggtgcttccttcccagtgactgttttccatcttagtaatcttctggacatttttacaaatgcagagattcttatttacattctgctagaggaagaaattgaggcccactgagagtctgttcctcttgcaggttttgtacttagtagcaatgggctgattgggcttagtgctgcagcctaaggttccacattggccacatgctcaattagggcctttagcttgttattaagacgagtgactccggccgggcacggtggctcgcgcctgtaatccctgcactttgggaggccgaggtgggcgaatcacctgaggtcaggagttcgagaccaacatggtgaaaccccgtctctacaaaaaatacaaaaattagccaggcgtggtggcacttgcctgtaatcccagcccctcaggaggctgaggcaggagaattgcttgaacccgggaggcggatgttgcagtgagccgagatcgcgccactgcactccagcctgggtgacagagtgagactgcatttcaaaaaaaaaagagagaaaagaagagcaactctaattttggagccaaaatttgagatccttaggccagtacaggatttttgtcctgatttttgaatttgcttacatgagaagcctttacagagtcctaaacattaaatcaaactgaatgtatgcatttacgaaatcacccttactgtaaagaatttaactgtataaactctttggtctcaggaaaggtagcacgtgtgacacttttctggtacagggaattacagggaattctttgtctttcatgatgtctccatcatgaaataagtgaaataagactttaaataagtgaaagacttgaaataagtgcagtgaaataagactgtgagcagtcccaaaaaatatttatgacaatttttttcccatttggaacatttgtttagcacagtgatagagacctgatgtggtgtttgcgcngggcagattgaatgcactccaaaaggaaaccataaagggtcgagtcgataccacacagaaacacgaggtggtgggatgagtggtttttccacattttaatattttccaggatgacactgaaagccttacccttagagaaccctgagccacctaataattcataactccagactcttgagagggagaaatggaggtttataccattaaatagatgttctgggcctttcctaagagaggctggaaagaaattgagggcagtcatcggaatgtgaccagcacagcaaggtaagggacactgcacgactttgattccttgtggaacaatgtcttcttaatatcagtatttccagctccctgtttttaaaaaagtctctaaaaagcctatcttttttgggaggacaggagagaaacctgtcaaggaagtaatgagtcagcaccggggacctactatgtgccgttcacaacttgatactttcgtgaacggattgtctcagagaggaggaaatcatgactcagagaaattatgtaaatcactgaagatccaggatttgaactttggttcatttgattgcagatttctttctactrctttgtgatgccgccttgtgctgaaatcgtggagaatgggggatactctggattgaactggggaactcatggtatccagctaactggcctgaaaacccaagtacccttgatctggaggtgtttggggagaggaagaatgatggttagaatagaggaatcgaggagagagacatcaggagttgctcagactgtttccgtttcatggaaagggaattttgtgccatgtcatgtagtccatggtggtggttcggaagaagtgggtcctgaattcatctgctaccagttacccaatgaaggaaaatgggagaaatgtggcatatgggattttacaaaacacgtttttcttttattttgagacatggccttactctgtcacctaggctggagtgcagtggtacagtcataactcactgcagcctcgaccrcccaggctcaagcaatcctcctgcctcagcctcctgagtagctgggaatacaggtgtgtgccaccatgcctggatagttttttaaatatttagattttttttgtagagatgaggtcccactatgctgctcaggctggtctcgaactcctgagctcaagcgatcctccaagcttggtctcccagagtgctgggattacaggcgtgaggcacctggcttcacaaaaacacacgttttgtttgtttgtttgtttgtttcttaatttggaccaatataggaaaaattttaaattttttttttaggcaaagggactaaaaacaaaaacctcaaatctattatcatcttcacaacatataagaagagacatttgcaaatcaaaataataaataaattaaaaacaagtcaagaaaatgggctaataagacagcaaagaaagaaccttccacttgtctattatatagttaggttagatttaagatgtttgaatcatggaaaatgacagcgtaagtttcttgatatttgtcagtttgggaatttttatttagtagtgcaacattaagagaagtttgactgtccagcttgtttcatgcctttttnttttaaaatcacagttactgttgggagtccattttgacagattttgatgaaaacagtatcaacaagcattgtaatttcactcaatatggaatattctggtggatggcaaaaggggagtgagaacagttcttaggctttcagttccgtggccaggccaggaagaaagcaggagtagcagctcctgtgtgtgactggtgagggctgcaggaaggggctgcaaggacctgtctgccagtgcttcctatgtggggtggggctggatactgcacagcacccttcctgcccaatatggaacgggtaggagtcttacttgagagggatgctgtggatggtaaaaacttncatcttggccgggactgatatttaggagagcccctcttgtaaaggaattatcctgtttggttctccaaaaagagatctacaggagaaggcacagacaaaggccccattgttttctccagggcagctgttcattgcgttggtgctgggaggggtgtgggaagcttgcccgactcaggcctaggtgctcagatgtgggagtggtcctgccgttcagccctattattttcttctgagcctttcttgtggggtctttttgcaaactgcattttcctccaagcagcagaatcttagcttcaccttttttgtggtcttggtgccctggaattttggtgaatgctgagtgcctgggaacagaaaagcctgaaagcaccttgggaactccccaagtcccctctcttttgtccaagagaatacctacttctgcctttccaggggctgtgctgggggaagtgtgtgtgttggcctctctggagaagggcatgctggcttccctggcctgtttacattagtctcattctcgctgcccttgattacaaatgaggcattgggcgggggatttccctgcttccagggaggtcactccttccttttgtctgtgctctcaatttttccacctggggaagagctgccttgaaaaaaaacccnaaaactccccttagcttaactccttgtctcatagactgtccagtaagtggatcagttcataatcaggaagcaattcatctgtctcctgaaattcccttcccctgggttctcttagtccttttctcattctcctgtctctgctgtagttatcagcactccttcctaacaaaacagtgttcccaacccagagtctggtctgctcctgggtgcttcttgagctgaggtgttgatgcaagggttctggaccttaggaatgtgtgtcctggcactttgagtagaatggaaaccctttgaggttaagagctccaggttttttccttccctcttccccactctgtatgtaatgcttgtgagaggacaggaggggtcactggggagggggaccactggtggcccagtttgctggtgtggtcacctcagaagtkagggaaagcctgttgccctgagcatgggtagaaagctggcttcagacccctttgctcttctgtggaactccccrcccacctttcttgttcagttgaacagtgtcaatatcagagcctctaatacaattaagggatcctatttgaagccctttcttaaaggttattggaaagtgtaagtgaattttacttggtggtaacaacctttccactcttttcacagatttcacaccctttggagagtttctttcttggataattcaggtaggtttttaccttttgttttttaaatcagtggatctagttccatacagtgacttcttcagttcccccggcaaagatccttgttcgggtcccttgaatttccttctgattccactgatgatgctcctggtttcccagggcttccatctcattctcatagattcctgtctaccttatcatgttgcaagctttattctagcttctgttaggccaaattagtatccattctctttctctcttcctccttttttcttcactggaaagttaatgttttgcctttgggctttttttctaagccaggtttcagttcagaccttggtgctgggagtaggcttggattcctgtgttatgttgcttcagcatacatctgtgttgtaggcctaagaatggtcattgcttctatgttgctctgagattttagctccatatccttttgatcaagctttgtgttggtgagcactttttgtgtcctttaagaattcctttcccgccccaaggtcatgaagatagtcctcctaagttttccgtaaatgctttccctcttagataacattcccatttagacctacaatcctatctttagatctcaaccacttttaaaactcggattcctttgttcccagcttgtcctcagtttaggattgcatttttcctcttttgtcacccatctgctggcctttgcagtggtctcttcgatttccctctgtgctgtgcctacccaactcccacagttttcctctctggcataggtcacagaggaaatatttagttagtccctgccaaacattctggctgtgttgttttgcttaaaaagacatgcagtaaactgttttgattcttggtcgtggtgctgtagggcagatgtttctcctataayggaggtgttgtggtcagttggaaggagcggtggacgtgagttcggagaattggattctaatccctgcagtgttactagtttgtggtgggatcttgcgcaaggcacatttgtatgtctgaatttccttttgttagaggggaacttatttcatggtgaagaagacaggactctgtgggtatgagataggaatctaaagagtaagcctgggagatccaggaaagactagacaggcaagaggcagagaaccattagtgtgagcatccttagtggaactggaagggaactcagatgactccaaacagataaaagtaatatatgtagtcrctttgaaaaagtataaaacgtggtaagaaaaactgatggaaattctctgacgaggataacttaaggagataactgcctgtccatgcctcggcttgctgtgggtccacacgtgtttgctgtcacccttgggatgtgggaggcttagccttctgcgggttcagttccagaattcttcttcccaccttccacctccttcataaactcaggaatatttgaaactcagcccagatcttcacctggctttgatttctccatcatgcggagattggtctttggaagttgtagcttccagagaccttcgatgtttgctaacatgtccaagctctacatttattgattgttggttctgttcatggctatgttcaaattcttgtaccctgagggtggtatgatttggttccagcaaggaaggggagggtatttgggggaccctatcatcaagaactaagaaataaagggaaacggctggatgtggtgactcacgcctgtaatcccagcactttcggaggctgaggtgggcagatcacaaggtcaggagttcgagaccagcctggccaacagaatgacaccccatctctactaaaaatacaaaaattagccgggcatggtggcgggcgcctgtattcccagctactcaggaggctgaggcaggagaatcacttgaacctgggaggtggaggttgtggtgagcccaggtcgtgccactgcactccagcctggacaacagagcgagactccatctcaaaaagaaaaataaagggaaacaactgagtaggtgtcctcttggtgttcctgagaggcaggcctttgaagaagaaacaaaatggtttaacttctgcctatgtaatccccatccctcctccccaaatacacttactcagacagagctacatttcttccttatccctgtacccttctgaaatgactgagatttaatcagatcttgcatagtttagacttttttttttgttccagttaaagatttgcattggcttcttccagtacagaatgagttggacaaagacaatctccaaagtattttgctgttctgtggtcctttgtcgggcagaaattctcctaaagaagtactgagggccgggcatggtggcccacgcctgtaatcccagcacttcgggaggctaagacagacagatcacttgatcccaggagttccagaccagtctgggcaacatggtgaaaccccagctctataagaaatacgaaaattagccaggtgtggtggtgtgtgcctgtagtcccatccactcgggaggctgaagtgggaggaccacctgagcccagggaggtcgagactgcagtgagctgagatcgtgccactgcactccagcctgggtgacagagtgagaccctgtctcaaaaacaacaaagtagccgggcgcggtgggtcacacctataatccagcactttgggaggctgaggcgggtggatcatgaggtcaggagtttgagaccaggctggccaacatggtgaaacttcatctcaactaaaaatacaaaaattagccgggtatggtggcgaatgcctgtaatcacagctacttgggaggctgagacaggagaatcgtttgaacctggcaggcggaggttgcagtgagctgagattgcaccactgcactccagcctgggcgacagagcaagactccgtctcagaaaaaaaaaaaaaaaaaaaaaaagaagtacagaaggatgcttgtctttgcagggttagtgatgaggatgaggacccatgctcactgttgctgtgcccaaccctgggaggctctcaggctgctgaaacttgctagagaaagttgtggagctaagtagaatatttctgggcagaagagctccataattgattctgtatactttcaagtaggacttctctgttattttgcaatttttttttttttttttttgtatttttagtagagacggggtttcactgtgttagccaggctggtctccaaattctgacctcctgatccaccaacctcggcytcccaaagtgctgggattacaggcatgagtcaccatccccggccctatattcaccatgtttttatgtattccataagccctaactccactgtgacctacatccccgatgaggatgcctcctactttcctgagactgttagagctaggtgacatagaactctggggtagtttattttctttagatagatcggtactcagccagccagctcaggagaacaggcagtgagcattccccgtaggctctgtagacgtgttccttgcgaatgccaacgatgtctggttgaagtaatagtttgatctggggctggataagagttgtgagcctgtgtctggcatttggtattttcccccattctttgatcttaagttgtcctaggcaggtgatccaactggtatctgtcacataatatccagtgcgtcctccctggcactccgattctcagtagtcatgaaccagctggcttctatatctctcaccaatcacaggtaatttaggtctccctcaggtaagtgttcttcagatcctactcacatcctctttaatccccatctttccttctctttctgtccttatgattttgcttaattgcctcccaaaaaaccctccttatcccctttcctttttgcctgtgggataaaagctagctttgatcatagctggtaaagtgtgaaaccaagaatacttctgaaaggacagtcagacatttgggaatgaaagtagacggtttgaagtatcagtgccatcactattgttcttgagaatgcttttaaagattccccccagatatccatcttttaattaacctgcccttcttccaggaccacaatttgaaatacgtaaaaattattatttatttgtttgtttggagacagagtcttgctgtgttgcccaggctagagtgtggtggcgcgatctcagctcactgcagcctccaccctctgggctcaagcaattctcccacttcagcctcccgagtagctgggaccacaggcacacaccgccatgcccggctaatttttgtatttttgtagagataggttttgccatgttgcccaggctggtcttgaattcctgggctcaattgatccgcccaccttggcctcccaaagtgatgagattacaggtgtgagccaccgtgcctggccaaaaatgatataattttattcctcttacattttgttttattgctagtatttacagaggtattgttttgtgtctttattatgtataaacagtatttcagccatgttgttcattaatgagcttgtctgcgcatctggctaccatgtctggtgttgtttctgtggaaaactgtcttcaacctataaagggcgactgcctgaaaaaggagcttttagtgaaaacacagtctgttcaccctctggcccctgctggtgaagttgctctagaagagactgactctgttcccattgcatgaagaggaagaaaagtgcttccaagggcttccgggagcaggtcaggaaagctaggtctgttttcttcagtctcggctagaggagctggaatgtgccatgcctaactttgcctaagctcttttctttttcgcactgtgtgtcacactgggaaaaacttgagcttaaaacccaatgaaattctcccactttgaaaatcatgatgtaattatgacaggatcgcattctttaaacttactgtttagtggggttagtggagttatctcctctgatttttgacaaggaaataatacattcttgttgcaatgctgtatcaggtcttaggatggaaagcgtctaatttaaagctacagacctttcctgtaggacgcatatgctgctaatctatgaaaactgaagatgtcccagtgcactgtgtgtaaactgcagcatctccttgtggaatgaacagttcaggaaaatagaatgactttccaaactgtactaggttccaggtgactgaaaatttcctgtgagggtgggaaagcttatccagatgttcttgcttggggatcagcatgtgtcatcccgttccaaagaagtacagtcacagctgattttatctttgtccttctttctgtggtgcccagggatgctctttttgagttcatctttggtcttgtctctctgaaaaaagcagcatgcattttgatctaggtttaaacagttaaaatctgtggccacagggtaaggtgaaactaatggctctaagtagccaactttttacctttgcttcactggcaccaggctgtgagtaactgaactaaccagctgcagacccttattatgcaattttgaggtaaggatgggtgaaatcctaggggctgggagacagacatgtttggctaccagagagatgacatcagttcatttactggtgctgtggaggaaggggagattccaggtgcttagccttcttcctgcatgtgggggtgtccagagccacccttaatcctattcgcagccaaggtctttgcttgggaaaaaccatatttaactctgtgcctcctgttatccccatagggacatgaagttggaagggttcttgtatctttggcttcccgaacaaagctttgaagaacagacgtgtgtctatatgtgtctctgtgtgtattttgtattaatgctagcaactgattaaggttttcagagtccaggtcgtatatgagaaggggaagtgtcatctggattttatggaatctgtattaggaattgccctttccttgcaaaggaaacmgttaatgatgtaatccacttttaaattaaaattattttattattttattttgatatccttcacgtggacacttagtatataacaggaaggcatctttaataactctttctgtgttctgctccttctcctgtgcttatcctagaacagagccttacagggtcataatttggaggaagcacaggcttctgggagctgtggtactaacagtaggactaaaaaaagccttatgacctctgaagcatgactgagagaatcaagctgggaggcattagagcccatctgctcaccagctttgctggcctgtcagatgttgggcttcccctccggtttgccctcctccctcaagatgtgttagaaaatgaagcctgcttcctggaaagcaggtgacgccaaagcctatgctaagaggatccgacctcacatctgcgtgcctgccttgggctcccctgtgactggattgcttcgggtctccctaagacccttgctgacattcaagtgcagccgctgcttactggaagccgtctggggccagcccaggcttgttctgtcagggcctcttcccaccactgtgtcctcgcctcctgtgggctttcacatacaagggcctcaccatccctgaattgccagaatccttgttstgagaacccagtgcctcccagtcagggcccaggaagctgtgggtaagctcttggtttccttctcggccagacacttctgggaaactatctgcattcctttctgcccaactctgcctctgggctctggggctgtgtggggtgtggctgcctcatgcctctgtgaggaggaatgctagttccactgagaccagccatggaaggtaaccaggagtttgaaggtggaattcccttttcttgcagtcctagagccaggagctagcttttcatggattgtgatgaggtgttggttcttttttttttttttttttttggagacagagtctcgctctgttgccaggctggagtgcaatggcacaatctcggcccacagcaacctccgcctccccggtccaagcaattctcctgcctcaacctcccgagtagctgggactacaagtgtgcaccaccatgcccagctaatttttgtattttgtactagagacggggtttcaccgtgttggccaggatggtcttgatctcttgaccttgtgatccrcccacctcggcttccaatagtgctgggattacaggcgtgagccactgtgcctggccgaggtgttggttcttttaaaaattttccaacttgctttcctgtctcgctgtcactctggaaggcgggggtgaggggtaggaggagagacagtyggctcagtcggctgtgatccatctttggcactggagatgggtgtggcagataccttttgtgaggaaggagcttagaggcagatgagagaatctgcctcttggtcttggtataactggacgtctccccagtctggctctgttgacactctgaatggtttgtgaaggcatcctctggcccctgaaggcattaccatccttaccaggtttaaaatctttcagagtgcacccagcatcatcagctcctgcaagcagaaagggcccaagggagcatgaacacacactgggtagaagttaagcctggttttttaaaatttaagtttaaatttttaattatttagggagtgaatcctacagaatttaatttttccatcttttttttatggagacagggtcttgctgtgttgctcgggctgctcttgaactcctgggctcaaacagtcctcttgcstcagcctcccaacgtgctgggattacgggagcaagccaccccactgtgtgcagcccagaagttgagcctgagaggtaggcttattgccctgtgtctacccaagggtgtgtgtgtgtgtctggaagtggagattaggagtgaatgcatcttataaacaggagaagatctggagagacgatggtgggggctggctgtggggagcacaaaagctgggacttttgcagaggtgtatttgctcccgagtggccagaagccaggagtagtggggaaggtgggtttaggcatgctaggttatgcttgcattgctgagtaccttgggtgtgatggccaggaatgctttcctctgggaattgggccgatctcctgacaatcctccccattttacacccattacatacttatgtgattcttacctatcagggaggtcttggggtcatgtgttgtggggcagaggctctgagtctaagaatgggctggtcagccaggggctcnacctcccagtttgttggcttcctcaaggatgccatccttctttgcagctgccaatcttcactggtgtctgtgccctggcagggtatagagcccttctcatgggtgctctgcctctttgggggcttgagaacagatggggcttaatttgaagcagatttccctccagggcccaggtatgaaatatatattagaagatgactactggtcttggcttttctttcttatgtgtctctttcttccttttatcttcccactactgtcaggcactgtgagcagctgttgctatcacacgggcggatcagaacatgaagaatggagctaaatagagctgtctgcatgctgttctgatgggctcaggctcagcctcagagaataggtggattggagcctgtgatgggggctctttcccccaccagagtgggtgaaagcagggaggaacaggcggnaagatactttaggagttgggagggtattaattccacctcttctctccttcctctgtaccccaacattccctgtgagttgtcaagggctggagagataacaaagatctttctttccaccatcaggcagtaaggcaatgcagccctcgctgaattttcagctccactgacattgtgatgcaaatattaaataaagcttattttctgacctgagggaatttataagctattgggagagacagtgtttgttaaacaagtagagaatatccaagatcttaactgtgttggtttacgaaccatggatacatttatagttcagaacaagaaagttgtatcttaaaaccacagaaaactttccttggaggaggcaggatttttctggtctttaaagttgggtcaactttataaggaaaggagagatgttcactccagtgtcacggcgatgatctaccttggaggggtaggtgtggcagagcagagccagggacctgagctctggaagtcctgccattacataggtgatgtgaagtgatgcagtgaaggtggagttttgtggaaatctctcctgtagatcgatgaaaataggataattttggagaggccagagaaaggcagtgaggaggcctgctaaaggacctggcaggtcagcaacaggagagaggaagggggcgagtcctagagaatattccagagtagatgaggcaggactgacatgaaggatgaacttgaggggcaagacggaagacaccaacgtttctgacctgtgagagctaaccaatactgacacgttctgtttgtgaagtacttggacttttcaaagcactttttcattcagcagagcattgtctgggctcttagagttcatctagtctggctctgttttatagaaggggagattggggacgaaaggggaagcgactgttcccagcacacacagctatttagtggtggggcgggacccgtgatataggcctctccctcctaagacaattttaagacaacagcagcatggaagagagtgtgggcttcgcagyaagtccgtctggctggataacattaggtgataaaccaatctctgagagctgagagaaacttactcagaagcattcagaccatatcaatggttcagctcctcagaattgtttttgagaaccacagagaaggaagatggactccttgggtccttctagttctcagattcataggagtgcacaaaaataatgtatatgaatagtactgaatggggctccccggagactggcgggtctccagtgtggtgcctttctaagggaattttcaagataacttgactccacatgatttttgccttgtgctgaccacggaagctgactgcaaagacaccactgctgaattgcgctgtggccagtcatcaccacagccaggggctcagcattgcagtgacggctctgatgtgtcacccactcctctcccacctcctcttacaacatatgctgcacatgcacatgcacacacataccacacacacaaacaccacacacaccacacatactacacaacacacacacaccacacatatgcacacacaccacatgcacaaaagcacaccacatacccacaccacacacacaaacacaccatacacaccacaccacacacaccacacacaaacacaccatacacacacacgcacaacacactccacacatactacacacacaccacacacatgcacaccacacacacacccacacacacaccccacacacacacactttctcctcccttccctgcctccctccttcctttcatcttactttttgtcctccacagtttcttgtctcatccctgtcttccacctctgctccccgctcttgtctggtctaattaacttcctctgttggagcagcttcccctcttgggtaaactcagacatgaccgcagcaaagcagcgtggaatcttctgtttggtcagtgttccctgaaatggtggtggcactcagccatccgggtcagaagctggagtccttctggagccttgctcacctctgcagctggtcacctccgagtccttgtttcctattaaaagagtgctcggtccgccctgcttgtccccattctcaccaccccacatggcaggagaggaagcagagagggatcatggtggaagaaaggaacgcagagatgagggtcccctttggtgtccttgaaagcagtgacccctcacagagtgggttcttgtggtctgcgtcctgacccccagcttccccgcagatacagctgcattggagcccctgaagacaaaccagagaagtgctgcatcctggggggcaggaggctttgctttgcccagggctgggctcctgaatgaattttggtgcagccttaacggccgagttgtgctgttgaaggtgcactgctctgtgtccaggcacttctggaagaggaagtcaaggtcatgaggctgaattaggctttgtgtgctccttctaggttctcagcgtctgtctggtcctttacttgctttagatctctgccccagccactgtaggcaggaacagctctcttccttgagaactcaagaggttctcaaggtagtaaacttcatggtgctcttagtttagtctgaatggccttggccttggggtccatcccaagttccatagccagcagttgggtccatgtctcacatttttgtccctgtctcctccacacaacattgccacagtccacccccgttccccctccccacctccagtctggtgcartagggatttaaggaggaaatggattacctggatagtagaggaaggaagtttgtggctggcaaattgttattttatttggaaagtctatcccattctctcccaaccctcagagcataaggtgaagtcagatgtcgttgagctgtctctcttcctagccatcttggataaaacagaggtacagggttcacccttcagaagcttgctgagacagtcttatttactaaaacaacaacaaaacaaaaaacacttcaagcccccaaatcccaaccacataagtctctaagcctctgacaactctcgcatctctctgggtcttggaccctctgtgacaaagcagtggtaacttggtaactgtcttgggagcacgcagagagagtcaagcctcatcttgccaaattttcccagagtatgcaccccttcttcatctcctctgggcctttaccttagaagagctgtgtcatgcattactgatggcagaggctgtctgcattggagatgagtggctataatctttcatcaccttcaggagaactgtgaaatcgttgacttcctttatctgctcgggtttgagatgagctagcatctaccagttttagcctctggagtcccatggccttgtaagaagggagtgttctgctggcactagctgtgcgggggacagtagtccttgaccctttgttcttttcactctgccttcctcctctcagtcrttcacagctcagccaaccagctaagtggggtgtaggcagatgtatcaccccagggtaaggagccccagacagggagggaataaangctttctgaattctttctttcctgcaaattcaaaaggctaagtggtgctcaagtatgttccctgacatccctgggagtaatgctcaggaattcccccaaatttgccactctgagacttccaaacaagcttcctcctgtttctgtccttcaagatcttaaattgctttctactctccccgctccctccacattcctctgcttttcctttcatcatctccctcatcttcccttccttgnatcgtggggtctaattgatttctctatcacacaggttgttcaatgttgatctctaagtgaatgaacattcataaggacctctttttacacaaaggcaaactagctctcttccgcagaaacataggatgggcccagtgcatgtcttgttagataaggagctaatcattgcatagattaggaacttctaagttcttaaccttggggaaaaagaagatagtttaaaaaatggcatcttctcctgtaggatgttgacgtttatttagtatgactcatctgtagatcagggccgccttccatgttcctaggataagaaccggatgttgaatggccactgctcttctctctccccagatccttagaagaagcatcatagggttcctttacaggagataagctggtatgtctatatcccagcaatccctgaagaagctgaaatgctgcattcctaccatctaatgtttcggttacagcatttaagcctgagtccttgctcacaacagctatcagatgacagcttagtataggaggttaaagatccacaagaattcactctgatagttaaaaatatcactgtgattctgcttgtagtgaaccatggtttggggagatgatgggtcagaattgtttggattcctgagctgctctatatccttgataaagctcggatggtcagagccccagctgggaggttttgatgtgactagcaggagggacaaagggcaggtcaggcagggcccagctgtctcttctttctgtgagcgttctttattccccagagatgactccgtggggataaaagcggtagttttctatcttcttgttctgcaggagaacttacaacctcatgaatcagacgtgttatcttctcagtttaaggggctccaaaagacttgatttcctttttttctttcaatatatttgtctgaaatgttattcaagactccatttaccccgggactgcaaatataatatatgtcccctggaaacacttttgttctaaccagaatggagcagagtaggacatgaatctcatttgatctgggccctgtgttttgtcagctaaactcaaaatcacatttgctcatcagttgactcatattgaacctttcctcaggtctttttcactaataaccatctttatcctgttgtcttgcagtatttttctaagcttcagtgtaaaattacatattttaccctttaaaaatttcatcttgccgtatttaacctatggttccagtttgtggaggcttttctctctgattatatctagtatattcattatccctcccaattaatttatcataaacatatttgataattgtgtcttatccaagtcattgataaaaagggtaaccatgatgagatctagaataaatgggaagagaaaggaatattacagggcaacatccctgatgaacatakatgcaaaaatccttaacagaatactagcaaatagaattcaacagcacactgagtctaataagacaaaggtccagtatccagcatctataagtaacttaaacaaatttacaagaaaaaaaaaacccatttttaaaaagtgggcaaaggacatgaacagacacttttcaaaagaagacatacatgtggccaacaagcatatgaaaaaaagctcaacatcactgatcattagagaaatgcaaatcaaaaccacaatgagataccatctcacaccagtcagaatggctgttattaaaaagccaaaaaagtataggtgctggtaaggttgtggagaaaaaggaatgtttatgtagtgttggtgggagtgtaaattagttcaaccattgtggaagacagtgttgcgatacctcaaagacctaaaaacagaaataccattccacccagcaatcccattactgggtatatacccaaaggaatataaatgatttgattataagatgctgggtgcagtggctcatgcctgtaattccagcacttcaggaggccgaggcaggcagatcacttgaggtcaggagttcgagaccagcctggccaacatggcgaaaccgtgtctctactaaaaatacaaaaaaaaaaaaaaaaaatagctgggtgtggaggtgtgcgcctgtagtcctagctactcggaggctgaggcaggagaattgcttgaatctgagaggtggtggctgcagcaagccgagattgtgccactgcattccagactgggtgacagagtaagactctgtctccaaaaaaaaaaaaaaattttgtttgattataaagatacaagcacatgtatgttcattgcaacactattcacaatagcaaagacatggaatcaacctaaatgcccatcgcagtagactggttaaagaaaatgtacatatacaccatggaatmmtatgcagccataaaaaaagaatgaaatcatgtcctttgcaggaacatggatggagctggaggccactatccttagcaaactaatgcaggagcagaaaaccaaataccgcatgttctcacttataaatgggagctaaacattgagtacacatggacacatagaggagaagaacaggcaccaaggcctacttgagggtgaagggtgggaggagggagaggatcaggaaaaatactaatgagtactaggcttaatacctgggtgatcaaataatctgtacaacaagcccccatgacacaagtctacctgtataacaaacctgcatatgcacccctgaacttaaaaaaaaaaaaagaggccaggcatggtggctcacgcctgtaatcccagcactttgggaggcctagttgggcagatcacaaggtcaggagatcgagaccatcctggctaacacggtgaaaccccacctctactgaaaatacaaaaaattagccgggygtggtggtgggcacctgtagtcccagctactggggagcctgaagcaggagaatcgcttgaacccgggaggcggaggttgcagtgagctgagatcacgccactgcactccagcctgggcgacaaagcaagactccatctcaaaaaaaaaaaaagaagaagaagaagaagaatgagcagtggcctcaagtcacaaaaaaaggaaaaaaagggttcatgtaccatgatcaagtgggatttatccctgggatgcaaggattgtgtattagtccattctcatgctgctataaagaactgcccaagactgggtaatttatataagaaagaagtttaattgactcasagttccacatgtctgggaggcctcaggaaacttagaatcatggtggaaggcacctcttcacagggtggcaggagagagaatgagtgtaagcaggggaaatgccaggagcttataaaactatcagatctcatgaacctcactcactatcatgaaaacagcgtgggggaaatggcccccatgacctaatcacttcccattggatccttcccatgacacctggggattatgggaactacaattcaagatgagatttgggtggtgacacagccaaaccatatcagatggctcaacatatgcaaatcaataaatgtgataaaaacagatgggatgtgcctaaacttctaggagttccagagytcctcttcctggttgatgcagattcatttcatagcactgtttggacccagctgtcctgagttaccactccatccagctgccggtgcatctctgatttttttttctttaaagatcaagagagatttttctgaagtccagataaattatgtccctgacattctttgccatatgtatgtgcatatgtgtgtattcatttatgatatatatattatatacaaatatatattgtgtaaatatgtatggatattacttttttaagtccccaatctgttatttatggatcacttactagctattgctgagtgttttacatgtattatctattttattccctacaataattatatagtaacctcattaactaaaagtaatgatgtctcttgatgcgatttgtacttaatctccagggatcaatacttccttctctgagtccttgccactttttatatattcttttctggagttttgcctatgatattgattaagaaatattttttgagcacttgctatgtacaaagaaagtactgcattacagcctgctggaaattcaaagatgaatatgctagaagagattatatgtaattaaaaatgtaagggaatgaacaatagcttggtagggaaaggaggaaaaacaaaagaacagtcctgagtgtgaatggaatgccgaaactagcccacctgcagagttcgaaagggaaacctttagaagccatggggatggtacagtccacgttagattctcttcacagaggtggaaagtatccagttgactgacagttttaaatcctatctcagtaccttgttggagtggctccgtgagtctgaggtcaaagcggaaggttgcnggaaagagtccacttttgaaatcttttctttaaaaaaatgttgctaaacgttcagttataagataaatcctgggaatctaatgtacagcatagtgactatagttaatactgtattgtttacttgaaatttgccaagagagtaagtcttaagtgtcctcacctctccccaccacatacacaaaatggtaactgtgtatggtaatgaatgtgttaatttgtttgtgatagttgtttcacagtgtattagtatatctaattatcatgctgtacatctttagtatatagaacttttgtyaatcataactcagtaaagttggaaaaaattgagaaattatttaaaatatgtagaatgtctatttttatatgtatagtttaagtgacccaccacctagcttaagaaagaaaatgctactattaactttaaaatctcctgtgtccttaccagtaattgatttaatttargaaaataaatgtatgttgaatggtagaaaatagttcacaagtttgagaccagcctgggcaacatggcaaaaccccctgtctacaaaawataaaaaaattagcagggtgtggtggtgcacacttgtagtcccagctaytcgggaagctgaggtgggagaattgcttgagcctgggaggcagaggttgcagtgagccaagatcttgccactccactccagcctgggygatagagccagaccttgtttcaaaaacaaaacaaaacaaaacaaatctacaatagcagcagtgtagaatatgtagaatttagtaaaaaggaaaaaaattgctaacatgattattgcttggtataaatttttttcacttgcatatgtctttacattttaatgtagttatagctttattatgcataattagcgttgtctcccatgctaataaagtcttcgtaattgccatttaaagttagttcttttttttttgagacaggatctctctctgtctcctgggctagagtgcagtgacgtgatcactgttcactgcagcctctatctcctaggctaatgtgatcctcctacttcaacctcctgtgtagcggggactacaggcttgtgctaatttttttttttttatttttggtagagacaaggtctctatgttgcccaggctggtcttgaactcctggtctcaagagatcctcccaccttggccttccaaagtgctgggattactggtgtgagccagctagttaatttttaaataaaaaacgtgttataaattcaaaaggtacaaaaagatatacagtgaaaagcaagttttcctcccaccctcttttctccttagaacaaattgctgctaccagtttgtggtttatagtagtttcttttaaattttttaaatttaaattaaattaaattaattaattaatttttttttttttttgaggcagagtctcgctctgttgcccaggctggaatgcagtaacacgatctcagctcactgcaacctctgcctcctgattcaagcagttctcatgcctcggcctcctaagtagctggaattaaggcatgcgccatcatgcctggctaatttttgtatttttggtatagatggggtttcaccatgttggccaggctggtctcgaactcctgacctcaagtgatccacctaccttggcctcccaaagtgctgggattacagatgtgagccgctgcacccagccatagtcatctcttacaatggctgcacaatagtccatctagtgcagtttttcagaccaagggccataatccattattgggtcaggaaatcagtttagtggggctctatgtacttcgttttcttaatttcttaataacatagattaggattgaaaatagcagagagcatcacatacagtaaagatagtgttgttttgagaaacctttttggttcagttttttacacacatgcacatacacacacaccctctcacacatgcatatgctagattacaatgtaaaacattctttattgggttgcggtttaaaaaaatactaatctaggaatgactgatatggagattgtttctaattcttaaaattattaaaaataatgctggaaacagacatttattctgcatacttaggaattttctcttaggatattctccctgagtgaggctactgagtcaaagtctgtgagcattttaattgataagttactttccaaaagccatatcccatttactatttaataaatgtcatctgtgctttgtttagcataggttatttttattttaacacagactgttttctatgggtaatatatgtgatatatatatwttttaacagaaagggatgatttattaattttacccccaagtaatataaagtgaacatttccctattttactaaatattcttcaacagcagtgattctcattctgggggcgacttttcttgggtgtagggtaaatactttagtgcttcccaaacttgagtcagtcttacctacctttatgattttttcctgtaaccatgtattgtatatacttttatttacttatctttaaatttggcttttaaaaactttttacttttaaataattttagacttagagaaaagttgcaatggcagtacaaattctcctaatcttgtgtaactacagtacaatgatcaaaactaaaattgatattgatatagacttactgggatttcaccagtttttcttacgaaactcctttttctattccaggatcaaatccaggatcccatgttgcatttagttgctgcgtctccttagtctcctctaatctgtgacaattcctcagtctgtccttgtctttcatgaccctggcccttttcaggagtactggtcaggtattttgtagaatatcccttaggttgggtttacttcatgttttctcataattagatcaaggtcatggatttgggaagagcaccacagaggtgaaatgcccttctcagcacatggtatcggggtacgtggtgtcattatgtctttattgcctgtggtgttaacgttgatcacttgattaaggtgatatgtgtccatttctccaccgtgaggttatttctacctttgtaattaataaatactctgggagagatactttgaggttacacaaatatcccattttatcttaaacttttttttttttgagacaaggtctcactctgtcacccaggctgtggcgtgcagtggcatgatcatggcccactgcagccttgacctcctgctaggctcaagtgagcttcccacctcagtgtcgaaagtagccaggcctacagctgtgtgccaccacgcctggctgttttttattttttgtagagatgggggttttgccatgttgcccaggctggtctcaaactcctgagctcaagcgatcttcctgtcttggcctctcagattgttggaattacaggcatgagccaccaagccccgcctctccttaaacttctacctgctataaaacaatactaaaagcatacaaaaaacgtaacttctttagtattgatctaatcagtgagattggtaataatgaggttagtagctggctttgttcttctatacattaagtaatataaaagtattaaaaacttaaaaaaagtttgtccatataccacttataatcatcttgtatacacaccccatcttggacactctggactactgtgaggtgttaagcatcaaatggtctaggttctgtggtgacattattaataccctttttagttggattgattagttggttggttttattagttcattcatttaaaaatytattaattgtacgtggtacacagccctaagctagaattcagagttaagacatagttctttctctaaagaatattacagctagcaggagaattaagctgaatgagctttggtgcagtcacacaaggcagtggggcatggctggcattggagtggcagcctgttctgaggagtactggggggtagggctagagaatcagtctagccggggagaatgaggggagctaggattgaggaggttgacacagtctgggctcacacttcctacagccttgcccagatcttactcttaggggtacttctttcccaggctgaaggtattttcttgggtagatcatagaaaagcagcttgagtccacattcctcttaataccctacctcttccctttccctccactttgcaccttgcctccgcaatcctgaagattttaatcatggtaggttaaggtcattgttgaactcagagttctgagctagctaagcttggaaagcctattattattattattattattagagacagagtctcactgtgttgcccaggctggagtacggtggtgtgatctcagctcactgcaacccccacctcccaggtttcaagtgattctcccaccttagcctcctgagtagctgggattacaggcgcctgccaccatgcctggctagtttgtgtatttttttttattttttatttattttttattttttattttttattttttttattgatcattcttgggtgtttctcgcagagggggatttggcagggtcataggacaatagtggagggaaggtcagtagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccccaatccatttaaccctgagtggacacagcacatgtttcagagagcacagggttggggataaggtcacagatcaacaggatcccaaggcagaagaatttttcttagtacagaacaaaatgaaaagtctcccatgtctacctctatccacacagacccggcaaccatccgatttctcaattttttccccactcttcccgcctttctattccacaaaaccgccattgtcatcatggcccatccccaatgagccgctgggcacacctcccagacggggtcgtggccgggcagaggggctcctcatttcccagtaggggcggccgggcagaagcgcccctcacctcccggatggggcggctggccaggcggggggctgacccccaccccaccctcccggacggggcggctggccaggcagaggggtcctcacttcccagtaggggcggccgggcagaggcgtccctcacctcccggacggggcggccggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctcccggactgggcggctggccgggcggggggctgatccccccacctccctcccggacggggcggctggccgggcagaggggctcctcacttcccagtaggggcggccgggcagaggcgcccctcacctcccggacggggtggctggccgggcggggggctgacccccaccacctccctcccggactgggcggctgaccgggcggggggctgacccccccacctccctcctggacggggcgactggccgggcagaggggctcctcacttcccagtaggggcggccgggcagaggagcccctcacctcccggacggggcggctggccgggcggggggctgacccccccccacctccctcccggtcggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggcggcgggacagaggtgctccccacatctcagacgatgggcggccgggcagagacgctcctcacttcctagatgggatggcggcggggaagaggcgctcctcgcttcctagatgggatggcggccgggcagagacgctcctcaccttccagactgggcagccaggcagagaggctcctcatatcccagacgatggggggccaggcagagacgctcctcacttcccagacgggatggcggctgggcagaggctgcaatctcggcactttggggggccaaggcaggcggctgggaggtggaggttgcagcgagccaagatcacgccactgcactccagcctgggcaccattgagcactgagtgaacaagactccgtctgcaatcccggcacctcgggaggccgaggctggcggatcactcgcggttaggagctggagaccagcccggccaacacagcaaaaccccgtctccaccaaaaaaaaaaaaacgaaaaccagtcaggcgtggcggcgcgctcccgcaatcgcaggcactcggcaggctgaggcaggagaatcaggcagggaggttgcagtgagccgagatggcagcagtaccgtccagctttggctcggcatcagagggagaccgtggaaggagaccgtgggaagggggagaggggagaggggagaggggagaggggagagggagagagggagaggccaggctaatttttttttaaagatctagtttgtgtatttttagtagagacggagttttgccgtgttggccaggctggtctcaaactcctgacctcaagtgatctgccagccttggcctcccaaagtgctgggattacaggtgtgagccaccacgcccggccagaaagcctattttagaagggtaaaatggtgctttcatggggatctagggtattgcttccttgatccagtctttcctggctggaagcctatgtttatgtggcccagtgttaacatgctccgacttaataagggacagtggtcaggggtctgtggatttgagagatttcagaaaattggcttatatattaacgttatcacagagactccaagaaactgaagcaagctgtgagtacctatgttgtgagtatctggacattgagctttatacggagggttgtgagctgagcggaggtgaactagggctggatgactggcagactgaaggagagggggcgcaacctagcatgaaggtgtgtggtagctgcttcactgcagggctgtggggtctagaagaattatagactgaattccacacttccctagttcagagccttaaggtcaggggtggggtgctggtggtaggagaggcagggggaattaggtcaggagtaaggacctgggaaaacttcctatcataaaacactaggacttgaccacagaatgggtatttctctgccttcctaggaaggctgtgcaagcaaagtttgtgtggcagtggtcaacactgtgcaggtcctgccagatgtggcttccaggtggagggggcccaggattgccatcttgaggaagacatttgttttgttgatctgaaggccctnatagcacccaggtagagaatgcttgatttgcantagacagattgtcttccaagagaacttaggtattgtcagctgttcaatgtctgctttgtaaaggcaactttgtctcagacttatggataggggtgagtctgagcaaggacctcagcaggagccttagtcctcttncaggccatttcctaatttccccattctgtaatttagcacctttcttctctgtccagccctccttaggcaggaagcctgagtcttccattttttttcttctaaaaaaggctactgttcattggtgatggacctctgtctgatcccaaagccccaagcccggggctctgctgaaaggagtctttctgctgctttggacttagaaagcagtaggactgggtgactgcgtagaatgatgcagtaggacagtcaagccgaaggatgcttgaacagctagtccagccctctcatgtggaggaaaaagcaaaggccctaagggagacagggacttgcctaggattttaccattccagaaagctggaagccaggactgggctccagcctgctagctgtctactcttgaattttaaaagcttccctcttgaccacattgccattcacaggcagaagaggaaaactgtaaagcccttaagggctcttctataaatggcagctagaacccagtgtaggagaattggtggagaggaatatgtttgattccccccaccttttttttttttttttgagacacagttttgctctgtcacccaggctgtagtgcagtgatgcgatgatgtctctctgcagccttaacctcccaggctcaagcgatcctcccatttcagcctcccaagtaactgagaccacaagcgtgtgccactatgcccagccaattttttaaaattattatttgtaaagatagggtttccttatgttgcccaggctagtcttgaactcctgggctcaagcaattctcccaccccagcctcccagagtgctgggattacaggtgtgagccactgcacttgacctgatcacccattaatttggtagaactggatgttttcagtgggaataccactggaccccagtctggtgggcattagaaactaggcttcccagaggcatttgaaattagactgccatttcttaggcattctaagatccaaccaataatattgaaagaacagcccattttacttgaatttctttgatcccaaagtaaggaatgacttgaaaagatttactctgttcctgtgttttcaggttcagaatttcagttgtctttaaagagacaagaaagtactataaacccctctagtgacctaatccaaaatccgatttacatatatgtattttcttgtacaatgtaggtccatccactcaaattccctcaccttaagagaggaaatagctgtttctgtttgtttgttcggagagtcttttcaatgatttgtttatctcacacacacttattgcatacattgaatgaaatactaaagtggatacacctcgaggagctcaggtctgtgggggagacaggtgtgcaagtaacagtgataaagtgatatcaacgctatagtaaaggcatctttaaactgctgttgatttgcagaagagacaaacagattctatcaggagattgaaaaatattttacagaggaggtgataaatgagttggaccttgaaggcagtaagattttgttagtgggggaaggagaggcattcagataaaggtaacagcatgagccacagagggagggagaggaaaatgcaggcagtgttcaaagaaccaggcagtgcactgtggttgtgcctgtaatygggtggttggtagcaggggaggtgtgggcaagagatgaagccagaggatttcagatttgggtgggagcgtaggccagaagagggaacgttggatgtagtcacactgctgttggtgttacttagaccttcatttttccaccagactgtagtgttcaaaattctttttagtaagagaaccctttttttctgaactttttacaaccatctccaaattataaaacataagacttttttttttagtaaaaatrtatttttttacaagcacagtgkcttgcaccatggaggggagaggaggtgttttgtccttggagctgctggcctgagagaaccttgtcatcgtgggagctgggccattcctacacagtggtctggcaatgacccggtggtggtggaggcctgtgagtgggcactggtaatgggarcagctgtaaaaccctggaggscagccccaggagagtgaccttaccaggaaagttctgggaaacaaaccacagggaggctttacaggaatttttggttgtgcccacaggcaaggcacatgaggaaaagaaatgtaattatagtttgtaagtcgatgaaaagaggcaatgagtgacatgaaatagctgctctaagtttcttcttcctgtcggacaggaagaaatggggttttatgcatttcattcagcagatatttattgagtgccagctgtgagctgggccctgcacaaagtgcagggaatattggtggttagcaaaatagtcaaggttcgtatcctaaggaactcttctgagggaagactgagattaagcagataactgtataaatgcataattacacagcatggtgagtgctctgaaggataagtgtggggagcctcatttagattggaggattgtgaaagtcaagagacaggagagtcaaggtgaggcaaggtgagtaagagctatccaggcaaagactgcttggtaggggagtgtcccagcaacgggaaacaacctggaaaaaatatgacacctcaggggaactaaaagcagttgtatgtggctgatgcacagacagggaagggcaggaagtgtgctgaaagaaggcaggaggagaatcatgctgggccttgtaggtcctggtaagaagttagattttatcttaagtgtagtgggaagtcaatgaagtgtgttaagcaggaaatgacctgatctggtgtaaaaaaaaaaaaaaaaaaaggtgattcagacagctctaatgactttgtgaggggagagtggaagctggggcaattaggaggtttttgcaataattaaggtgagagatgggtagcatcagaggtggagaaaagtggacagataaaagatatattttggaagtagaattgtttgcagttgggaaatgggttggatgtgggcagaaataagaagggagagttgaggatgtctcccaggtttctggcacatgtatgcttgcaggcctctcagtagacagcagagagcttatataaggttgtcaaatccttatccttcagaagggtcaggtaggattggtctaaatccagccttgcagaggcagtggtgggattcagctgtccctgactctgcccagttcaaggagtgtgtacacagtagcattacccaagcagggattccagttctctcagtaatggggcccttcctttgtcccttcccccaggacaaggccctaaggaacctccataactccagcatgccactagggggagcatggcccgcattctgggtctggtttggagggcttcttaagtttggattacttcaggaactgacttgtatcagttctagtactcagtcctgacccctggcccctcatactgcttaaaagaatgcctggcatatggtaggtgctcaacaagtgttaactgatgttactactgtattattaatattatcttattatagaaaggggtgggatcaccccttctttctcaggatggagactgggcaagtggaatgtgcattttgaggatcaggaggagagcagagggatgccttttggacaaggaagaggcggaaatttagtgatttgatgatactgcatttgcccttctgtcttgtctttctttgtctttctttgtagacttgggattcttcagctggggcttgggtggggttggggatttatagtgggtgattaggttcactccctttcaagctctgattgcttcactaaagcagtagtgccccccatttaggatttgtgccattctgtcatttcctgttggattttataacactttcctaccttaacttctggtatatatttaccttttaaactcaagtcaatcagaatcttgttttgagaatgttgtgatatgctggaaattaatgraaaaaacccactagattctgcataggatgttgcattaaagattctatcaggctgggtgtggtagtacacacctataatcccagctactcaggagtctgaggtgggaggattgcttgagctcaggagttcaagaccagcctgggcaacataataagacctcgtgtcaataaataaataaataaataacatcaggaccttttttttagcactgtttttgggagcagcattggaaaatatcctccttaagcctcagtgtcctcatcctggggagggtatcaactgtcccagtgttttttgtttgtttttggtgaggagttgtcaagaggagtaaagttcttagttcagttcctgacttgagagtgctttcacggacagcatctcttccgatgctcagtcccagccctgtcagtaggctctgtaggtggaaagggggaagtcatgggacttgcccaatggcacatggcccgttagtggtggagtcaggcactgccaaggtcttctgacccctggtgctgttgcaaccactgtgcttaatgtactcaagagacttgaaaggcttggggattgtttctagattttatttcctggttccatgacctggggcaagtaattttacttctgttgtagaattaaaaaaaaaaaatctgttaaattagtataataatgccaatcctaactttcagacctgtcatgttgaacagacgagccaagattttgagagtcgtttagaaaagtgcaaggtcacatatagctgtagggtagggctttttctccgagctgtgcatcaggacgttttacatcttagagatgctgtcttaaggtctttaggctgaaaggatggtagtcagcctatctcgccacaacttacaaggattcnccaccttcccttgggagcccagcgttatctcataaccagttatcaaaaagttgacagtttttgaaatcaggtggcaatatactttagttgaaagtgtgctggactagggcgaacttggctgatctcttagttctttgactgcctaactgtataagtgcagatcaaatgtttaatctctctgagtctcagtttttccatctataaaatggtcataaggccagtatgctggctcacgcctgtaatcccagcactttgagaggctgaggcaggaggattgcgtgaagccaggagttcaaaaccagcctgggcaacatagtgagaccctgtctctataaaaataaaaattaaaaaagtagccaggcgtggtggtgcatgcctgtagtcccagctacttcagaggctgaggcaggagggttgtttgagcccaggagtttgatgatrtagtgagctatgattgcaccaatgcattccagcttgggcaatggagcaagatcctgtctctaaaagaaatttaagaagaataataaataaacttgaaaaaatggtcataaaaatatctgtgcagtgtatttcaaaaggttatgaggatcaaacaaaatgatacatgtaaaaagaatgttacaaagcagaaatgtatgctgggtaggggggagaggaagggacaggatggggatggggatgggactaaacttagggggtctgccgtgtcccagggactgtgctcattttctgacaggagcaatattattaccgactgtgacagcagctcccackaagcctgcaccttagctgcagatccttagcagggcagagagacaaggctgtatttgtatcaggtttgtcgtctgggttgtgactctcgacttgcccaggattcttcctggtcctgaccgagttgtctttgctctccatttcaggaagatgagagactgcttaggcgccaccactagtaccatgagtccctgcactggttaaagccatcgccacaacctggacaggcagcaaggtaagcagagaggccagtccaggcgagctcctgggatgtgagtgcatttccgccccaactgctgcccggaaaaatcccaagtgcacaaacaagtcaaggcagcgcatcagggtccctcctacccgagctccaggacccagaggaagctgggtccccttcaagcgcttcagctagctccctcccccctggcagggattcttccaagttataaaaaatgagacactggaggggaagaaaacaagtccactcactgtcttctcccttctcccctctgagctgttcaagcaagttcccaggagcagttcagagcccctgttggactggaagggaggtaggaggagtggaatgcatgcaaaaaccgagctgatcaaaagacagtgctgtttcatggaagcctcccagaactragagagagagagagagagagagagagagagagacagtgagaaagaaagaaaaagagagcgcccttgtgcacgcgctaggccaagagcgcgccgctgtgcgcgcgcccgcctagcgaggacagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcaggtaagggcagctccgggctgggatcatttggcctcctttcctggcccttctctccggctgttttctgggagtcaggcgagtgtctgtagtctctgctcggggtttggggctcaggaatgatgtcatgctccaacagttggattctattagcttaaggaggagggaaacagccaattttcttgactttgcaaatctagctgatctcactcttgctgaatctgaggtgtttagacttcactctaaaaagcatcattttacttttatttagcacaaaggcacaggatatttttacaggaagaatcttttatatggaaaaatctgagttaacatcactcccgtggtgtttgtagttcttacagggaaactccagtgccttttgagccgcttgttcgtcctagtgaacactgtctgttttgtctcttggtgctgctatgtctgacctgtaatggaaaaaaaaaaaaaaaaaaggctaattaagctcagccaggagcctgtggtgagttccaagtccctctagagcatttattaggacagagggactgtcacagggatgcctgagctggggttttgcactctctctcttccaggcagcttggtaagaatcaagctgtcctcccacatcaaaaggtcgatcacagactttcctaagaggtggaggagggggctggcttggggttggggggcctgcaaacaggtttctcatccagatgtcccagagtgagctctcagcagcagctgctaagagctggggaacatgaggcactgtagttgtgccgggtggattcctttggttacattttgaccaaatctcagggcacgcagtgtccacgctgtgcactcctacactgattgtcctaagttttggtaaaacttgttctgacctagaggagtggtacatggtgagctgtgtggccttggaaaggagaccctcccagaaaggcagttttataggtgatagggtagtggggttgtcagtaatattatgaggaggatgaatgcagcaaacacttcctgcaacggagacccatcaggggttgtgcttccacttgagccatgttatgtcttaaattcacttcttggcctcagggaactttgcaaatgcctttggtttctctgtgggatgagggaacagctgctgtcctggttcttcagtttttcttcttgaactttctgaacagaatgtcttttgtattctggcaaacaatgagggggcattctgattaacttcggatcagcttgccaatgcaagcactggccatgtcsccagttccggctccctaaaatgagtacatgtatacatcgtggttgtggcctgagggtccacaagggtgaactccatggccctggacctcagacggtccacttctgaagttattcctcttgctacatacactccagggatcctttgcttagttgaaacctacattttgctggagggatgtggcataacactgagccagtggccccttcagttggcagtgtaaatccagaacctcagccttcttttctacttgtgtgtgtagttggagctcttcaattttaccatccccacatctgtgaagagggctagcagagacccagtttcaggagctgstgctccttctgttggtatagcagaaagaataatggatttgggttgctagacttgagtcgacggctagattctgttcccatagggcggccacgggcaagtatcttaactaataggagcttcagattcttacctgtgagatggaggtaataagaacaacttcacaggactgttgggaggagccagtgggataacttccatgaaagtagtttgaaacaagtcacgtcctatctaacgaaccgtgttgtgaattgaagcttgaggaatgacccaactctctctggaaagtcactttgcctctctgttctggttctctcattttataaagtgccttcttcctttctgcatttataagtaaacatgagaaaaatctgaaaagacttcttcaggatgtttaaggaaacaaatgttgctttccttgggttgggtcgtttcataagagtgatgtttgccataaaactggagcctcatagacgatcctgcagggaggaagctttccttggtcncctgactcatgtgtttatatatagtatagaggagaggtattccaaaagacccgtcgcttttcctgtgtcccacagctgcctgtagagttgtggcaccataaactttagcagctggaaaagaggccaggcctggttccctcatcctgctgggtcctgctgggcacactctgcagtgggcaaaggggtctttctccttcattctgggtttagaaggcagggttctaactgggagaaagtgttattgctccgaaaggcttcttgggggctgggcaggtctttcaggaactcataaggccacagcttatggggaaagaaaaagaaacaaggaagtgggaattccaagggcagagattcttgatatgccatgggactgtgccaaggaatggaagagcaggggaagggagactccaggcaaggagagtcccaggtctgtcctcattgagtcgaaagggcgtatggcatactagagcgcgtcacccacagccccagctttactgtaggatggggaagacctgccagccatatcccggagtggtgtctgggaagaagcccttgagcagacccatagtaggcagattaaaaaaatgaaacaaaacaagcagctccccttctagttgagtcatgtcacaacagcctctaaggcctgaaggagaagctgcccacagcttagattggggctgcagctgttccccgactcccatcagtccggcttcccagagctgagtcacaaattggatctgtctatgttccttaaggattaaaaagtaacattcctgttctcactccctctttcctcctyctaccccgcttcctgtaccttctccccttgggctctctctctctcaaattagatatcagtcamcccgggaagatgaaactttgaaatacactggagaacaggccaaggacacccttggttctgctggttcagcctctttccctggaatgaagggcggggtgtacagattcaggagggcaatccaagtatcatggccccactggtagcctagacctaagagaggctgtgccccactccccaccgcatctgattctaagaactgcattacgggaggtccacctggcacctcagggagatgggaggctctgaggcctgggccttctgaagcacctccctgtggggcagttgggactgaaggattgaagaatacatcttccttcctgtcactcctcttagctgttaactgtcattgccctggaaacgtccccatttccatcgttgggcctaagagagtcggccgaggcagccaagcccggggaacacatagttgaggctggaggaggcctggcagcagcccttccgagccctggcttggccttccttctgtgcctctgcatgggcttgggaggagggtgtgtttagggcaggctgcgaggaggggaaggggaaatctgcaggcagataattgagttctttgagttggagggaccatggaaagtggagaaggggccaggagggcatagagcgaaaaaagaaaaagaaaaaaaaaaaagaccatctggcatagtctgcagagatttgtctttaaagcctatgggaaaacttgcattagtgtgtgccttctcctggggaggcaggggctggggaggctaggcatttgtttcatcctggaggggaggtgctatgtgtgtctgtctcagtaggtgggtcggaggaactactgggtgcatctgtcttagaggaatatgccacgtaatattgtgctgatagaaacacctgagctctctatttctagccataggccccagaaagctctcctgggtgtgtgtgtgtgtgtgtgtgtgtgtgtgtgtgtgtgtgtgtgtgtgtgttttgaagggagaggagggtgttaaatgagtctagattaccttattgaagaatttctccaaagaccccttctcttatttttttggctctgatgtcatgartgtactgttgttggggagggtgttgaaactatcactrtactcttctcatctaaaactgcctgaatgttagatttcactgtccttataaaagagtgaattatatgcagttagcgtatgaagccttcttaaccaaagcagacctattcctacaggcttgtcacgaaaccaccacagtttctcaaagctccagactcttcctctgtgtgacctgtcatcaccaaaggggttgtgtgtgagctggagatggactgttggaaatcacatagtggatggaggattatttggaactgggaaaaaatgagakaaactgagggttacgggagacaagatctgaggcaggaggaagactactggaaggaagcaggagtgaggcactgggcaaggggccctgggcggaggcagttctcaggagcagcaggtggtaatcgagagaagggctgacctcggaggcctacacaatttagcagaaggccagactgcccccagggagctcagggtgacagtgtcgtgcaggccctcagaagcactggagggggtaggggtggctggcattagggttaacacctctgtttgtttgttcttggctcagaggtgtctctggtgcccatctatgcagtattggtctgttcacccatttagtcagtgaatacggagtgtctgggccaagagctggggaggaacgcagaagtatcaagtatgggccttactcccatctatgtcatgttataatagacgttgtgttgtagttatttcttcccctctctcccccactctgtctgtgtgattaagagagaagcagcatagacctgctgcagttctgagttttgatggtagggttaatgaccatctcatgctcttaggctgggaaaaaggaggagggtccaacagactgatttcaagcacgattcgaatgaaggaagagagccaactgaaggactggaagtaggagggtgaggattctaggcctgtgttgaagcttctcttgacagtgtcaaaggatggtgtatgtgggagggagtcataggaaaggggaaatgggaaagttggaaaaaaactatcaagtcagctatttttaaaactctagttttgttcgaggaactgacttttggtgtgcttgtgacttggaacacaggctaccttatggagttctgacaactgagtattgtagatggttttaaaatgaactagcctgtggtgtgtttgttcaactctcagtgactcttaggtactcagtgagtgcgtggtgctgccttagagcaattctgatggaaccatttgcatttaatatgagtatctgacatgcattgcagtgcactgcagtgatgaacagctatagctcaggggtcttagaggcctagctttagagcctgaccttgctgtgtgaccttgggcaggttatttaatctctctgtgcatcagccttctttgaggcatctgtagaatggatgtaatagtacttgacttgatagagttgtggtaaggattaaatgaaatgatacctgtaaataggccagtgcctggtacatagtaaatgtccaatgctttccagtatattattatcaacttacagcagcattttgaagagagtgggctggtgtctctcaaacaggttgatgttactacgctgggaacaaaccagattcttcttttagaagtagctgctggttgggcgcagtggctcacgtctgtaatcccagcgctttgggaggccgaggtgggtggatcacttgaggtcggtgtttgagaccagcctggccaatatggtaaaaccctgtctctactaaaaatacaaaaactggccgggcatagtggtgtgtatcagtaatcccagctactcgggaggctgaggtaggagaacagcttgaacctgggaggcggaggttgcagtgagctgagatcgcaccactgcactccagcctgggcgacagagcaagacttcgtctcaaaaaaaaaaaaaaaaaaaagaagtagctgctattttgcatctcgttcatctttctgtcaagaccccaggtagtctggtctggggtctgtgcagtcctgggtgtgtaataatacaagatttcctaataacacaggatttcctccccacctctcaaagctgcttgtgttcagttcctgccacttgacagacagctccccatgtcttatggctgctgcatcaggcagaatgatcaaagaaagggcacagggrgccatggacaaggtagggagagaaagacaattgctttggaaagtcaccagcagccaaggaggactgccctttcagacctggcctacacgtyaggaaggtacttgagagtgtcctttaagaggaaggagtaggggccaatgagattttgaggacacggcagccgcccacactggagaggccagaagtcctgagtctgaggtagtccttgtcaacccagcttcacaggttcagctctttcctcctgctgtgggatgctcactcctcacagacggggagacccgtccatccagaactgcttctcgcctgcccctttcctgctggccagcctaggtggagcccctgaggtctttctcagtgtggtattggaggcccttcacaagctgctctcagtgctccagaccccggcctctgcctcagccctccttacccctgcttccacaaatactgcccttgtacccttccagatgcagcttagagcatagaataggctttgcagccagctctgagggtccatagtctggtttttcctctatctgtggacctctggtgagttcatctctgtaaacctctgttttcatctgtaagttgggagtgataatattacccacctcaaagggttattgtaaggtttcaatgtgttaatttatgtaaggcactcgacttagttgtagacacaaatatgctctcaataaatgttagctgctgctgttgttaataatccatccttcctgtgaatttctctgcctacatatagcggtagaaagtcccagccaggtagtcagcaggtctggatgttagttctggttctgtctctaatttgctgggtgatcttggggaagtaacttgacttctctagggttcagtctccncttccagaaagtagaaggcatggattcagtgttctcattgacatcctgacttgacattttttttgagacagagtctcgctcggtcgcccaggctggagtgcagtggcatgatcttggctcactgcagcctccacctcccgggttctagcgattctcctgcctcagcctccccagtagctgggattacagatgtgcgccaccacacctggctaatttttgtatttttagtagagacggggtttcaccatgttggccaggctggtggccaactcctgccctcaagtgatctgcttgccttggccttccaaagtgctgggagtacagatgtgagccaccacacctggccctgacttgacttttcaaatgtgtatatcttgtgttttcaactagattccttgaagttgtatgaaatcaagtataatattttatactttttatttccccaaatggctaacatatatagttggtgcttaaaaaatatttgagtaacttttctttaaccccatcaaccagattctaggaagcattttgacttggttctcagaactcggaggctggaagcttgttctccaatgcgnagggcagtacaaggaggcctcagcctttantaagtaagaaggtaggtttctcttggtgccctgggaaaattttggttaacagatgtttggggtacttatttgtttggctctgtagccttagaccaggtctttgaataaatatttccatcactgtttccttttctcagtggcgaaaaatgccagtgttttctgagcaatcccctctcctttagagtttagggtgagccagttagtgcccagacgcaaatctgtgtcttaggggaagagccatccaataggagagtaatgtttagagcctgggctctggggtcagattgggttcaaattctgcctctgccacctaatagctctgtaaccttggacaagttacttgtccgtgccctggttcctcttccgtaaaattgaggcagtggtagcattatctcatggggctgtaacaaagcctaaatgccaaatgtaaagtgcctagaatagtacttcctgcctccttgctgaacaaaatgtttgcagttattgttttgtttattattctcttgtaaaccaagtagtgtttagttccttttttttttttccagacagagtctcactgtcgcccaggctggagtgcagtggcacgatctcggctcactgcaacttccatctcctgggttcaagtgattctcctgcctcagccttccaagtagctgggactacaggtgtgtaccaccacacccagctaatttttgtatttttagtatcgatggggtttcgccatattagccacgctggtcttgaactcctgatctcaggtgatacacctgcctaggcctcccaaagtgctgggattataggtgtgagccactgcacccggcccttttttttttttttttttttttccccaagagagggccttactgtgtcacacaggctagagtgcagtggtgcaatattggctcactgcaacttctgcctccctggctcaagcgatcctcccacctcagcctctggagtaacaaatgtgcaccacacctggctgatttttataattttttttatagagatggggtttcttcatgttgcccaggctggtctcgaactgagctcaagtgatccgcccacctcggctttccaaggtgttgggattacagacgtgagccactgcacccagcctcaggagtgtttgtttctttctttctttctttttttttttttttttgagacaaagtcttgccctgtcacctaggctggagtgcaatggcacgatctcggctcactgcaacctctaccttccggattcaagtaattctcctgtctcagcctaccgagtagctgagattataggtgcatgctgccatgcccagctaattttttgtattttagtagagacggggtttcaccatgttactcaggctggtctcgaactcctgagctcaggcattccatctgcctcggcctcccaaagtgctaggattataggcgtgagccaccacgccaggcagctgtgtttatttctttgtggcttgtctgttgggtttgttctgctgagaaatgcaaggccctatccccttcttctgtgtcttgggcagacggtatcagcagagcagtgataagcgtcccccagtcagcatatagatcggagctcctgtaccttgcttttgtaaagaaattataaaccagaaggggagtctggctgaatcaaaagagcctctaggctgagcgggcccctctctgaggagtaatatgtgttgtatgaacaacagggatagggacatggcagacccagtgtcaaagagcagaatgggaattgggaaggctgatgggagggtgagggagatagarggctctagatagtgaagtggcaaatgtctctgggcatttgtggctaaggcagtaagaggcatcaaggtaagttcctggtacttcatcttcccaagagatagcctgatcccagccccaggtgagacttgccccagcagtctcactcctctttcagaggagtggtggattgggatgaggaggttctaatctgtttctaaagagaatgaatagctccttatctacaagtgtaaattataaagagattttcttttgcaacttcagggaacaggaacttttgctgccaaatttagcaatgtgttttaagtccctcaaatcttctttgagtgctaccaaagctctgagctttgttgttatctcttgttgaaatacagcctggaaaggtcatatcaacagtgccaatttatgggcctgctgagcccagacaggcctagggcagaatagggagttcctaagagtagaggcttcacaaattttctctttgagtgagggtgtttacaatgtaaggttatttttgctttagaagaccaaactctagatgatggtcaaacatcctgttcttcagctttttyacttctgcaggcttccacaggcaggggctcagattcgacagtagctccttgtagaaccaggagaagcttagcctcgatggtgcatagagctcccaaaactgtgccccgtactccttagtggaggtaagtttccttgcagagttatgctggaatctccctcccatttagtttattagcaatttgtgacctaatatgtgttctgatggagtaattaaaagatggtaaaggccggacacaatgcaatggctcacacttataatcctaacactttgggaggccagggcaggaggattgrttgaggccaggagtttgaaaccagcctgggcaacataatgagacccccatctctacaaaataaatgaaattaaccaagcatggtaacacatgcctgtagtcccagctacttgggaggctgaggtggaatgattgcttgagccctggagttcagggttatagtgagctatgattgtgccactgcactctagcctgggtgacagagcaagatcctgtctctaaaataataataataataataayaataataataataataaatacatggtgaagactgaggactgtagacactacacgtggaactttgtactcatttgcaaagaccttaggacaaaaaggtctgacttgtgtgtatatactttgccacttagcaaaaaggaatgccagtagggaaaggaaattaaggaacttgaatgaccccagcaactataaaggagtgtgctctggttttgggcacctgtagtcccatctgcttaggaagctgaggcaggaggactgcttgagcccatgagtttgaggctgtcctgcgcaatgatcacacctgtgaatacacactgcactccagcctgagcaacatagcaagacactgtctcttaaaaaaaaaaaaaaaaaaaaaagagaaaaaggaggatggtacatgagtgtgagaagaaaatagctaggacatgtgagacaagcttggcaatggcagtgaccttggtttgcagtctgtggcttggactctggctggtatgttctgagaaytgaggcttttgaatctagaaaggaaagaaaatactgaagtttcttatgttctctgcctctctccaacctcctgattgacttatccctttgggttgaaacataaatggaacaggtagcactgtcctttccgagtccctgcctctctgcatttgagtcatcactgatgctcagggtttgctcttggcttggctgtgctgggagagccagttgtgaagatattggaggtaagaagggctattggttttgtcaactgaactctaataagtacccagggggaagtggcagggatccaggttaaaaagaaagcaaccagggcagggtgcaatggctcaggcctgtaatcccagcactttaggaggctgaagtgggtggattacttgaggtcaggagttmaagaccagcctggccaacatggtgaaaccttgtctctaaatacaaaattagccrggtgtggtggccggtgcctgtaatcccagctacttgggaggctgagacaggagaattacttgaacctgggaggcggagtttgcagtgagctgagattgtgctgtttcactccagcctgggcaacaagagtgaaactccgtctaaaaaaaaaaaaaaaaagcaaccggaaattgttgttttatttaaatctcattaagtggaaatagaaaagcctttttattttctttcctaccccctccagttgcaggacccacaactgtttggtaaacccaggtgggttttttttccctccatttagatgtaggtgcctattctgcttatgtgcccagatgggttttcaaagcagtgatatccagacttcttttcatctgaaaaacaccgaaggccagatgtctacatggccttgcaggaagaagctgagcttcttctggaaagctgtagaaacaaaaaaaggcggtggagactgcaacacctgtgccatcctcctgggtccctgatagcccttaatgttttgtcattgggggggttgggatggcttttattttttggtgttccccaaaagttaatcctcagtctgttctctttttaatttacaatctttccctgggattccatcttctactgtcaccagttagagaaagcgaaggagtgagggggaatctaactctgcctctcttgcttcggaaactgaatgtatttattcatccaataaatatttatggagcattccttctgttctaggttttgttctgtatgccgaggaggtagagataactaagacattgaagtccttgttgtcatggagcttgacgtgtagtgagtggggaagcatttcagtaaacaagtaaacawatcaatagatgagatcaagatagtgctgtgagctcggaaggatataatggtgatgtaaaagagagagtaacagggacctgagaggttagagaaggcctctgagaatgacgtttgaactgtgagctcaaggatgagaagaagccgttaatgtgcagatttggggaaagttcctttctggaaaagggaacagctgtcaaagctcctgaggtaggaaagagcttgacatgcagaaaggacacctaggaagtcatcattgttagaatgtagggagcaagggggtgtcggggtggaggatggtggcacaacttgggataaggtatggaaatttgagagggagagagaggaacattgaatctgatggagaagaatcaggaaaaagagtagggtgctgggcatggtggctcatgcctgtaacccccacactttgggaggctgaagcgggaggatcgctggaacccaagagtttgaagcttcagtgagctatgatcatggcactccagcctgggcaacagagcaagactctttctcagagaaaagaatagaagagaagagacagagcaagactctgtctcagagaagagaagagaagaggaaagggggaaagggggaagggggaagagggaagtgggaagaagggggaagaaagaagagggaagaaggggaagaaaggggaagaaggaggaagaagggggaagaagggggaaggggataagaatatgaggaaacagaagggatctgaagtgggcatagacatacctgcttagctaaggaagtcgaattaatatagtctgcatacttcttgggatcaagcactatgtatttttaaattttctgcagattttaggttagyggtaagacattagtgtaatgtttactctgttctaagcattgtgttatactaggcatttttatttcattgttttagtaaatccttacaatgatctgtgagttaatttgttgatgttgtaacatctgcagggatgtggagtagctaacttgcttaaaatctaaatctaaggctgtttgattccaagcatgtgttcttgccacacttccactctggttggtatatcaaatgcagctcttctttggttatctagaacatctaatgagttttttcctttgtatcactatgtgttatttatggtcacattttgaatgtttgcagaattgaatgagttttttttagctttctctgaaaggggtacctggttaaatactgagaatgcgagtccatataaacaactggggagggtggggctgtggcaagacttggaagcagttaacctgacttacatctctccctctgggcaggaaaaaaatggcctttctccttaacgctccataagtagttagatgtcttagattgcaattccccctattgtataagaagatggaatttacttttggaaaaagtaagtaatttgtcagtaaactagtgtttgtaaataaaccctgatttcctagcgtacagatctcttctagagtcttcaagtttgttggaaatgtttgagaaaagaaatgtatcaggccacaaatttcacttcttggaaattgaacattgactagtttctatgggttgatacttctttttctttttcgagatggattctctgtcacccaagctggagtgcagtggcatggtcttggctcactgcaaccrttgcctgcctggttaaagccattctcctgcctcagcctcccatgtagctgggattacaggcacacgccaccatgcttggctaatttttgtatttttgtagagagggtttcaccatgttggccaggctggtcttgaactcctgacctcaggtgatctgcccaccttggcctcccaaagtgntgggattacaggcgtgagccactgtgtccggnccatacttctttttttttaaaggtttgatcctgtttggattctatcagtagtgaaggcccgggattctgaaatgaaaatgtatgcagtgtttataaactctcattccttggtgttcatgagatctgtggtcagcccaatcagcctgcttagatggaatagtttgtgaagggcagagcagggtgagactgaatttcagatttagcatagattgctagaaaacagaggartttctttggtaagtcactggattttgctttcctgtctccccttcccagtctgtttcagtaacagacttgcttctgaaggaaagataatgtagttgggaaaggttcctttacagggtgttgttcagatggtcttcatcactgattcacaatgagcagacattgaatggtcatctgccatgagcagggacacacagatgggttggaagatgaggctggaaagactggctgaggtcagatctttaagggattgaaccatccagaaagcggggaatcactttccccaggaagcaggaaggaaacacatttgaatatgatttgtagaaaagaaacctaggagaccatgtagaagatggaaatggagtgggaggaaacttgcctattttattggctgtaactggaggatgatattccagtccctcaaaattcatttagagcagaaagtaagggaagtctcagggtgggcgggatcagaactccagattgcagagctttctagagcccgtagagcagtggttttcagacttgactgtgcaccaaactcacctggagagcttgttaaccaatttagtagaaattttttagtaaaaatttgcatttttaacaagtttggaagtgatgctgctactgttggctgggaaccccactttgagaaccactgcttaagaggcttggcagctgagatgccaataagggtatgagggccagatgttaattggcttgctttcttttactgacccagaatttcatgtctacaaagctttactttagatgttcttaggtggcttactctaaaacatcaacaaagcctggtaaaggtccatgctctcaatgactcttctcaccaaatccgtatcacttctggatgagatttccaggtatgtgctngtctttaaacagatgcttgtctgatttttggaaaatgcccatcctgggcacttgatttcattaggattggtggcatttctgccaggaaaagcttccccccgccagtcagcactactactggctggcagggctgtttcagggacagccagcaggggctgcacagaatgtgttctgttgattagccaaatttacacaggacntgcctgggagattatctctttaggccaggagttgaatttcaagggcaaagtccacagttggcagccgaaaggctgagaacacctggaagaggggaaggatttcacttgactttcacttccccaggcctcagtgcctcttcccacagaggctgggttttctccttgttgctgcctgagcaggtgaccttgggatggttcccacagagcagtgtggctccaggcactgccctttgctgtctacttcagcacctgtggcttcaggtgagacacttgcattagtcaatgtcagctgccctgtcctccttggcatcatcatttcttgaattcttttctgggcttgcttctttctttgcggggaaggccttcattttccttcatagtccatgactcgcaggttttccccgagctctccttttcttaccttccttcattagttcagtacaactgtagaattctgtttcaatgtaggaagggagacggctacccatacatagcctgagacaacccacctggggctcctgtagcctcagtgctgtccccggggtggaaggaccacgtgggtgggtccacacagctgtcgtctattttgcggatgctcactgggaacttggattcagtcctaggtgcctgggagttgagaggtgagaatacagagtgctcagggtggcagagtggggactgggactcaggtcttctcacctctgcccatttagggccttgctgtgtatgtaacactgaaactgtgtttcacattagcaggcaggcatcaaaccgtctatctggctaacttytgtttaagacattttttaaaataacaaaagcaacaccaggtgttctaaaaacttttgcaaaatggggaatacgtaaggcagaatatgagcatcttctataaacccatgccccagaaaaatagttattgttaacagttgggtagcactgggttttttatttatttatattttttatttatatatttaaactaacatccttgagccataaagattctttaaatgatgcatttttaygtacatttagttttacrcgaaaagtttatgctcttaatttaaaaaaatggaaagtaagaagtgttggtgagaatgtagagaagttagaatcctcatacattgttagtgggagtgttagcggtgcagctgctgtgggaaagtttgattattccccaaaaagccccaaattgccatatgacccagcaattccactcctaggtatatgcccaaaataattgaaaacaaggactcagattcttgcatgccagtgttcattgcagcattattcacagcagcgagaaggtggaaacaacccaaatgttcactgactgacgaataaacaaaatgtacaaacaatgtgcaaagaaaatgtatraacacagtaatacagactgtggactattcttcagctgtgaaaggaaggaagttctgatgcatactacaatgtagataaaccttgaaaatgctgccctaactgaaataagccgtatataaaagcacaaatattttgtgattctgcttatataaaatatctagaaaaggcaaattcatagagacaggaaaatagattagaggtaaaccaggagcttggggagaggggagaatggggagttattgcttaatcattgcggagttactgtttggagaagtttgggaaatagtggtaatggttgcacaacattgtgaacatagttaatgccactgaattgtacacttttaaatggggaattttatatactttactgcaattaaaaaatggaaagaaaagattatactgtactgaaaaacatatcacttgtaatttacctaggatatttttctacctcagtatgtgcttttaaggagcagcattgcatttcttcagagggatgtatcataatttatttaaccaagccccttttgacggacaattgaattgtttctcagttgttcctgttatatgcagtactgtaatgaacagcagtatccagctgtctttgcccatgtgtcctagtacttgtattttatttccttaggcagaattcctagaaggaaagatttgctgatcaaagggtgtgctcattataaatgttaaattgccaaactgccttccaaagaggttgcatcagtgtacttctcatcagcagggtatggaggtgcctctttccactgcgccctggcccaacacaggtgttatacatttttttactcttcgccaatctgataggtgaaaaaggatttcttattgttactttatttaggatgtcttcagttattaatgaaattagcatctttttatctttctggtagttgattttattcctttgtaaattttctgctcaaatacattgttaatttttctctttggtcactattttatcttgtagacttgtgagagcttttacatacatacggcattaggactctttgccatatgtgttgctgataatttttcccccaataaaaattttttttgactttgtttatgctaattatttgcctttcacatgttttacatttttatttaggcaaatattttccttcaaggtgcttcycctcatctcgcttctcggctgtggagttgaattttctgtcatacttggaaaaatcttcttcacttgtcagaatcacaaaaaaaaatttattcatgttttcttttagtgttttcttggttccagtttttacatttaaactgtaattaattttgctgtaaggagagaagtagtaactaaattttctttatttgtgtgtgtgtgtgtgagatagcgtctcactctgttgcccaggctggagtgcaatggtacgatctcagcttactgcaacctctgcctcccggattcaagcaattctcctgcctcagcctcccaagtagctgggattacaggcacccaccatcatgcccagctaatttttgtatttttgtagagacggggtttcaccatgtttgccaggctggtcttgaactcctgacctcaggtgatycacgcgccttggcctcccaaagtgctgggattacaggcatgagccaccatgcccagcaggaattacattttgttgataagaaaacctaagataacctttttttctattaaattttttctttactaaaaatttgtgaacttcttttcacttaaggatgtaccataacaattaaaaacattttctgtgacattaaagaaatattcctttttttttttgagatagggtcttgctctgtagcccaggctggagtgcagtggcatgatctcagctcatgcaacctcctcctcccaggttcaaatgattctcatgcctcagcctcccaagtaggtgggactacaggcacatgccaccatacccggctaattttttgtatttttagtagagatggggtttcactagttgcccaggctggtcttgaactcctgaccttgagcgatccgcctgcctcggcctcccaaattgctgggattacaaggtgtgagccactgtgcctggcttaaaagaatatttctgattaagtttacaaaaaaaaagcctttagtgagagaggcagattaaaaatttcacccaagtcttctgattcctaatcctgttttttgtttgttttctcttatcstatatacgatacaaccagatttcttttgttaatgtttggggatagttgcatgaatcccctttgcaaaactttccagtgcttcctatgtgcaattgtattgacatgctggacctagatcttgtgacgtagaagcttctcccttaaaaattttacctgctttgatgagctcaccctggctgaggtggcagcaggtgggcagctggtactgaggagaggcagtaggccaaagtctaagcaggtattaagacccagaaagggtgtggcttttggagaagagcagcttgaaaggtgtgaggaaatggagctgctttgggaacagattcaggaaggtttttgaagtgagagaaggaaaagaaataatgtttatttagtacctacttatgtcccagacactaagctagtcaggtcccacctaactgtattttaaaaggcagcttttagtgctggatcaacctggggttgtttttccaagggttgtgaacttgcgaactcagaaaagaaaagttagagtttaggagaccgagaaaagcaggatttagcgagcatcatttctgctccatcagccaggggcttaaacagaatttttctttgagactgctctctttctttgctctgttgcacgggctggagtgyagtgatgctatcacacctcactgcagcctctacctcctggactcaagtgatcctcccactgcagcctctggagaagctgagatcatgggcacgaaccaccatgcttggctaatttttaaaaattttgtagagatggggccttgccgtgttgccgaggttggtctcgaactcttgggctcaagtgatcctcttacctcagcctcccaaagtgctgggattacaggtgtgagccactgtgcctggcccagaaatgtttttagtagaaataggctaagtaaggaagcaggagaaaccacttccaatcagcatacattcgttaggcccctgcaggaccagcgcacagacatatagcacttaccttcttggaacttaatagtttaatggacaagacatatgaaaagccagtatactgcattgcagtttatgccaccctagatgtttcactgggaggaaaggattaattgagttactggtgggaggagagtggggaaaaggagggcatggtttcacagaggaaatggtgctggtacagattttgaaggaggcatagttcctttataaggagacagggcagggaggggcattccaggtagaaggatttgcatgcacaaagacaggagtgaagctgtaagtgtagagtgtgcagggaagtcccagttggtygtgtttgttgtccttggcagggtagattgaggagtgtcaagataagactccagagacaggtctcagggctggctcttgaaaggctggatttaccagtgtcctgcctaccagaccaccccaaaacatagtggcttaaaaccacaatacttgcctggttctggggttgttgctcggggtcttcttggatagttttagttagatggtgggggcctcagcctcctgagtagctgggactacaggcatgtgccaccacactctgctaaatctgctatttttttatttttttattttttgtagagatggggctcttgttgtgttgcccaggctgggagttcagttttagacacttcttatttcttaacatgaattcacttttcacattatggatttgtctgattgtttctttggggtattgttcaggttcttcctctctgccctgtgtattctataaactgtaacttagatctagagacctgattagatttaggttaagcattttagggagaaaacaaccctttatgaatgatgcagcagatcagaggcacatgatgtttggctggcccattattattgatgctaagtttgattactggttaaggtaggatcagctaaatttctccatcgtgaaattatagttttcattttgtgactagcaggtaatctgtgtgtgacctttggcattgttccccattaatcttgcacgtaagttgttttattgttaaactttttgttatggaaaataccaagcataaccaaagtagagagaatagatgactactgctgtgtccaccatccagcttcaaccattatctgtaactattaactaataactatgactattaacacatgaactagcttgttttatttctattcttgtccagtactcttccttttttaccactgaattttgtgaagcaaactccaggcatcataccatttcctccataaatgcttcagaatgtatctccaaaaggcctttcagaagtgtattggatgtgtggtatctgactagcaatttttaggtgtgcttacaaaggaatggagaataccatagttagagctttttaggtaggtacagtggaaagagaaaggagctgtggatttgagatggatccatttgtgatgaatcatggatttcagcctggattggcagaaggaaaggccaagaggtggctgatatactctaggaaaaaggcctaagggaacagaggcctggccaagttcagagagcagctgtcaggtagtgaatggtcaaaagatagacaggaagggaaattgtggtcagacagtagagggcaaggttttgagatgggtacgccaggttcagggtttgtgcaaaagtgtgggtgactcaagtggaagtggaattgatgtcagggaatcagttgtgagctaagagttttgagtggatccatccacatagctattgaagttgccagggtggagagagcgccctcagggagagcctggtgtgtgtgagggcaggagatggtgcacaattctgtgaagagtttgaagatgtggggtagttgctttactgcagagctggggcactgtggaatcggttgaaagcttagccagtggtggaagaagacaaggtgagaaaagtgcaagacaaccattctaaacagttttaaatgtattgtgctctgttggacattgctgcccactggttggagtggaggaaattaatgaggtagggggttaatactgaagaggaaaagaattgtgatacataggtggggttgaagcaggagcccttgagaggaaaygcagtgagcccctcttcctgttttatccctgagggatccctttgcatagtaaccccaatgcttttctggttggggtttgttttggtaggtagtctttgtgaagatctgtgttgcattctttacacttcacttacagggtttggatgggttgagtagagaaggggtggccgtccctgagtgaagcagtggtccagagaacccaccccagcattttcttgctgctggcgaccacttccctcttaaacatctagaaagcccttgatgcccaggactaaaggtagagygaccccttttctgagcacatcatattccaaactttgtctctaaactaccagggaaggcatgcatgtctcctaggtaatagccatcaaacttagaggaaagaagcacattgtaggtgtcagagttttggagagctttgatttcaaaaagtcgtggatttgtagatgagctagaaattaaaacttgaaataattcttcttctcaaagatagtgtctcttgaaataattctttgagaatgatcatcactgaaggagatgagattaaaagggagttgagagaaaagaaggcctacctggccaaatgccagcatctcctggattctgaagcaaacaggagtctgtgcccatggacgttagacgtgggatgatttctcactatcttgccagacacctgtgtttaagggagtgactgacccacacacttgcttacgtgtttttatgagttttagtgttgagagaaaagttctcctcttaggctatgtttagagttcacttcctgctgagtttactggtgtgtgtgcagcagaaatgccagttctggcctgkcatgatggcatgtgcctgtagtcccagctactcagcaggctgaggcgggaggatcgcttggcccaggagttcaagtccagcctaggctgggaaacgtgtccctgtctcttaaaaaaaaaatgaaaaagaaaactgtcagctctgctttatgcatcttctccttgaggatgatgatacttacttacatataaatcttgccttatagcatagagcatattttcatatacattgtttcttcagatttatatcctgtcctctcagaggagaaaattgatgtgtctggctgcagttgacataaaaacaccctactgtactttccatggcatagtggaaggaatgcgaattttgaaatcagtcctggtttgaattgtggctcctccttktactagctgtatgacttgggccttggttttcctgtttggtaaaayagaattggtaacatttacctcataggattgtgttacagtattaaatgaattaacataattaacacctgggaacaatgcttggcacacagtagataactggtaaagagaggccatagtcatgttaataacatagaaacagaaataacatcagcaccgaagaaaaggagagcatgcagctgttctaatcttgtttttttttgttgtttgtttgtttgttttctttgagacattgtcttggtctgtcgcccaggctggagtgcagtggcgcagtcaagatcactgcagccttgaagcctcgacctcctgggctcaagtgatccttccgcctcagcctcctgagtagctaggactccagaggtgcaccaccatgcccagctaatttttaaactttttgtagagatgggttcttgccatgttgcccagcctgatgtcaaagtcctggtttcaagagacctcccgccttggcctcccaaagtgctgggattacaggcatgagccaccatgcctggccttcctaatcctgttcattaacgtgattgctgtgaatggccttctccttggcagtcaacataccactttctcaaaggacaaagttatttaaatgagtttcatgttttaatgaaatttatatggatatgtaaggcaatattgaatgatataatagtaatttttactttttttaaaccaagaagtatgttttatttatttatttttttcttgtttttaccactacagcgacagtttccttgctatttttataaccagtgcttatgcagtcttggttttctatagctctcacagagactgcagacaaaatgcagatgttttacatgaaattgcaacttagtgaaaaccactctgtgaggagctgagctaatgacatctgtgtagctttcaggtgatctgctagaaaatggagcctaaaatatgcaggggcatggatttatatcataccccttagacagtcttccttaaatatcacttctttcagatggaattttgtgaagagttggacagtaattcaagaccccgagttctntaatagcttctatattctgtatttccaactaaaggcagacccatagactttggaaaacaggtaaaaggattgacttcctaccagctagaaattggagccaagttagagccatgtaacttgtattcttgcttctattagaacattattttgtttaatccttatactagcctgggagggaagggggctgacctaacagttaattctttcttaagtatcaggtattggcctttccttccatgtacaaatgggaggctggctcagtgctgagggaccaggtgaaggagtgcattcctcccttctcttctctgtcatctcttgggtcacacatgctaggcaggagttgcccttygccttatctgtgcgactgckcatgatctggaaatgactgccatcactcctagataacaccagccctgggcttttgcggaatgaagcccacattacaaatcatgggattatagtgaccagggagaggtcctacttgggagggagtgattcttcctgaaggtgaaaaacagcagggcagggaggcgactaccttcatgaagtgctccttggtctgtatcctccttttcggttagaggcaggaagagtgaggggaatttcagccacagaagagtttgcgtgtgtgtcattttatcctctggtgacttttcctcttcgcagcagtgatcccagaaaacaggaaaaactgctatgatcacaatcagtttttaatgtaaagaaaagctgatgatggtttttcattgacacggcaaattcaggatttggggcctggggatgaagctgacggtctgtgaaagtgcaggcagccagctccttggatgaggtccaagtccaaaagcctaggggtaaaagtaaaaggatggcttaatttcaatggacacccgtggcatcttagatgttgtaccttcctgtggcttcttagcaactactctaccatgtggcggctgtgttagagggggtactacatccagaaagaagacacgtgccagtagaacttccatgctgcatcataggtggccacagagccattacttccctgtttagtttcaagttgtagatgtttcgtatttgcctaaacacaagatcggcttatgattacccgctggcttaccagcccactttttttctcactctgtttcttttctttttttttttttgagaaggagtcttactttgtcacccaggctgaagtgcagtggcacaatctcggctcactgcagcctccacctcccaggttcaagccattctcctgcctcagtctcccaagtagctgggattacaggcgtgcgccaccacgcccagctaatttttgtatttttagtagaaacagggtttcaccatgttggccaggctggtctcgaactcctgacctcaggtgacccacccgyctcggcctccgtaagtgctgggattacaggcatgagccactgcacctacccatctgtttcttcagcttctcattatctcaccaattctagagaaacagagttgctggttgtgtaggctaaactaaggccactgtgatgtcattgcttttgtctcctttgacaccctttttttttttttttgwtactgggtcttgttctattgccaaggctggagtacagtggcacagtcaccactcactgcagcctcgacctcttgggctcaagtgatcctcctacctcagactcccaaatagcagggaccacaggcatgcacctccctgtccatgcctggctaatgtttttttttttttttttcggtagagatggggtctccctgtgttgtccaggctattggttaccttctttatcatagttcaatcctgagggtgtttccttggccttctgaatgtgtatgagggatgggatctgaaaagtctcctcctctggggctgatcttatgacagactttatgaagttctacccaagaatctttccttcgctcacacacttcgctcaccaaaggagctggtcctgtggcaggttcagaatctgtgaagtgaaaaacgtattaaaattttgtatggaatttgagaactgtgtagttctgtctgtactctctgctcttcagtcacaaacagctctcccagctgtcctcctcactcttgccttctttgttcttgttgctgaaaatgcccaacctggatgaaaacctctaagccttgctcttcctcctggctcttcgtttcggtagagcttttgttatacttctgtctatgatatctccctctttttctgcttaccttttccgttatttcaagtaaaactcatctgctattaccagattgtccttattytctttttgcgtgaaattaactagctttattgatttttctaataaaagaaatacatgctcattgaggaatatttggacaataacaaaaaatattaggaagaaagtaaaagtcacataatcccctatagcataattattgttaatttgtggtgtatcttgtcctttgggatcttcttcatatgtgttaacatatattgctttttcccccaaagtgccatcatttttcacttatattttgtaacctacttttctgactaatattacttggatatattccacagacagtacatacagagctactctataatgtttaatgctgcatagaattacattgtatggatgaattgttatttagttaacctgacgatggacttttgggttgtttctgttattaatagctatgtgggccaaagcaggaggattgcttgaggctaagagtttgagaccagcctgggcaacgtagtgagatgctatttctagaaaaaagtaaaaaattagctggtgtggtgctacatgcctgtagtcccagcttttcaagaggctaaggtgggaggatcacttgaacccaggagttggaggctatgttgagctgtgattgtgccactgcactccaatctgggcaatagagcgagaccccatctctttgggaaaaaaaaaaaaaaaaaaaaggtaagtggtggcaaatatctacatatctgtatagctgtgcctacttgtataacttcaggatagttattgctagaagtttctaaaaatggaattactggttcgaaagctatgtaatatacttaaattatttaacaatatcttttttttttttttttttttgagacagagtctcacactgttgcccaggctggagtgcagtggcgtgatctcggctcactgcaagctctgcttcctgggttcatgccattctcctgcctcagcctcccgagtagctgggactacaggcacccacccccacgcccgcctaatttttttgtatttttagtagacatggggtttcaccgtgttagccaggatgatcttgatctcctgacctcgtgatctgcctgccttggcctcccaaagtgctgggattacaggcgtgagccactgcgcccggccaacaatatcttttaaaacttggaaaagtatatggaaaagtaaaaggttaatataataaaaatctatgtacccatcatccaaatttcataaatgtaacactgtaccatattggcttcagatctgttaacataaattttttttaagtttgacaaatatgtactcatgcttggaggctcaggaaaaaaaattggacaaatatgactaaagctttctgcagtcctttcctcctcctgatactgataaaagcctcattactgtgcatatcttatccttttacatacatgtgtccataaataatgtatagtattgtgttttaaaatgttatacacatgatactattcttgcaggcaaaccttttgcaggttgattttttttcattcaaagtcatttctaaaaagttttcatgtgtaaaatcatttggtttaattggtgtataatgcaccattatatggcagtgagaaatggttaaagtctaatttttgtgtattacagacactattgtaatgactgtgcaagagtttgtgtacgccagctacctaggaatggaagtgatgtggtggggagtatgattctttagctttactaggtaattccagattgttctctatagtagttgttatgtgtttaccaccaatgtatataagtgttcatttccccttatttttgctaacacttggagatcccatgcttctcagtattttccagtctaagtatgatataatatctcatcactttaatttgcattttcccaatttatcaaagagattgagcaatattttattttctttgaattctctgttcatatcttttacttatttttcagttgggttttcgtctttttcctttagaagttcttaatatgttctgatttttaatcacttgtcagttatgtgctctgtaattattttcttcctgtctgtggcttatcttttaactttgtataggttatccttgtgaggttatgtgtgtgtgtgtgtgtgtgtgtgtgtattcctaaattgttttccagaaaaattatactggtttacagaacatccaacagtatatgagagtgcccagcttgccacaccctgcctgactctgggaatagttttatcatcttgcccagtgtaatagacaaaaagtggtattgccccttctttggtggcttttcctagaacattcctacctctttgttatagccaaaagctggcttttccctgaagatcttactttccttgtgaccctctccaatgaagccacctcacctcctcccaactctcgctctgaactccccacgttgcttccaagcccgggctggcaacctttcccatgagaagttagtccctcctctgctcactcttggtgcccttacctgcctattgacttcaggctaactgttaacaaccttcttcatatgtcctctttttggcataattaggatttgaggattcatactgagaatccatcaatgctccggcctcacagtccctccatccttccaactctaaggacttcgtcttcattcctcttcgggtacctttggctttatcacttggagcagtttcacttttaggatgctgaactcggagattcccttcccttccctggtctcctgtctgtttccacctcccactccttcgctgtcccctcccaagagctggctctccagctcttctctgcctgtgtagcctcttagccaccctggccactgcctactgatttttctgttcagcctgagcttcaaaggcagaaattctcatcctgcacttgctgcttacctcagttctctctctcccttgtccctcctgtgatcattagccctcgtggaccacttgaacagatttttctgccgtagcccctagacctctgagtattgcttcatctttcagaagcataatctctgacccatcattcttttctcagaaaacttctgtgattccccagagaaaaactaagatccctgatttggctctcagaggcctctaagagccgacatgtctctgtctttccaactctctttctccctggtctactttcaattaaactcccatcagactgacaaacactttgttgtccttcatacgtcttctgctttcctgcttccaagcccttgtgcatgtagttctatctgtgtaggaatacccctgtattcttttgccatttgatcttccaggcctagcacaagggtcaccctctctgtaaagtgttcttgatcctttatttggaagtaatctccttctacctaagcttcaacattgtatctctctaatggcatctctctagtggcacttaatttcatctttctaatggcacttaaaatagtcttcctggtatttatgagatttatatgtctattgtattcaccctacagagtggaagctccttgaggatggacccatacctgatgcatttggtgtccaaacagcactaaacatattggcttatgcatggttggtgtttggtgtatattagctgaatggatgcatgactgtaagtatgaatggaaggaggaaagatggttgtcctggcttccaggaaccatagttacaatwtcatactgccccccttctcctgctctagcgagaaaagaatcagactcacagcttgacccaggccaacacaggaatagttcaagctcctggcccacactgcacctgggggagcctgaagcttgtcctaccgtgggagcaggagccttgagtaccaggaatttcaatgggatgtttttgagtttaggaagttaggctggctgcattccatgacatgcaagggagaggattttggagtagcacagaaaatggaaaccttggccgggcgtggtggctcacgcctgtaatccgagcacttcgggaggctgaggcggggcggatcacctgaggtcaggagttcgagaccagcctgaccaacatggagaaaccctgtctctactgaaaatacaaaatattagccggtgtggtggtgcatgcttataatcccagctactcaggaggctgaggcaagaaaatcacttgaacccgggaggtaagaggttgtgktgagccgagattccaccattgtactgcagcctgggcaacaagaatgaaacttcgtctcaaaaaaaaaaaaaaagaaagaaagaaagaaagaaaagaaagaaaaaggaaaccccgagcatgcttttggcagaggtaggtgcagagaggctggagagcatggtaacccagaggggagggttctgtttttaccaagtcacaccactttccttcctccatacctgctagggctgagcctcagttgaatgtgagaaaaacrctatgggtgtgatatttgccactctctctgccttgggaccttgagtcatagtctcattcttcatctcaaacagtcttctgtctcattctgtccagctactgtttgtcctttacagtctggctcacatttcctctcccacagaagccccgtccagagctgctctgtcccctccaccactccattgtcctgtctttctagtttgtgtcccacacttgcatcgtttgctgttgtgtctcagtgccctacattcgtctgtgagctccccacatgtaagaatcacatctcatgttttgttctctcagctaaaacaaagtggtgatcaataattactgtcaatgttattagggagcctgctattggaacttggaagattancagtagcagaaaaactgaagtgggaatggaaagacgtgaaagtagaacttagcctgggctagttctccagagtcttgagtctggggaggaactgccctttcatctttaccatgggtttcttgaattctggcttctgaagctctgcctttcgacagtaatcagcatttaggcaggtgacagaatcaggtgttcagggtgtgccctccagggaagaagagagagaggtgatggccggcaccccatgcagcagtgactaatgtgggccaaactggcaccatgcctcccagcccccgggtacgtgggagctgtaggcacacatggtagattggagctggagggatcatttaccagcmcttccctgagctggaagcaggcggggagcagcaagccaattggcagacttgccttttctgccttaaagtactttgtttctgttgctaacaacagacatgggtagtataaataaaacacagacacacaggcacatagacacatgtggagactgaatatttgagctgtcaggggcagggggagggtggatgtggacggggactgaaatgtgtggctaagcctctcaagatagtgtgcactaggtcttctcttcagccttggagatgggtgtagtgtaaggggtggctgtgtggaaggccccctgaaagcagtcaagtaggaagtgatactgtctggatgccacaggcttcaaagactaggtgctcgttatggctggatgcagtcctcattaggcagactctttcgagctagttgctggtgatccaagggccaatggtaacttctttccttctgttctgccctttcaaggcttgactcattgatccccgttagtgctcacatgtggtataatggtcagcagctgctgtggcctttctggctgacctgagctgtacaagccagcatgcctaaatatgtgactgttgttttgggtaagctcctgaaggatgtgagcttccttagtagagactgagacccattcagcctctctggaaaagatggtcttagtaggaggctgaatagttcatgctataaaaagcaacagctaagtcacatgtgagataagcttattcagagacttgaggttcaggtagattacagggaggatggatgatgaggaagactgtgagtctccactgctggaaatataagtagggatgggttaggtgttctctcttttttttccctgggttgaacattatattccctggtatctaagattacatcaagagagcctcttctggttctgggaaaaagaataactgtattgataggaattttagagcactcccaatgtgtgtagctttgagcacttgattcacagatatctctgacacttgggatgatcatctgatggtgtgggcatttggagtagctcttagctggtctctcttttccatcttactgctttcttggaccatatgtgacaggcctaaggaatgtccaacaggaggtacctttggtccatatgaataccaagtcagtaatagttccaatcttctagaagcagtgagacgccactccagtctgagggtgagacatgaaaaatatgtgggccttttccccagtcattgatatagcaacatttgtctcccctgggcagggggaaatgaattaggattaccctctgggttgagcttacaagtctgtcttaggatctcttttttaccsaggtagccctcttggctatccaaggtggggtgcctgggtgggggtggcacactggaagctcatagcagctgcttctctccaggcactgtaactcactagcagcttaggactagatgtgaggcatgtatcacgtggcatttgttactacaggagttaaaggaccaaagtaatcttaaatgggttacctattcttataatttagaaggtatgcaagattatacctataataatagcaagcccattcactctctcataagctttcttaaataagagagggaagggtggagttactcctatggtcagaattgcagattaccctttttccctaaagaggcctaagggttggctcccatgtgacccccatcatctctgtagtcaagtagcatcaggcctaggaacccctaaggagatcattctctctctgttccctggcttagggcagggatgtgaggcttttgcctggcactaaggagaggtagttgaccatggctattattgaatgaggttggacccagcctagctgataaaattctaaagcaagatggggcagtgctacccaaggtggtcacagagaatgaaggttcttataatagaatatattctaagccactaggccgtggtggcttctttgaaaggttgaagtcttgaaaggtaagaagaccccatctagctgggtttcatgtgctgccctcaccttacccctacaagtggcacagcaagctgcctgcgatgtctggtggttgactctgctgcctgcatggttcaggtgagcagagcagttcatgttgaagcccctcccaccggtcaggagcctgtaggactgtgttgttttccttcctgtgtcctcagtgactgggctagtgtcttgcacaaggcaggtgcttggtcattgtttgtggattgaatggcttctcagcctgagcttcaggggaccttggcctgggccttggagcatactaggagttggataagcagagaggaagaaggagagcactccaggctgccagtgatttgagcccagaaacatggggcagaaatggacacgtggacatgtttggagcagaaggtgtcctgcctggagagaggtaggtgtgtgtgtgtgtgtgtgtgtgtgtgcgcgcgcgcgcgtgcgcgcacgtgcgtgtctgtgtgcatgtgcaagtctgtgtatctctgtgtgggcaggtctggggagggtggtagggccagggctggctgaagagggaaggaagaattggaaagtgagattggttggaaccaattaagggaacctgagtctggtgtgattggcggttaaggagcccagaagaatgacatgatgatactgacattccaggatgcttagtctgtcacttatgagcagagaggactggaggtagaagaataaaggggagcttgtcatacaataatactgtttaacatttatttagtgcctcctatgggctggcactggataaagtgctctctgtataaccagagaccattgcagtaaactaggtatgaggtgataaagtggagaaaaatttcaaagaagatgacattgtttcttcatatttggctatatttggctcttatttggttaaagaagaaatggctccaaggacgtcttcctcctgggtcctgcttccggcagcgtgtccttgagcatggggctgttaatctggcctggttggagctgctgagattttgcatgctccctgccaggaaccagtgtccttgggtctcagctggggtgtgtccccaccccagccatctggaaggtcagaggaattagccactagaatgtgcccattagtggctttgaggggttacaacctgtcagtggaatctgaagcccgggaactgcctctctcccagggcttttyggagttggaacagcctgactgttctagcactgactgctcccttatttggacagtaaattttcagggtgagattggacttctcttttgtcttgggagagttttttgtttttttaagtatttgacattcttgtgagtgattttcaaggagataacacgacatcagagctatacctttcttcacctgattctttccttggtctctagtccatccacttataagacccagatgggggccaggcacagtggcccacgtctgtaatctcagccctttgggaggtcaaggcgggcgggtcacttgaggtcaggagttcgagaccaccctggccaacatggtgaaaccccgtctctattgaaaatacaaaaattagccaggtgtgttggtgggcccctgtaatcccggctaytcaggaggctgaggtgggagaatctcatgaacctgggaggtggaagttgcagtgagccaagatcacgccattgcactgcagcctaggcaacagagagagactctgtctcaaaaaaaagtgaaaataataattaaaaaaaaaaaacgaaaaaaataagaagacctagatagggttcctagactgcccactcatctcagtctccccaggggagaagcaagtaacatcatcctatagacaagaggcaaggtgtctgaggccccggggttgggcttcagggcctgggggcaacttcctgcccagccttgagacatatgtcttggttttggggaacttgctgtgccccttgacttgtggatttgtagtttatcagcccagcttcatgtggggccaggatgggagcagggcacagccaggagttggggtggtggtgatgagatggtggatggtagtggtgctactgaaggggaagaatcttctgtggcgattttgagagcacacttcctctctgtcagaagcgcaactctgtcagcttctggctttccttctgatggatccctgtaacccttaggaaagtcattcagctaatggcagtgacactagattctaatggaggaagggaaagcaggaaggagaacatgtttctgtcaacaaaggtgtgctttcactagtcagaacttgctataaggcagccttcagcctttcaggtgattactgtgctttgggattaaagtgtcctgccgtttctggaagagactgctagtcataaagacaggtagggctgaagggtggaggtagggtctccagctgcagttgtcaagaacccaacgtgaaggctgactgagcagagaaactgctgctgcccagaaagaaagcacttttagcagtggtaagtcctttgcatgcactatcttactcaatctgtacaacagcacttcgtggttggaactgttctctccattttacagatgagaaaactgaagcttacagagggtaggcaacacatccaaagcttcatagctggtagaggcagagtttcatacccaaagatcacccttttcccattgtttcttacagaggaaactgtgataagccattattttttataaatgttacattttagaatagtttcagatttacagaacagttgcaaagatagtacagagagacagagagttcccatagaccctgcaagccattaattttttttttcctccttttctggtccattttatgagaattcattgggggtggggaacagatttggaatgaggacattttttccagagattccaacttggtaatttttttcagtaggattttttgagcgtccatcagactacattatttcttccccagttctgctctgcctcagctctgctggactgggctgggcctggctttgacatctagtttcagagtcaaatgccccactttctgactctgtctcaatagggtcagatggtaattgggtttcygagagttaggaaggcaggtaggtgtggggaggatctttagcagctgggcttctggatactcttctgtctctgatggggctatgacaggggagtgttaatattttcagctcatgtttgatggcatggagccagagccctcccgagggtcagaggcagcgtctctggggtgaggcctgtttgcttggatgccctcgagtctgtccttgtatggtgccagagtggctcatggtggtcgctgctgtgggccctggccgtggtctgcaggcaggcaggctggctggctgtaggcaggagaatatccctaggtagctggtgtgctttgctttgggtcccaggcacattctccatttaagggaaaggggtctgcagtcttcttggctctgggtgtgaatgggctggcctgaagtctgctcatggcctttgctggatgtgctttttcaatgagatcattccagaattacattcctatgaaattatatttcactcaagatgtaaagctggatttgtgtaaaagcactggcactaaaactcagggctcagagcggggcagaaatgagaagagggataaacagctcttctttaggaggaggggaaggaaagacagaaagagagagaaaacagttgttaaaggattttgcattgaaaattggtgcgctgtaagcatacccaaggagttgggattgccactcacccctggaaaggcaggcttgatgtttgttgtcccagctgcctgccacccccaggcagtttggagggagatgcccttgaggcttcagtgtgtaaggttgctggaacgctggagccgcccaggtgtcccctggtcatggcactctaggcctatccctgcctttctagcctcattttgcaccatcccatatctaatttcttyccctgtctctgtttccttctctctcacacacacccacactctcacactcactctactattagtatgatatattgctactcacaacactcctgacaccaaatgtgtggggttttttctctcacatttgccaatttgccaaactttctggacaccaactggggtttcttacaatttaattcaattttgacactacctggagctagcataatctccayagattaagtggggacaagactgtccccacttcagatgctaatcacaagtcagggccacccatacttttgaccaactcactataaagttggagggatcggttcccacaaccccctcctcaggtttggtaatttgctagaatggctcacagaactcagaaaaacagttgacttactattaaccctactattagtattatattactattagtttattaaggatacaactcaggaacagccaaatggaagagatgcatagggcaaaattttggtktgtgtgtgtgtgtgtgtgtgtgtgtgtgtagagcttccattccctctcagggtgcaccaccctcccggcaccttgatgtgttcaccaacccgggagctctctgaactcagaagttttgggtttttatggaagtttcactatgtcggcatgccatattttgaatgtcccctccaagactcatgttgaaatctgattgtcattgtgatggtattaagaggtaggacccttcagagtgattgggccatgagggctccaccctcatgaatggattaatgctgtcattgctagagtttgtttctgataaaaacaagtccggccccctcctgccctctctctcttttgtgtgtactgttgtgcccttctgcctttctgctatgggatgatgcaggaagaaggcccgcaccagattcagccatcaatcttaagacttccaagcctctggaaccgtaagaaataaatcctcacttcattagcataaattcaggtatggtagagggacttgttatgaatcacaaagtaggctcctctcacccccatccctcaggaaatgccaagggtttttgaagctgtgcccagaactgggaagaaggctctctctctctctctctctctctctctctctctctctgtatatatatacacatatatatattccttattatatgtagagagatatctatatatattcattattttatatatggaatacatagatatatttatctcacagtaacacacatgtgcacacacgcacacacacacacactcacagcccctgcatgctggtagtgtgagattgtataccccatactctatatgattctgctttgtattcctttgtatatactgttccccatagcgtggaatgtccttttctccccttgtctgctgagagcactctagttgctctaaaacccattttagctttgcctcctctgaaatcttttgtgctgcctgctgacggttactttctggcgtctttgtgctgccacagctccttgtgcatcccgctgctcttgcacatttcatttgatatgttttcgaggaaaagcctctagtatggggcttagtaaagggtaggtgcttgtgaaatgattgttgaagaaagaaactaaatgaatgaagaattggatctaagtgaaggtcatgtactgcaggcagggcaaaccacagaaaggtgtctaacatggcataagtgctatcagagaggctaggagatgagtgtcagactggcagaaaaggtggggtgtgcgtacttccctgtgcacacaagtatggagtcgttcgtggagtggcaagatagagtctgtgcagtggtgcacacctatcatcccagctacttgggaaggctgaggcaggaggatcattttagccaggagttcagggctgcagtagctataatgatgcccctgcacttcagcctgggtgacagagcaagaccctgctcataaaaagattttttaaataaattagaaaaaagaaaaaaagcccagtgagttctgggttccatagactgactatagggattaggtctggactcactcaaggtgagatgaaactattttctgagcaaaatgcagcaggatagaaggaaaagagctgtagctttggaattgaggattctgggtggtggtgattatactgttaataatgataacatagtcctaactatgagccagacactattccaggcactttacatatgttaattcatttatccttataatgtctctatgaagtagtgactactaattgttgatttatgaagattgcagagcaattctggacttggttctactcttactaattgagtgaaccgagggcaagatgcttagccttcctgagccccagcctcctcctttgtgaaatggagaagataccttttgcatttaatcctattgggcttattggtagactcaaatgagataatacgtgaaagtgtttttgaaaagtataaagtactctaaagtactttgcattggggaagaagggaaacttgcaaagtaattgtagtttagatactgggctcatacttaatgcagatgctgctctgagcatgggccacagttgcccttcacagctacacaaggtgggctactggcagtctctttgattaaatgccaggatttgagctgctgttaaaaaaatcaagaaatctttttttgcccctttctttcttttttatgttttgtagagatggagcctcactatgttacccaggctggtcttgaactcctgggttcaggtgatctgcctgccttggcctcccacagtgctgagactacagtcatgagccaccgcacttggcccaagaaatgagttttattggggccaaatgtatatgtgaaatgtcataagggacagattttttgtgctaaaccagtccttctttcccagccaggggaacagtggtaaagctgggtggtaggcatttgcatgggggaggattaggatcagtgtggccactgcaacaggtgrcaaaaaggctggctcagagcggaggcacagcagctgactgcagggtcccatgagcagcaggtgtgtgaccccttttttctaagacgagacgcttatgggagtttttagaagttgctttatgaccaggcgcagtggttcacacctgtaatcccagcactttgggaggccgaggcgggtggatcagttgaggtcaggagttcgataccagcctggccaacatagtgaaactccgtctctactaaaaatacaaaaattgtctgggagtggtggtatgcctcccatacctgaggcatgggagcctgtcatcccagctactcaggaggctgaggcacgagaatcacttgaacctgggaagcagaggttgcggggagctgagatcgcaccactgcactccagcctaggtgacaaagtgagactcttgtctcaaaaaaaaaaaaaaagaagttgctttacgttgctgttaccttggcagtggagactgtgtccctcaaagtggttctctgctggcactagatacacaaatgtgtcagcacttgggcttggcaggcattgctgagtcaggcagtgagtgataagggagatgaaggggacatagggggagtgcctccaagagcagcaaggaggggcagtgtggcccttctaagccacattactacagtattctctggagcttcttagagccaagtggcttcttccatgaggttcctgcaggcctgagagttgcctggattgaccatgatgcctgagtgtataattataggtcactgaacagaacccctagtcagctacatccctcaaaaatgcctaattgtaggctacaaatatgaaaatatacaagagcttagaaacatgtcatacctcattacaaagagcaatggcatgagtcagctgtgacttgggtggctttagtgtgcttggtgagcatgctgactagtccagaagagggcaggaggcacattccccaagcttcctacagggagattgaggactttgggaaaagggagaaagtataagctgtgaccatagcctgctagtcacatctactaaaggggtctgctcacctgatggtagatttgattcctctttgggaattgtttcctgaccagtttacaaaccacattagaaaatagcacatttggccaggcacggttgctcatacctgtaatgccagtgttttgggaggcaggaggatcacttaaggccaggagtttgagaccagcctgggcaaaatagcaaaacccgtatctctacaaaaaatttaaaaacttagctggctatggttacatgcacctgtagtcccagccactctggaggctgaggcaagaggatcacttgagcccaagttttaggctgcagtgagctattactatatcactgtactccagcctgggagacagagcaagacctaatctctaaataataaataaataaataaattaaagatccttgagggaagtgaggtcatatgtaataccttatattacctaactgggccatacagattttattgctgggttgagggagcccactctgtctcagggtggggaggggtacttggataagtgcccagcctggttgctctcgtccggtctggcagtgctttctcaccgagaggcctctcccagctcagaaagaaggaacagctcgatctagatctctttcttttgtccctccctgttctcccaactccccttggtatagatgagtctatacacacccttgctgccagtggcttgccattccttttctgagtcactgcccttcattaccagatctctagtggtgatagtagaagggagggttaatctgtggcccttggggtactctttcctctcagttttaaactttttagtcaactctaagaatctaggaatctcagtattgaaagcgaccttaggtgccacccatgcccatctcaaaggcgagggggtagactaatcttatctacctttactgtggtattcccagcatgtaactgagtggagtgtggtaggaggtgcaaaaaatacttgcggaatgagtgagtccctgtaaatagcagcagcttcacaagaccactgtcattgcctcatttgttcatttttttgacgaatattagtaagctccaattatgtgccagttccttttaagttctggaatactgtgatgaacaacacagtccttgtcctctggaacgtattctgtaattgagaaataaggaattaaaaagaattgatagtctccaaatggaatttaagaattaaaacttcttcttcattttggcctctcagggtctctcattttctgaggtctccttgggggaccctagaaaacacatctaatccctttttcacacgagagcctttccgaattcccaagccaatgatcaccctccccgctccacagccttctcttctccagggtaaacattctcagttccttccgtcatttctcctgtgacatgcttctgagtgccctctccatcctggtcactgtccttaggactcagtccaaactgatagtctgtccctctgccagttgggagtccacaacagaataccacctcccacgcattaatttccagggagtgttccagcctggagcctctccttactctgggctcaggcgataggtgagggaaagagaaggtcctggacttggccagactgagatcatcttcatatttggccaatcctggaattcgaaattcttttcttttgtctcctccctgcctccccaccatccttcccttggtatagacgaatctacacacagccttgctgccagaggcttgcctttccttttctgagtcactgcccttcattaccagggaaattagcatgaaaaagcgaattccagttctataactgtattctattcttgtcctctgtcacattctccaacccagcacccccacctaaaatgacaaaagttgagtcctgtgacatcacaacagttgactattgtatcaacagctgtgatgtcaccaacagaggattatgacttcaaggaagaatggaggkggggcgcatagctggcaagaaaccccgtgggaacaaagaaggtattttcgtgcagawcttcacccagaaagcctgagttggcctttcagtggatggtctgtcagtggaagccctctccttggttcccattgctccctgtctctttggattaatgatttggcttgtggacattgcccaagtctgagcgtgtgtggaagacccctgctggccggcaggcttctgggctgtctttgggttttattcatgaggttggagctgaatagagcttttcagggagggagttcagaggggtgcctgggagcctagggtgaggctgatgtggatgtgcaggcgcctgggctgagggataactggtgtgcaggcacttctgttcaggcagaggggttattctaccagccactctgggaagcctgagtgtgctgccacaggcctgaatgttgactcctgcccacttctggggctgggttgggcctgccctgggaactcctcttggctccatgaacagagacttaaaaacacctgctgcagagactcccaaactttcttagttcatgggccttagtgtttcagtaatttttttttttacagtgtccatagcccaaaakaaatacctaagttttcttttataagtaggttttttgtttgtttttatatgaagtctcactctgtcacccaggctggagtgcagttgtgtcactgtatcctccgcctcccaggttcaagtgatcctcctgcctcagcctccctagtagctgggactacaggcaggcaccaccacttctggctaattttttgtatttttagtaaaattagggtttcaccatgttggccaggctggtctcgaactcctgacctcaggtaatctacccgccttggcctcccaaagtactaggattacaggggtgagccactgtgcctggccttaagtaggtttaaacaattaagtatttatatcctaacaactgagtagccatctgaaaaaaaaatgatacaagaaattgaaaggaaaaatatttatattccattcttaaccacacttactaatgggatgtactaggtactgcatagcatatcagaccttggaaccagattgattagtgccatgcttatttcctgttccacattgcttttcacatggtatttgctttttatcacagcaactgctgaaaacccagcctcagaaagaaatgacatcatcgaaaagaatgtaatgcagtctgttgttgaagctgtgaactcatggggtgttcaacaaatgttgagtgttgctctgtttccctcaaagatttaaaatatttagcagtatccctgtgagttcatcatggggctttggggcacctcagcacacagtctgagaagcacagacctgaaactgccaagtagcacttgctctgtttaaaggaggaagaagaggcaagttcggtcatcatcatggcccttaaaggagttgggcaggtggatggacagactctttctctgcagtctcagctccagcagactgcattgttagggggaaggtctttgtttgaccagggtctgtgtgtgtgagcccctttccctagatggggaagaatgatgataggcatctcttacgcttatttgttgttgactcagagccttctgaactagatggcttaaagaaaaatgggattttgacaaccagaatttaggggccaggcgttggaccttctgctaatatccttttctaattctttttttttttttttttttttttgagacagtctcactctgtcacccaggctggagtgcaatggcgcgatctcagctcactgcaacctctgcctcccgggttcaagcgattctcctgcctcagcctccagagtagctgggattacaggcacccaccacaacgcccagctaatttttgtatttttagtagagacaggacttcaccatgttggtcaggctggtcttgaactcctgacctcccaaagtgctggaattacaggcgtgagccaccatgcccagccccttttctaattctttatccagatagagtggggctgcaggggtgtacttgggatggagggtggcttcctgccacaagatatgacagagaccaaaggactaatgtgctctggtatcacttctagagcctcatgccaacctctccagactctggggtctgctgcttatgaaacgctargcaaattacttaacctttcagcctcagcttcttcatccataaaatggagataatggcatctatttcacatagttgtaactaagattacacaagctaaatataaatacatgcatagaaccagcagagcctggctatataggtgtgctttcttctcctacttccaaatttgaggaaaaaagggttttcctccaaagggaaattgagccctaatgatctaagatctgtagttccagtgttaccctctaccctctactgcttcttttttcttttcttttcttttgttttttttttgagattgattctcgctctattgcccaggctggagtgcagtggcgcgatcttggctcactgcaacctccgcctcccgggttcaagtgattctcatgccccagcctcctgagtaggattacaggcacctgccttcatgcctagctaatttttgtatttttagtagagacggggtttcaccatgttggccaggctggtctcaaactcctgacctcaagtgatccacccacctcggcctcccaaagtgctgggattccaggcttgagccaccacacctggcctctctactgcttcttaataactttgctctgtggatccagtgttcccaaatctgctgagctctgtatcctgcttgctatattaaactttttaatgaagtatatcatacaacatgaatgtatatatgtatccaagtcaacaaatttttacaactgaacccatgtaaccaacactcagatcaagaaacagtctattatcaatatcccagaatctccctctagtcttcctatgggtaaccactctcctgacttctaatagcattgatttatttttgggttttattgttttctataaataggctcatctagtatgtattcttggtttctggctcttttattcagaataatggagagatttatccatgttgtgtgtagctgcagatgttcattctcattgctgtatagtaatcattatgtaaaataccaaaatttgccttctcttcttctgattatgagcatttgaatttttagtttatagccattatgaatagtgttgttatgcacattctcatacttgtcttttagtatgcatgtgtatgcatttctgatgggtataaaactaagaaaggaattgctgggtcatgggttatacctatatttagctttagtatataatacccaargttattccaaagtggtagtattgatttacacttcctctgtcagtgtttgagaattccagttgcttcacatccttgccaacagtaggtattttctttttcattttatccattccagtgggtatgttaatgggtatcacatctcagttataatttgcattttgttgatgactaataaagttggataccttttcatatatctcttcactgtttgggtatcctctstggtgaagtatctgttctacttgtgccattcttcttttgagttgttttttatttatttgtagaagttcctcatatattctggatatgagttcttggttggatggtctactgagtacattgtcttatactctgttggtttgcttttcactgtctgtatggcatttgttaaatgaacaaagttcttatttaatgtagtctaatttgtcagtgtttttcattatggttatcactttttgtttgagatgcagtttcgctcttgttgcccaggctggagtgtaatggcgcgatcttggctcaccgcaacctctgcctcccgggttcaagcgattctcctgcctcagcctcccgagtagttaggattacaggcatgcgccaccacgcctggctaattttgtatttttagtagagatgagatttctccatgttggtcaggctggtctcaaactcccgacctcaggtgatccacctgcctcggcctcccaaagtgctgggattacaggcatgagccactgggcctggtcttataagcttttcagagagcaattttagttgagttcttgggctgaagctactcctgcccagaatcgtttgggttttcacagggggaggcccccttttgaattttctgagtggttgtggttgctgtaagtgggtcagacccttcactgggaaggccagaggtaactagagatgggcctggactgtggagcccaactgctgttcaccctatctagggagggcagttctacttacagggtacagcaggtgtgaaggccctggggtaggaacacacctggtgtgtttgagcacatggtatcggacagtgtggctggagtggagacagtgaaggagaaagagtagttgaaatggggccagagttataaaagggacccagacaatggagggccttataagtcattgtaaagattttggyttttactttgagtaatgggagctatggttttgagagttttgaatagatggggtgacaggagccatgatgctggtggggagtacatgtgatgagtgtagctcattgaggatctgttcttagtggaatcggaagcagaggcagctaaaagagtgaggatgagggaggaggtgttgaagttgagagctggagggaaagctaaaccccagcccggagacttccagtagcactgggctctgagtacccactgttctttgtagatggcttctcattgttctttgtgttctcattatagaggtggagtagtctccgtaagctatctgtggtaaaacggaggtattaggattttgcccagtccctttagcctttattatttcctagtcttactcggagaaggtgcagcttgtggatgataagtttcttctagagcagaggaggcagcttgccatcagtcaggttgagctcagctagaccagagagcgtgggaagggtgagaaggaggtcaggacttagagtcaggaagaagttgacacttgaactggatatttaagaaagaatggggggcaagggacactgaaaatcaaaggaattggttgaacaaaagcttggcggcatgaacattcctggcatgtgcaggaaatgtcatccagtgagatgtggctggccagagtgaaggtgctgctctaagataggactatggcctctggatcatcgaaattgcaggacccaccatgttctccttgccagagcgaaagagggcagtggttggtccccaggagcagggttttttatggatcaggcttccaatctgcctcctttttccaagtggtgacaagatattgggcagagtaggtgccatagtcttgacagagctaggataagccacttgctgagaggctgagtttccagaatggcagaaacagccatgtctaggtttttaaaactatgtgagaaacaactagatttcctttggcctgaaattgcctaacaagacctcactccaattcaggctttcaggaagtgtgtaaacccagctttaaacctctgcaggatctgcactgaagtggagaaggaccatctggcaggaaaagggattgaaaaatggttgaggttgaaaaagcagacttaaagggctttctttgaggaggagggttgggaaggaggatgtgggaatgataagtggacagtgaagagayggaaaaagttcttacttttttttctgattattatgcaacaacaaaaaaattgtctttcctgtggctgattgagggrgatttcagcctcacgggggcctgtaaaaacacccacctatcctctgacctcccagcaaaacaaatgttggttcctctccacttgaccaggctcactatccccattacatttttccttgaagggctttctggacctggggctggaatggagaagatctaagatttacaatgtgtatagaagtagtgaaggagaaaagggtttactgttttgtagggaatgggacagtcttgagaaaatccttcctggtatttcttttctcttctcttctctttttttcttctcacagggtctgactctgtcacccaggctggagtgcagtgtcatgattatagctcactgcagccttggacttctgggctcaagtgatcctcccacctcaggctcccaagtagctggggctacaggtgtgcatcaccaacctcctgctaattttttatttttagtaaagacagggtctcgctctgttgcctaggctggtctcaaactcctgggctcaaacaatcctcctgcctctgcctcccaaagtgctgggattacaggcgaaagctcacatttttgagaatcttggtttgggtacttacaaggaacttaatctaaggttactgaagcttgcagcggctctgggttgtgtgggcaggtcaggggaagggaggtatggcagggagagaatggaggcagcactgagaagatagaaggaaaggggctcaggttcttagtatgtttctaggagcccttttatcccttagagaaccaggcaagtcgtcgatctgtcgggaggttaggcagagaggggctgtgccttttgcttatagcattggtgagcttagctctttctaggaagcaggggagcttttccacaggaatttagcaggaggccttgctgcttcaggaagaacaggggctgatgggaggatccagaagacacaagtgctgagggtgaggttgaagtcccatgcggagaaggatcatcctgatttagttgcatttgttaagctccttagaatctgagggccagtattggttgctgagactcttggcagccctcctctggggagctgccagtctgttcctcatgtccttggccagggcccatggatgaggagaggtgcaggaaggagttggcaagaaggtaaagagggtctgaggagatgtttgctgggcaggatgagtaggcaggttggtcccagggcaatcaggccacagctgcacactgttgggtcactatactgtcactgtattgctggccctttcctggctctcaccatgttctcagaacacacacaagagctctgttcccattcccaccttctctgtccctttaggctgctgcctaaactttgacttccacgtgagcagaattgcttaggagagtagtggaacatagatgtagcagaaattctctcatgtggttgagaggtttcctattttcgggcatcttgacttcttacctcggctataaagcagagtgctgggcaatgtttacgtttcctctcagtggtgacattaacctcagcagaatgggaggctttcctccaaatgcttgcatttcttcctcttcactcagggctcagctgtctcctgcttcaagagcaaggcatactgtcacatccacatttatgcctgcagaaaagtatcagacagacatttagaaatgtcacctaaacaaggacagacaggttttttgctctaggataggaaggtccattcttagaggtggggcacccctcagaaagagctcccttcagagactgacctctcatcggtcccttcttggacctttgagagagcctctgtggatcaggtgatgggatcgggtcagagggagaaagggcactcaggatggtagagagttgtctggtgaaggctggactgagcaaaagctgtcagccttccgggaggtctgtcctcctgtggcagtgaggggaattgatgggggtttcaagcagccaggaggctgtgccctgcactgctcctgcccagccgtccaggaggttttgtgtggctgttgccaatgccgtgcctcctaacccttcctgctgggatgcaggctagagagctgcgacacttacctgctggttgggaggtcaggttagagccgagtggaccaggtggaggccatggatgaggaggcacagcgctgcggtggagggagccgcggcatctaactgggccacttgtgctcagctctggcccactgttgtcatataggagtgcacacagtgatggtaaattttctcatttttcaaaagaagctagaatctgaatttttctttctattcacctgctttcttaagcttgacaactaattcaaattatttaaaaataaaaggaaggccaagtgagacatgtttttgcttctgcagaccaccagtgtatgactgatataaactctttttcccaggagcttagaaatgaggagaaagcaagcaaagggatcagggtgggtggcaggaagagtaatttcaaaatacaggaagacggagcacacctggagactgacgaaatggcttagatgagccattggtaatgctttcactggatcccgtggtgtgtgcgttcctttgtggttgagggccagtggttctctgtgtggtggaagaagctaatgggatgggggtaggaggaagaggggctgagtgccatcttttagttgcacatagctaggcagattcttgggaagatggtgagtcgtgactccattaagtccctagagaacatgctgtgggacacaagtttttgcacttaagggcatataagcttgatttaaagcgcttactaaaatgcagattcctaggccccatccccacagattcccgttcagtaggtggggcctgggactctgcattttaaagcaccccatcaatgttaaagaaaataagtggacaatggagtgagacagagctgggtctacattcctgctctgttccttcactaggtgagtgatcttggtccagtcatttaatttctctgaatttaaatttcctaatcagaaaaaaggagactgtattatcactaccttgtagaatggtgagaactaaattagaagacagttggaggcagtacagggtcctggcccagagctggtgcaggccacctggtcataaatccctgcccctttctagccgtgtgacttggagcaagctaattaactgctctctatcttggtttccttggtaaagtgtaactaaccctgtgaaatattaatagtacccacctcacagggttgttaaagggttaaatgacttaatacacatgaagtgcttgtaactttrgctgttataattacatgtttaaaagtctagcagcgtgtctcataataaatgctcctttgcttttccttaggtccccttactgtgggtaacagattaaagcttaatccaaatgtcaccttctgatgaggccttcctggagtccactttttactttcttgtctcccttcacagttagcttctccagggcagggactgtgtcttccatgttaatatcctagcaccttgcacagtgcctcacatagggtcagtgaatggaatgatagtactagggagtctgaaagatgactcagacttgggaatggagaggttgtcttccaaatacctagggaagtgtgatctggaagaacaaacattttttaagcttctattgccagacagggcaatcatgggaggtaggtcatattgctattatggctgttatagtgacaaagtgagtctttgacactcactggagcaaggtcacataactagcagttgtcagaggcagggctggactcaaggcaggtgtttttccactgcccctcggggcctgcgactgtgcctgtttgtctggatgcagtttgtagaaaagttccagaggtaccttattctattcctttctctggattgttactcttcagatagttgtctataatttgtcagagctgtgtttttgaggaactttggatggatggtatatgctaattgaacaatttccttttctaaacatgcagtttctgcctagactttgccattgagggcctgggaactagcaaagaagcctctcatcatgcttgagtctctgctccattcccatgggcatttcctctgctttaggagygtcttctctccctgcagtctgactagccaggatatcaggctaaaagcatagatgagggcctggggctgcttgtaggaggtggggagaaatggtgtagcccaggaagccagaatgctgagagtcctcaagcctgagcttcaggtgtaaagggttaacctggccttcagctcctcaagtcccaaattattctctgatcctgatagacctggcccagagagagcagttggtggggaggctggtgagtaggcatctgtgtttctaacctagtgcgcccntgtgaggttctcagcagtgccagctcaagatgcctgaattcccaggccacttctgagaatggcagctgcactcttggagaaatgtgactaagggtccctgtcatgggcctggaagcaattttgttctgcttctttcttggttacatcttcacaggatttttcttcttagccacccagatgtcagagtcaactacatttctctttcttagtaagttggctctgtgttctcatatacaactgcatgatagcatttcagagcagtgagtctaccctcctgaaagcagaaaytcagggaaagaaagaatatgtttttcatcatgtttttttaacatgtttcagtttctggtcatgccacaaatcttttgccttttctccaagggcctgccctggaactgatagagcaggtcaaatgttgttttcatggatggtgatggttactgtgatcattgctacagttgaaaactgatgcttagcaagttgattcctatagcactgtgcttcctgaggaccctgaaaactggcctgagaaaatgtccagaggttgccttttctctcccttctctgttgtacatatagcaatatgatatgccaagcactttacttggcactgggctgatacaggtagagagtatctcactagagccagtgtgcgtagatgccctgggggcragattgactttatcatcatcatcatcatcaccatcactaatgttatgctattaatatagacttaaatttatagggccaagcatggtggctcatgcctgtaatcccagcactttgggaggctgaggcgggaggatcacttgagaccagcagttcgagaccagcctgggcaacataaagaaaccccatctctaccaaaaagaaaaaagttagctggaccaactccattttatgaagggtaaaagtgaggcttagagttggtttcctttttccagaagcatctgccgtattcaccttggagggatgtttcattgctgtcaccatcagctaatcatcccctgcctactggctgcttcctctctttccagttaacataccactccctatcaccatcactaaaaccacaaccctgagagcttatgcgaagttaaaattagagctagtacatttcatcttgagattaggaaggaagtataaatgctatcaagaattaggacttgacttatttttatcatcaaaaccaatcacttatttgcaccaaagtaataagtaagatggtctccaggattaaggtcatcagtggccataaataaatatgtttaactttcacatccagatatacttcattttggccaatgtgatggaggataccaatcagagggagagaactactgtttgtaaactgttcagcttccgtgatggtggtgttcrcctaggctgtggtgcaccttgacattggaaatatgcttgatgtgtcgtttgtgttgtcactcacacccactctccaaggcacttaaaaagatttatttagctcttaagttttaacgtctatattgagatgtaattaacatgctgtaaaattcattgatataatgtaatgatttctaatatattcacaagagttgtacaaccattaccactatctaattctagaacatttttgtcaccccaaaaagaaaccccgtactcctatcagccatgtcccattctgccaccctcaaccagtgctaggcagctcctagtttactttctgtctctgtaggtttgcctgttctggacatttcacaaaagtggaatcaaggtttattcatgttgtagaatgtatcagtactttactcctttttatgtctgaataatattccattgtgttgatatataccacattttgtttatcatcagttgatggacatttgggttagttccactttttggctactatgagtaattctgttatgaacatttatgtacaagtgattgtgtggacatatattttcatttcttctgaacagatacctaggagtgggtcatcctggtttatatggtaactctgagtataactttttgaggaactaccaaattgttttccagagtggctgtgccattttacatttctaccagcagggaatgaaagttccaatttctctacagtctcactagcatttgtttttatctgtctttttttgttatagaaatcctagtggatgtgaagtaatatctcatgtggttttgatttgtatttccctaatgactaatgatattgagcattgtttcgtatgcttattggccaagtttatacctttggagaatttctgttccaaatcctttgtctaatttttaattgggttacttttttattattgagttgaaagaattctttatatattctggatacaattttcttaggagatacatgatttgcaaaaaatttctcccattatttaggctgtcttttcactttcttgatggtattgcttacagcacaaaagttcttttctttgacatagtacaattcatgtcctttgtgtgtgtgtgtgtgtgtgtgtgtgtgtgygtgtgtgtgcgygcgcgcttttggtgttatatctaagaaaccattgcctaatccaatgtcataaagatttacttctgttttcttccagcgttgcttttgtaattgtagctcttacatttagggctatactacattttttactttatttttaaatatggtatgaggtggggycctactttattcttttgtatatggatatccagttttctcagcacagtttgttgaaaagactcttctttccccatgaattgtcttggcatccttattgaaaatctgttgaccataaatgtaagggattatttctggactctggattctgttgtgttgatctctgtttctgttcttatgtcagtactgcactgtcttggttactttttagtatttttttttaattggcaactcagagtcttctaactttgttcatctttttcaagattgttttggctgtcctgtatcccttgcatttccataaaattttaggatcagcttgtcaatttctgaaaagaagctagctggcattttgatgggtattctgttgagtctgtaaatcaatttagggagaattgccatcttaacaatattaaattttctgatccatgaatatggtatgtcttttcattttttatgtctaatttctttcaatgatgttttataatttacagtatayatgtcttgcattccttttatttatttctaagtgatttattatttttgcygctattgttaatagaattattttcttaatttcattttcagattgttcgttgttagtatatagaaataaaattgatttttttttctttttggaggcagagtcttgctctgttacccaggctggagtgcagtggtgcaatcttggcttgctgcaacctctgcctcccaggttcaagttactttcatgcctcagcctcctgagtaactgggattacaggcatgcaccaccacacttggctaatttttgtatctttagtagagatggggttttgccatgttggccaggctggtcttgaactcctgggctcaagggatctgcctgccttggcttcccaaagtgctggaattacaagtgtgagccaccacacctggcccaaaattgatctttaatattgattttgtatcctgcacatttacttgaagtcactcagcagtttaataggttttttagtggaatccttaggattttctacatacaaaatcatgccatttgcaaatggaaataattttacttccttctttccaacccaaatgtacccttaaattttaatcttcatattccttttattacttggcataaaatagtgttcctgaaagggtagtgcatttaccatggtgatatattagctaagaatatatggtacatgaacagacattttttacttttaaatatttaaataccttaatgtatattacttttattttaatgggtattagaaaaaatgatgagcacttctagctctcaatttcatgatgtgtactcaaatgttactttatcgtaatggttttccctgaacatcttatttaaaataagataccctcttcaccactctctttccctctaccttgcttaagtttttttctctcttttttttttgagacagaatcttgccctgtcacccaggctggagtgcagtggtgcaatcttggctcactgcaacctcctcctcccaggttcaagcaattctcctgcctcagcctcccaagtagctgagattacagctgcctgccaccacacctggctgatttttgtatttttagtagagaaggggtttcaccatgttgcccaggctggtctgaactcctgacctcaagtgaactgcctgccttggcctcccaaagtgctgggattacaggcgtgagccaccacgcccggctcaaccttgcttaatttttttttattccacttaccatcaccttacatattatacacgaaggtacacttattatcacacacgtgataattcatgtgtgctcattgtctgtttttccccactgggatgtaagctgcatgaggtcagagactttgtattactcttcactggatcacatttgccgtggacatgggtgctcagtaaatatttgttgaatgaatagtttattgtttagaatgaggtgacttttttctttttaagaaaaggaagtcagtttcaagtatattcaagaaaaatattgaataaatagtatgtcaggagatatgcaaatatggcaaaaaccatggactgtatagaatgatagaagtttaaggaaactctaacttaaggaatgaggagagatggatggagatggagtttcttgggcttctttgtttattttgttttctgtgaaattgtgtccggaattggtgggttcttggtctcactgacttcaagaatgaagccgtggaccctcgcagtgagtgttacagttcttaaaggccgcatgtctgtagtttgttccttctgatgttcggatgtgttcggagttttttccttctggtaggttcgtggtctcgctggctcaggagtgaagctgcagaccttcgcagtgagtgttacagctcataaaggcagtgtggacccaaagagtgagcagtagcaagatttattgcagggcgaaaggacaaagcttccacagtgtggaaggggacccgagtgggttgccactgctggcttgggcagcctgcttttattcccttatctggccccacccacatcatgctgattggtccattttacggagagtcgattggtctgttttacagagagctgattggtcctttttgacagggtgctgattggtgcrtttacaaaccctgagctagacagaaaagttctccacctccccactagattagctagatacagcctgtggactgatgtatttacaaaccctgagctagacacagagtgctgattggtgcgtttacaaaccttgagctagatgcagagtgctgattggtgtatttacaatcccttagctagacataaagattctccaagtccccagcagattagctagatacagagtgccgattggtgcatccacaaaccctgagctagacatagggtgctgattggtgtgttcacaaaccttgagctagacacagagtgctgattggtgcactcacaatcaaattagctcacactcctccgtattccaggccaggggtttcttggggtctcttaagctgtaacacatggagttaaacattaagtgggaaagcagtttctactacctgccacagrcmccctcttggcacttttggaggtcatctggaagatgttcaaggtgcttttggctgcctatagaaacttggcttaccggcattgtcgtctttgcagggctctgggtttgcagagagccgaaatgaccatgactgccaacaagaattccagcatcacccacggagctggtggcactaaagcccctcgggggactctgagcaggtgggtaagggagcacttgtgggaggtggcatcaagggacctaggtcctgggtgggatccctccaaaatgtaaatagtcatcatcttgactgacagtcatccaggtgactggtctaggccagctcatgctgaccattaggcagaagatattttctagttctgtaagtttctatgtgatatagcaaacagtaaccctaaaacaagccttgctttgtgtctagcattctaaggatggggccagcaagaagcagctgatgttcttctggcttgtaaccttttcccatggtggggagagcttggggcctgtgcctgagctaagctgcactgtagtgagggaggctgaccacattgggctaagggtagagaggcagttacgcatattagcacaaactccaagcagcagcctaggctttataggagtttagagaaaccgtggattttggaatcatggatttggttcaaatccaggttctaaccacttaccaaatagcgagctctcagwrcstwtmcctgtgccctataaaatcttcattatttcatctataaaataataatagtagttatcttacagagtttctctgaggactaaatgagataatatatgtcagtgcttagcattatggctgacataaagctactcaataaattttaacccccttttgaggatgagatcaaagcttccagaactcacagatgcacagatagatgcacagtactctcaccagggcttctctggtcttggccaaggctggacactgatatcttaaaagaacctttagtcttttttattaaagctgtgtacctctcatagccctttctgctgaatgtcaggtggacaaatttggcttttggggcctctgcctctaagatggatagctatgagaaggatgcttagctttggtttggatagggctagttcattcctggatatctggctgtgcagtgctaggctgagtccaatagggtctggtcagagttggtggtaaacatttggttcattcagaactggagtccagatatagttggtagaatagtgcacgggatgtagcccctggggagtgactgtcatgaaggaggcaggggttccccacaccatacatacaggactttgtcccaatagaaacagtctggatggactatgccaaacagggtttgatggactctgacttgttaagtacgtaagatcctgggacttagccaagcaaactgactatccacttgcagcagcaagactgataggaacaccccttgcccaggcaatccctctcatttagactgggcttggtggcataccagcttccctgtactgagtgaggctgggagtggcaaggaacagcttcttgggcaaagcaggtggagaaactgacctcctccagaacatgttggtgtccaaggtagaaacaagtcaaggtctcagagtctttatctcccattgcctgctcctgggaaccatgttgttgggctcttgtcagcctagtggcattcttaccatgattgagctggcagatggggctgaaaactaaggttccagttttttagaatatcacactactgtaggagtgaaacaaatatatgtgattgtgtcattttatttgtaattttaaagaaattgtatatttaggacctgaaatggagattaccattcccagcaaccctcaactcctttaaatattctttttttttccttctaatttccaccatacaggaatggggtagaggggtgggaggggcagtatttacatcaagtttcaaagcagactcgagactgctgacaggtgctgcagtttctatttggagtaaatgcctacttacttctaagtgttttcagaaattgctcttcctttagcttctcagcatgcttgccatcataacatgctagatggtgtttgtaaatatctgagcctcagatgtgcctaaaaaaagcacctttcctgcctcccttctaagtcttctcttccttcctaccacatttccgcttctctccttccttccctcccccctttctttcctgggagcctggcttttggtgtgaagttgcaggcctctgtggctagtgacacccttctctcagagactacccctggggtgtaggtattatttagacattgtgatctggtggtttctttggctgccttcacccctggccacatctgggtgtgttctttgggctaaggcagtaaatcaccagttcatttaggaaggcattgtcggtgaactcagagggttctcctgggtgccaggctctgtgctgggcactggagggcaaagagggatgatccattctctttctccaaggtatttacaacttggattgatgatcttggcacctgagtttcttagtttgacctttcaataggtgtttggtagtgacctggggcccttttatcattgccagcacatgaatccaaggaggagactcctcggtgtgaccagagctttagttggggaggggagggtgttggggccttggaaagctgggcctttgacyctttggctacgtcggggacttccacatcatccacatgaaggcagaggaacccagtggttctaagacgcatttgtatccagctttggnggaagagggaggtctggtcaaggaaaactggcgggggtgggcagatgggaccctgtgtaactgtcaaggtgtgtatttgaaggactgtacccttaatttgtgtaagacttcacctggtgctaccaccaagcctgtctgggttaaagaccctggattccagtccctaggttttcacaggtgtgttgctaatttattcccttccttttcctttgcagcttagtcttgatttggcaggaatgtgtaggaggggaaaatctaagcctttcatgtgactgcctcagttttgttctttgctgtatcttggtctcctggagcaggtttccttgtcttcgcttttgttgatgaggccgaatgagcatactgttcatccttacctgccagatacactctccccacaggctgttcccatttcagctcacaagatatggctgcatcccactctgggggtctggggtgggattctcaaacctcttctgaattctagaggtcagccttcactgtgttggtgttgatgacctggggtgggactggaagcaggttggtaacttgcaaaaaaggaagtattatgtttagagctaattcagctgtgtagatagggtgaactttgccacttactgctctcaggagatttcacttttgcagtaagacctggcaggcagcaggggctcttctctgaagacctgctgatttcctccacagcttcttcactatgaaactccagcacctgggtcattgcaacttggaaataacagactgtatcagccttgagtttgagaacttttgcttgtggtgggtgctgaaaatctgagtgtgtgagaatatataattcttgagggcaaggactttgatgtctttctgtgtgcctagagcctggaacaatgcctggcacgtagaagccattagctatttgttgattagtcaactagatagatgggagagcagcctcttagagcataggctgttgtactacttgagtccttatagtaccttcctaatgggtcatcttagctttggactctgttttcatctagtctgtagtttcttagaaaggtagagctgaaagggggctttgtagctcattcagtccaacccatttgatttacagattgggaaactgaggcacagaaaagaggaggtactccttaaggatacaaaactagtaggaagaggtactcaagcctgcctctcttcatccttctgttattttattatcccaacacattcccttcctatgagcactcctgggatcttcctgcccccaaagtactgctatccatgataaagtcaaacttagcctggtttgcagggcttttcatgatctggccctggtctttctttctgccctaatagttcactgttctctaatgcaaaccttacatttctgccaatctggatacaattattcacttctctcccagtgtttttcttgaccacccaactaagacaaatccctccctcctctgcattcactcagaatctttggttcaaaacggccaaatggcacttatcatatagtatctcataaagtggatatttgtgtgggtcttatttcccctactcagctggaactctttggaggcccgatacattctctgttgggatgttagagttggaagggatcttgagatatatctggctcagtaacttacattacaaatgaggaacctgtaagcccacacagctaattggcagtggagccctaatttcaactcatatttgcaggtttttatgcagagggtggcctcagtttgtgatacagtgaaatccagagatgtcttgaggttccatggccaatgtaggcacagatttggaccctgtgccttagatcgggggaagctaagagcctaaagagaagaaaaatctcctgagtagctgtgggtaaaagatagtgctgcagggcctgtcctggccgtggcaggccccccttaggaggccctgtggcctcagcccctgttactcgagatgcttcctagaatccaaccatgatgctgtcagtactggtctggttatttattgctacataacaaatgaccccaaacttagtggcttagaataatatttattttgcccaccaattgcaatttgggtagggctcagcaaggaaagcttgtgtctgttccttgcagcatcagctgggggtagcttgaaagttatgggtgactcaatggctaggggctgaaatcatctgaaggcttacatgtatgacagttgatgctggcggtcagttgggactaaagctagggaacacctgcacgtcacctccacacttggcagcatgccttcatagcatgatatctgggttccaagagtaagaatcccaagagaacaaggcaaaaatgcgtggcattttaatgagctagcctcaaaagtcagatagtttgtcttctattgtgctgtattgattaagacagtaacaaagggctgcccaagttcaagagaaaggaagataatttccaccacctgctgagaggaatctcaacatctctttataagaaggtatgtggaatgggataggttgtggttcctgtctttggaaaatacagtctgccctctgattgcaacaattcacatctttcccagatgcaaaatacactcactctctcccctaaaatctcaggtcttctcttattcatggcatcagcttgaagtctattacaatggaatcttgtcaccaaaatcaggtacagatagggccgggtgcggtggctcatgcctctaatgccagcacttggggaggctgaggcaggcagatcgcttgagcccaggagtttgagaccagcctgggcaacatggaaaaaacccatctctacaaaaagtacaaaaattagctggatgtggtggtgcacacctgtagtcccagctactctggagattggggtgggaggatcacttgagcctgggaattcaagaccagcctgggcaacaacatagtgaaaccccctctctaccaaaaataaaaaagttggctgggtgtggtggtgcatgcctgtagccccagctcctctagaagctaaggcaggaggattcttgagcctgggagatggaggtagcagtgagccaagattgtactgcacttcagcttgggcatagactgaaaccctgtcttaaaaaaaaaaaaaaatcaggtctggatgtagatgagacttttggggcgcaggttcattccttgtgtgcagctccttaagtactgtttctcttgctgtgaagacctgtaacttaaagagaatgtatatctgctacccaaaagacactggtgggacaggcttagggtaaccactgaataggcttcttttcaaaaaggggaaaataagaggtacccagcagtcactggtttgatgtatttcttatattcagtgggacagctgttgctaattctttgactaggtgttgactcatttaccttgtctctagctgcaccctctgggcttttggttctgctctctgactcatcttttcttttccatagaagtagctcattattgcaggtgagtagtttctccatctgcttcatgcccataatatgttaagggcccaaagtcttttcttcattttgtactatctctgctctttttactccaagctgatacatttcctttaaaaacttcatgggttggctgggtgcggtggctgatgcctgtaatcccagcactttgggaggccgaggcgggtggatcacctgagatcaggagttcgagaccagcctgaccaacatggagaaaccccatctctactaaaaatacaaaaattagccgggcatggtggtgcacacctgtaatcccagctacttgggagcctgaggcaggagaatcccttgaacccaggaggcggaggttgtggtgagccgagatcacgccattgcactccagcctgggcaacaagagcaaaactctgtccccmmaaaaaaaaaaaaaaacttcatgggtttcttatgaatcattttataatccattataatagcaaaaggcacacatacaaatcacttcaagataagccccttggccaggtgcagtagctcatacctgtaatgcaagcactttgggaggctgaggtgggaggattgcttgcactcaggagttcgataccagcctgggcgacatagtgagaccccgcccccatctctacaaaaaaaaaattaatcaggcatggtagtgcatacctgtagtcccagctcctctggaggctgaggtgggaggatcgcttgagcctgggaggtcaaggctgcagtgagccatgatggagccactacactccagcctgggggccagactttgtttcaaagaaaaaaaaaaaaaggaagagataagcccctctccacttcgatttggatttcttgggagattgctatgggacaaaggtttttaagattcttaggagccttactgtcttcagagaggatttacaggacccactcataagattcttaggaggccttttgtctgtctgtctgttctatgaggcaacactttaagtaatttwaaaaaaaaawttttttttttgagacagggtctcactctgtcacccaggctggagtgcagtggtgtgatctcggctcactgcagcctctgccaaccaggttcaagtgattctcctgcctcagcctcccaagtagctgggattacaggcataagccactacatctggctaatttttgcatttttagtagagacggggttttgccatgttgaccaggctggtctcaaactcctgacctcaggtgatccacccgcctcagcctcccaaagtgctggaattataggcatgagccaccgtacctggccagtttttgggggcttaacaaagggtttttcagtctcactttagattttttttaaacagatttattgagggacaattaaagtacaataaattatataatttaaagtatacagtttgagttttcacacacacactcacacacacacacatactcaataaaaccatcaccacaatctggaagccatttctcttcttttctttttctgagatggagtttcgctcttgttgcccaggctggagcgcaatggcgcgatctcatctcactgcaacctccgcctcccgggttcaagtgattctcctgcctcagcctcccaagtagctgggattacagccatgcaccaccatgcctggctaattttgtatttttagtagagacagggtttctccatgttggtcaggctggtctcaaactcctgacctcaggtgatccgcccatctcagcctcccaaagtgctgggattacaggcgtgagccaccgtgcccagccaccacaatctggaagccatttcttaatttgagaatgttttcctgcctagaggtactggaagtgaaaaccagcaagccctttctcatttgtgattcctttaaattttaacaacgaaacagctccttcttagtttacctcttttctcttttttactgtaggcagctagagcaagtcagatggcaccttcagcactttgcctgcaaatctccttaggtagttcatcagatttattagctgtatttcctattatctatgttaccacagctgacaagcttttcaacactataagggttccttcttttctagcttctaatagcatttccttactctcctttatgcccctactgacagcccaaaagtcactgttttaagattttgtttcagtagcacctctcttgcaggcgccaaaatatattccagacatctactgccaaccacccacctcaaaaaaaaaatttaatggcataaaacaacatgttcttatgctcccagactccatggattaggaattcagwcagagcactgcagggatggcttgcccctgctccatgatgtctgccttggctaaaaagacttcaaggctggctgggcgcagtggctcacgcttgtaatcccagcactttgggaggctgaggcataaggatcacttgagcccaggagttcaagaccaggctgggcaacatagcaagaccctgtctctacaaaaactagtaataataataaaattagcccagtgtgctggaatgcacctgtgctcccagctactcatgaggctgaggcgggaggctcgcttgagcccaagaattccaggcttcagtgagctgagatcttgccactgcactgcagcctggcaacagagtgagacactgtctctcaaaaagaaaaaagtaaaagacttcaaggcttgtggtggggctcagtagctaggggctggtatcacctggagatgtcttaaccccacgtctgggggattctagctgttgctggggctttacctgggactggcagccagaacacctacatgtaccctttccacgtggcctgggcttgctcctagcatggtagacaggaattaggagctgctgatttttttaggcctgggcctgaaaagtagcaccacatcacttgtattgtatgctatcaatcaagcagtaacagagcccagatttaagaggaggggttattttgactggaggcatgtcaaagaatttggggaccacgttttaaaactaccacaagtgccattggcatggtttcctggaatcggatttgcctccctcttggctttgtctaatgcctggctctgctttatacagcagcccagtctttactggactagggcwctggggatgttcctgtcagggatcagtaacctcagagggggcttctgcagtgtcagtattctctctgtgttcacttgccactgctccttagagagttcatcattccctcccggagaagagctcagcggtccacttggtgcttccttagaaatcagcttgggggcagacaggtgtggcttccatagattcttagatgtgctttctggaattgaaaaggcaactcaatttatgctgtgactctcactacctttcacgtaactctgacaagctgtagggacctggaaaatctctatagatggtggcctagatatagccccagttgggggctgaggctgccctggaccctgttgagggctcacaactgtttgagatgcttgctttgggagcaagaaagccaagttgtgagtatcaccctgtcctttggctttttctcaggacttttctggaatgggatgtctatgtcttgttactgggcaagtttctgctctaggctggggaacaaactcttggacttgctgactgaggcactcttcctcctttttctcctccacgctcaagagtatggctttagggtagcgcagtgagaatgccatccccagaattggggcagtcactgagtggcaggaggatggtgatgccaccaagccaacagggcccttagtagagaagcccgagaatgctgaatggccggccaccttccaggcagtttcatttgaagcaggctagacattgcttagtagggatggaagcattttggacactgagccctgtataaccttcacctgcagacaggctcacttcatggcactcataacactcatggcactcatggtacctctcaggctgtttccaggactactaggactttttcccaactagctccagcttagtcccttcttgttactaacacttgtagtagccctataaccagaaaaagcagagcaacttggagcatgccaagttcatcaaggactaaagacagccttccctccagaaaagttcctcggggcacctgacaatatatgaggcattccttagcacaaatgcttcttgtgttactgaagaggggcctgtgttactgaagaggggcctgtgtcactagcccagggattggggcgtgttcctgtgagacagtgccagagggaatatttattatgcactttaactctcactttctgtctatgtgcatgcgcacacatacacaygatgctttttcttttcttgtttcttttttttttttttttaatttttgagacaggatctcactttgttgcccaggctagagtgccatggtgtaaccatggctcactgtagccttgacctcctgggctcaaggatcctcctgcctcagcctcttgagtagctgggaccacgggggcatgccatcacacccagctaatttttaaattttttttttgtagagatagagttttaccatgttgcctaggctggtctccaactcctgggctcaagtgatcttcccaccttggcctctcaaattgttggaattagaggcatgagccaccatgtctggcccacaatactttttctttaaatttatttctctttccataccttagctcatattctttccatcctaattatgtgtcttacatatttgtgtgtgtgtgtgcatttatggtgctctgtttcttttaaatgtcctttgcattctcccctgctttcttttatctgttcatcttacttcatctctccttaaaatgttggttttggccagttgcatgctgcagtgttggcatccatgcctgtgttgagcagcagaactggctgcctgctgacaaggccacggcacaagtgcccagttctacagtgtctgcctcccaggggcatactctgggattgtagaataacagagagatgataagagcagtcttgggtgtctgatggctgctttgtatttacttttaaaaattatttattttacctttatggaatgatttatagtgttcaaacactgttagagatttgcgtcatcttagccacacagctggtgtgtgaggacactcagagtaagtgttgtctgtgtttaaagaacctgaggcacagagaacttagagggcttgcccatgagcacacccagaaagtgatgggaccaggacccagccagtgtgtagctttcgtgcctagtgggagagggcttcgggggctgacggcgatactgggctgcaccgagtgcttcgtgtacctttctctgttgttcttcagctcatacaccacaaagagaaaggcgaggaagtctgcagacaatgttgtgagcaggcatacaagaggcctaggtttttaactatttacattttcattcatttagtcattcaacacaaataataattccttttaagttctaggcactttgcagggggctatcaagattaacaagatactgttaccaccttcaggtgggctcactcatagtctagtaagggagaggaaacagtctggtgcaatgcagtgttatacatgccatcacagatgtctccccagtggaggcctctgcataggccatctctacctgaaagggggtagggtgtgaaagagctaagagttggatgtgcctaagggtgggatacaggattgataaggagggaaaacaatgtgggataatgaaggggaaagtaggcagggaccagctcatggggtcctcatcaacaatgccagtgaatttgcattttattctgtagatatgaggagtttcaagcatgatcagtttttcattttgggaaaatgtcagaagatgagaggatggatcaaaactgctttaacactgaaggcagaaagaggagttaagagaccaaagaagtagcagtagcagyagggatggggaggagggggacacatctgagagatgttaggaagtagaattgataggacatagtcatcaagtagatcaatgtgtttggggagagggctggatccagatgcttgaagcaggaggggaacaaactctgaccttttctcccccctctggaatgagtttctctagagcgttaagtgtagctagagaagtccaagcgctgggacgttccagtgttttgaggtctggacgaggaagaagaactagccaaggaaaccgactgagaagagcatttagtgagaaaagaagaaaaccatgaagagtgatgtcctgagacgctcaagaaacagggagtgatcaactgaagcgtaaagcagcatagggacgagactgtgagagcagacgtccagtgcaggcacatgggaaagtgggtgctagtataaggccagcccttttagacgggcgttgggtccccacctcttcgttgcctactcaagcgtgttattcctgcatttgtgccctctgtatctgcactgacaacctttccctctctactggatcattccaattacagtcacaaggttggcatggtggttcatgcctgcaatcccagcactttgggaggccaaggcaggaggatcactggaggccaggacttcaagacctatctgggcaacatagtgagacccccatctgtgaaaaaaaaaaaaaaattagctggacctggtggcatgaacctgtagtcccagctattcatgaggctaaggtgggaagatggcttgagcccaggatttttgggttacagtgagctatgtactccagcctgagcgacagagcaagaccctgtgagagagaggaaggagaggaagaagaggaaggagaggaagagaagaaagaatgaaagaaagaaaagaaaggagggagggaggaaggaaggagagagagagaaaragaaagaaagaaaaagagagagaaagatgcttccattatgccatattcttctccagctaccatcccatttctttgttccttttttaggaaaactctaaaagagttgtctgtactctgtctccactgcttctcctcccttttcttgaatttttccagtcgtgcttcccttcctacctctctaccaaaacctctcttcgtcaggtcacagtgacctccatgtttcaaatcatttctcagtccttctcttacttagttgttggcaggtttgactcagttgatcactccctgtttcttaagtgtctcaggacattgctcttcatgttttcttcttttctcactaaatcctcttctcaatcggtctccttggctagttcttcttccttgtccagaccccaacacactggaacgtcccagcacttggacttctctagctacacttacgctctagaggatcttatttggccacatggttttaaatatttctatataccactaatgactcccatattgaaatttataacccagactctattctaccagtgctcaggccaaatatcctgatgctgtcctagacttcccgtttgtgtctcactgctcatctaacccatcagcaaattgcattggcccagccctcaaagtagatccgtctctaccagtacccttctgatccgagtcatcataataatcgtttgtctggattgctgcagtggcattctaaatagtctccttgttgccacctttgtacccctgcctgtcatcctctgatgtgaagtcagattctgtcactgtcctgctcacatccactcaagagcttccttctcttgagagtgtaagcccaagtcttatcagtggcccatggggccttccataatgtggcttctggtgtctctcaggctcatctccagcccacacttcattgtttccctccactctggccacactggcctccttgttgcccctggaatacagtaggcatgcggttatctttgccctactgcactttctgtctggaacattcctcccctggatagacacattgctcacttcctttgggttgtgttcatgtgtcccctggcaagaggggcttccctgacctccctatgtaaaacrgcaactcatctctactgctcatctctgatccctttccccttctttattcttctttattggcccccaaaccgtctcacagagttgatatgttacctgctcactctaaacaaataaggcaacttgatgtgtgtctaccagaatgtaacctatagaaaaagagactttgtctgtttttagtctctgctgatccttttttttttcttttgagacaaggtctcactctggtctcactctgttgcccaggctggagtgcagtggtatgattgtggcttgctgcagccttgacctcccaggctctagcagtcctcccacctcagcctaaaatagtgcctggaatagacttggtgctcaatatatctggttgaatggatggagagccaaaatgtatctccggcctggtggggttgcacactgtggtcttggtgataggtggcttccttcgttcagatgcagagaaggctagcaaggagctggcctaggaaccatgaagaagtgaagctagagactgtcagtggctttgctcccatggtggcatccgaaggcaggccctgcccttctcttggccgtggtctcctcttgtccaacaggggagaatgatcttactttccctccgagtctcagtttgaggaactaggaaacaactagacagagaggaactgaagcccaggaatgagcactctctcccatccatgccaggggatgacacctgctgtgcaaactctttgtcacgaggatctagacatcctgacacctggctcccattgtgtccctcctgaagcctccctagtgttccctctctaggtgagactctcctgaccctccttcagcctgggagcaaagactggtggaagctgattcttagggtggctgaactagctccacttccagggggtgcccccataagagcatcagagcctgtagtagtgagagagagatccaatccagacatcatggaagctaagctggcctgtggggaagtggggaaggaaggccagggcagtggctctgcattgggatgggatgggccaatgatacgcaggcgtggcctttcccacctgcatctttttactgctgccgtggagcaaatcaccccaaaacttagtggcttaacacagttgattgtttctcacatttctgtgggttttctggtggttctctgctggtttcccctgggcgcactcatgtagctgtgtccggctgggtctgggtccaaggtggcctcattcatgagtcaggcagttgtaggctggctattgayagaggtgcctcggtcacattccatgggacctctcgtcctctaaaagactagactggcttccttatgtgacggtgtcagggcagcattccaggtgggtaaagggagaaactacaaggcctcttgaggcctcaagtttagaatttgaacaatttcaatttccactgccacattgtattatactcaaagcaaatcaccgagatcaaccaagattcgagtgacggagcaatagactccacctttccatagcctgagctgctgagaattcatggtcatatttgatttactccccgccctcccgcccccctgccccgacagcgttcaggatccattgacagtggcaaactgaccaaatttcccaggtgattactctgaagagccagccccttgtgaatatgagtaattatcaagctaagatggaacactgtgtgttaggccccaagctcaatgcgcgacaggtactatttctcacagggattctctgagatatgtgatctttcttttttttttttttttttttgagactcttgttttcactcttgctgcccaggccggagtgcaatggcgtgatctcggctcactgcaacctccgcctcctgggttcaagtgattctcctgcctcagcctcccgagtcactgcaattacagttgcctgccaccacgcccagctaatttttgttatttttagtagagactgggtttcgccatgttggccaggctggtcttgaactcctgacctcaggtcatccatctgtctcagcctcccaaagtgccgggattacaggcgtgagccactgcacctggccgagatacgtgatcttccaacacccattttagagttaaggaaactgaggcttagggagagaagattacttgctcaaagtcatgaagcttataagtggctacactgaaacttgaaccccaaggctgtgatgttcttaccctctcttgagactgactggctagccataacctgataaaaaaaaaaaacagtactaatgataatgagcattttgcatccatggtctcattggctcaatatgacaaccctgcgatgtaaaatggaacagttttgaagaaatgaaactggatgttcagagtgtgagtccattgctaataagaggtagaatcagaaacatgcagacagataacagagaattctaccctcaagtgagaatgtcaccccaggagggcagggccttatctttattgtttaccagaccttggaatgagtgactggtgccttctctgtgatatggggcttcaggtcagcacaggcaggttcctctgtggtacagtgcactgggcctggcctgtgtggggaggctggggcaagggtagcacgtgaagccgtgggtcccaggtcagcagtgacaccaaagacaggaccttcagaggaaagggccagtctactctctattttatgctgcatgagaggggagaaatgaaacctcagttgaagcagggtaggcattgagagaaagttcttaacctgtgaggatttattcgtgctggagccactaagggaagttatagaatcactctttctgaaagcatgctgggatcagatggaccagaggacctgaatcattttcctatcccaaggagccatgccccacactaccataagtaacagtggttccatggactggtgaattctctcctgggccgctggggagacacagccctagggaaccacatatcaaagtgcctgagcaggtgaggcatgtatagtttaaaaaggcttcccaagagattgtgagtctcattaggtgcctgccatctcccagtagaatataagcttcacgaggacatgaatttatgtctgtgttgtttattcttgtatctagcacctagaacaggcctagcacagagtaggtgctcactaagtatttgtcgaatgaataaacaaatgaaattgtcctctgtcaaatgcatcttcagttgagaactaaaacagagtcctttgtgtagcacagacactcattcacttaggggctagactgatgaccttttgtatttatggttctataaaataagagagacctaaggcctccatgaactgtgaggaagttgggatctccccccgcctcaagcctggcgacttgccctgccgctccctaccccagggagtgcggaggcttactctgttcacacctcctcactgagcagagcctctttggtcattggcttggcttggcactgaatttctctcatctgtgcccatatacacatgggatggctcttgtttgacttgccctttgaaaaacaacttaagcatgttgaggtttcctgttgattgggggcagccagaggcctgtgacccagcagggaattgtcagccaatccctgactcacccaaactccagttttctgtgtgtgagcgagcagtgacagcagcctggctcaggggcagctggctgccttcctgtggatagcatggcattccggagcctgagaggctgggcagcccagagctgagggccacggccttagggtcaggtaggccttgtgctgtgcagtgttggcaaatcctgctgtttttgaactgaaactgtttggaaagaattctgaaagttgacagtggttactctagtagacaagtagaaaagtgtgcccaagaggaagtatgctcatggtgctcttcaataagctcacctttcccttccttttgctcttcatcattcaccgagcaccttccagacactatntgtttgtccctgggcctagaagaaaccatggtctagtagggaagaccaagaagtcccttgatacttacaagtgctgtggcaggggtgtgctgagtgctgtggggatttctcttgagntgcctcagggccctggcagttcagaaagtggcagaggcactgcttcctcttcagagagtcagcccagtgtagtggaagttcacgtcctggtttcacttaccagctgagtgacctcggatgagatattaaacctttctgtgccttagtgttttttatttgtaaaatgaagataataaacatgataacctcatagacttttcaggaagattaaatgagttaacatatgtaaaaacatttattcagaagtgttccttgtagttgccaagatctgcatatggatttggagctgggacatggtagaygccaattattggatgtgatgccactgctggagggtggagctgcctaaggagttggcctccccaccccattggcttcctcaatgatagagtggaaaagactctttcctgaggggcgcttctgacctgtctgaggccctcagggattctaattctggtcagaacccaacatgaagaagygagatgttatgtctagtagcagaagtcccaggggagacagaggcttgttaaagggaaagatcaaagggtctgagtgtatttgggggccacttcagggagtagtgttcaagaaccaccttgcaccagttcacaagagctgattagtggcatctcttctcaactccacagccagtgacgtcacattggtagctcagccatagttggaatatttatactaccaaagttggcaagtgctaccaatctgctgttgcccctagagagccggttgttcagacttgtttggttttggggtttttggtccctttttccctctttttaccatacacagagtctcactatgttgcccaggctggtcttgaactgctgggctcaagcgatcctcttgcctctgcctctctaagtgctgggattacaggcatgagccaccacaccttctgagaactggttgttaagcatgtggcagcacaccactgggctttctgtcctcttactggcagatgttagactcttgggatgctctcgcttggcacagaacaggtgtctgtttcagacattactcagggtgcctggggatggtttgggcagagaggcctgttgagtttggcctgctgtgattaaggagctattgctctccttgaagacagccttcaaggtatattacttgaatagaatactctttgagagtcctccaggaaaaagatgctgagttctgtaagaataaaacaggatgccactggttggtcagccactcactgccattttcttttcttttcctttgttttgttttgcccccaggtctcagtcagtctctccacctccagttctctccccaccaaggagtcccatctacccgctcagtgatagtgaaacctcagcctgcaggtaccccagccactccagctcccgggtgctcctcaaggaccggcaccccccagctccttcaccccagaatcctcaagatccctccccagatacttccccacccacctgtcccttcaagaccgccagcttcggttatttggacagaagcccttcggcgtgcaagagagacgcccaaaaggaaagtgtccaaggcgcagcccaggatgtagcaggggtcgctgcctgcctcccccttgcccagagcacgccattcccggggccagcagctggcccccggggcgtcttgctgacccgtaccggtaccsgcgcccacagcctgggcatccgggagaagatatcagcatgggaaggtcgccgagaggcgtcgcccaggatgagcatgtgtggagagaagcgggagggctctgggagcgagtgggcggccagtgagggctgccccagcctgggctgtcccagcgtggtgccgtccccctgcagctctgaaaagacctttgatttcaagggcctccggaggatgagcaggaccttctccgagtgttcctacccagagactgaggaggagggagaggcgctccctgtccgggactctttctaccggctggagaaacggctgggccggagtgagcccagcgccttcctcagggggcatggcagcaggaaggagagctcagcagtgctgagccggatccagaaaattgaacaggtcctgaaggagcagccgggycgggggctcccccagctccccagcagctgctacagcgtggaccgggggaaaaggaasactggaaccttgggctccttggaggagccggcagggggcgcgagtgtgagcgctggcagccgggcagtcggagtggctggtgttgcgggggaggcgggcccacccccagagagggaaggcagtggttccactaagcccgggacccctggaaatagccctagctcccagcggctgccatcgaagagttccctcgatcccgctgtgaaccctgtccccaaacccaagcgcacctttgaatacgaggctgasaagaaccccaagagtaagcccagtaatggtctacctccttcacccacacctgctgctccacctcccttgccctccaccccagccccgccagtcacccggagacccaagaaggacatgcgtggtcaccgcaagtcccagagcaggtaatgcatgcccctccggtgtgttgtagctgaataccgtggctttcttttaaatggacagtgcaaacacagattgtaggatgggtcgcagtcattagtgcttcgtaagctctgaagtgctgaataattgttaggtggtagttgtggtagtgaaaaatgagattgttctgctcttacaagatacttggacatgagtgggaatgcttacaggatacttgggacctgagtgctggtcactgaaggtattggctgggtttggcctttggggtagagctgggctgtgtcctgcccctgttgtagcttcctcagtcttctgttgggagtaggtaaagcaggcagtcctttgcggagtagtaggatcttagcctccctaccacctgaagtaccagcattagaaattaatttctttgaatgaagcattatctgaatactgcattttatcattaacatggtagtgtcggcaaatttaacacaattccttctctcctgaaggcctcctggccatatacgaaccctgggcctatatcaagaggggattattgggaagattgatgaaaaaaggagtaaaacaggaatgagcctgttccgaggctcacgttggtttcctggtcagtctcaggatttctaaccccagattaccaagggctgtctccccggtaacttggagctggagctattggaattggtgaaagctggcaggcgtcttgttctctgaatcagggtaggctgggagtgagcttccttgggaatacttatcctcctacaccttactgccattctcatctaaccccacgactgatgggtattcaggtttgtttcacttctggggattctttagtttgtccccacacttcaggcttcatctaacatatcccatctcatatataaactttcctgccatgtgcagaaaggaagaaatttcaaagattcagacccccgagccggaacagcccgtggctaagggtaatcccgtgtttgagtccaccccagaatgctcactggctctttaattcttaaacggcctgccaagagtgtttgctttgtccttgttcatccatttctataaacattcttctagagcctgctgtgcaccaagattgtgctggtcaagaggatgcagaggcaaataggacatggttcttccattcaaggacttcgtggtctggtgcacagataaatcatagataatgtcatacgtgccatgactcatggcagtgcaggaggccgcagagacccagagaaggggcatctgagttagatgggggagagaagggaggctcctcatagagggagttgctgagctaaatttagaagagccaaaagcagttggctaggtgaccaaagggagtggggggagagttcatcagcctgaaggttttacacatattccaccccacactgcatttatatataatatatacacacgtataccatatatggaggagtcccttcatgtaagaattaacttagcaaacttaaatctgtgctcttggaaaaagagaaacagttccagaagtgcagtctgttctgtatgccatttcacacagtgaacatgttccatgaggagtagagatggtaagtttgtgtctgttataccaagtgtgattcttatatttaatatacttttttattttaaaaaaaatgcagtccaggtgaggtggcttacacctgtaattccagcactttgggaggctaaagtgggaggatcatttaagaccaggagttcgagacagcctgggcaacataatgagacctcatctctacaaaaaatttaaaaaattagctggagtgttggcatgtgcctgcagtctcagctacttgggaggctgaggagggaggatagcttgagcccaggaggttgagggtacagcgagtatgatcacaccactgcactctagcctgggcaacagcacaagaccttgtctctcaaaaaaatttgcgtgtgtgtgtgtgtgtgtgtgtgtgtgtgtgtgtttgtgtaaaatgcaagccaagccaaatgtttcttctggcattcagccaaaaaaaaaaaaaaaaacctggggagaaactattagttttaatgagagacagcatgttggtcctcagtgtgacaccttcctgggggattttcaaggataatttgactgaacatgatttgtgtcttatttactgacttgagggctacctgcatacgatgctgagtctactgtatatgccaaagaaaacttgctctcacactaactctggtcctgggccaacatttgcgaaccactgtgctcagccattggatgtttaactagttgagaatctctgggccaaagacagaaatctgggagtcatcaagatagagatggtagatatggcaatggcccatggatatttggtccctagaaagtgcagagtgagaaagagtttttaagacagaactctgagagacccggacacttaaaaggcaaatggaaaaggagaacccctcacaagagtctgaaaagtagtggccagagagttagttgaaagccaggagggaatgtgtcacagaggcacacggaggagatgtcaatataaagagtgttcggttgtgttgagtgcttggggcggggcaggggcaggcaagctaagaacaagctgtagccttcaggacacttttagccctttacctacaccctaggactctcaggagaagctgttagtaaacaagagaaaaagggctttattggctgaaaggtctgatggtgccccaaagaagagggaggtgttcatgggtgggaggagggatccagtcagtgcctttccttctttccctccccaggagcctgcggggacttgccttggagagggagagggtacagttggggtctcagatgagggacgtacctctctcatgaaggagaggggcagagagtgctgtaggctcagggtgtcttaggagacaacaagctgtggtcttgaaattatacagtagagaggaaggttgtccaaaggatggaaaggagcaagctagctgaagggaagcttggtcttggaagcagcttctggctgcaaattgtcctcccagctccaccttggcagtggtcttatttgttttaagggctcagcccttcctgcttcaacaaaccacccagcaacaactgcttttccaaccccctgacagccctgagtgggaccctcccagtgttgagccttcctacctgcttagtgcagtggcaggagtccccagctaggatgcagatgaggatgtgagactccagaggcagaccaggcactcaattccagtggaatcacagacacttctcaaggaggatattctctagggctcaaggccaaaattatagttaagagctcaggccctggagtgagacgtcgcctgggagaatcatgcctctgtcacttccatctcctctttcacaagatgtcccaatactggtggcactgttgtgaagattaatgagataacacatgtaaaggtggatttgacgcagcacctggaacagcatgcttttaagctggggtagttgttatctaatagcggtattattcaggataaggcacattgcaggcacccaggctggggcctttcagaccatctgtctcttcatttggatggtaagtttggacccaccttgatgctctttcagaagctgcctttgtaaggagggcctatggtctttgctgttgccatggacattccccagcaaggcagcagagatctgattcagcaggaatgactcttgctcttgttatccacagaaaatcctttgagtttgaggatgcatccagtctccagtccctgtacccctcttctcccactgagaatggtactgagaaccaacccaagtttggatccaaaagcactttagaagaaaatgcctatgaagatattgtgggtaagcaatggcagaggtggcacctgggtcatctcagggggctgcagaagaacaggaacaggaggagacacctagattgacctccttcactgtgggcaggcatggtcccaccttctggaactcctcctggaatgggacatcaggggaagcaccttagcttagacagagtggctttgtgattaaaagcctggctcttgaatgaactgaaatccaaaggacctttggggacacgagaaggagaaaacaacatcattcctttcctttatttttggaaggctttgaagtccaacaggccctcttccttagctgtgtgcccttaaggcaaatcacttaacttttgtgaagactctgtttttctcttataacatgatgatgtgactatattaacaacaacaataatagtaataatatttcgagccgggcatggtggctcgtgcctgtaattccagcactttgggaggccgaggctggtggatcacctaaggtcaggagttcgagaccagcctccatctctactaaaaatacaaaaaattagctgagcatggtggcaggcacctgtaatcccagctactagggaggctgaggcaggagaattgcttgaacccgggaggcagaggttgcagtgagctgagatcgtgccattgcactcctgcctgggcaacatgagtgaaactccgtctcaaaaaaaaaaaaaaaagtaataatatttcataaggttattgttagaattaaataagattgagtgtctggtgcaggcctgctacctggtcagagatggccatcttctttctgtgttcttacatggtggaaggggcggagggagttctctggggtctcttttaaaagggccctaattggtgaaggccctgcactcatgacctaatcacctcccagaggcctcacctgtgtttccacataggaattttgggggacagaaayattcagtctattgtacaagctaacacatttcattgccccagtttcatggtgctggcagaagacacgagacccctgggtcgcaaaggactttattacttatggcacagtaggcagcatgagcttcgtgttcacacgggtttccccttgtgcctaagtcccatggggcggtgtggagaaggcccaggtggaagctgcacacactgcaggtccatgtcccagctggggagcccaagcgtaggaaaccccagtcttttcagagactgctggcaaacctgcctaacctttgtccttggaggagacattatctttatcactctggtcaggaaacaaatctgcctctgccctgaagggagacactatctctgtcttccaaggctgtttgctgtataaataccctttaaaatacagtctggaactgtcagttcctcttgttcagaagaagggcagaaatgcgagactccattgggatttgtcttccaacaggtgggaagacatggtattggcaaacttgtgttcacagatcagatgaaagatagaatgctctagcctgggttgcatttgttttgttttttggcgttcatttcaattctattagcatcctcatcagtaaggggctttgattctgcccaagtgaagtgtgcgtgtcagtgtaggtcagtgaggaggagagaggctgtgtgctgcctgcttgctggctccctctctatgtccctgtcttgcctctgtcttgggccttgaatctgaagaatgtggtgttagttaatacatgagagagagaagtggcccagggtagagggaaacctccagattatcagaagcctggaatcttttttttttttttgagacggagtctcgctctgtcacccaggctggagtgcagtggtgcgatctcggctcactgcaagctccgcatcccgggttcatgccattcttctgcctcagccttcccagcagctgggactacaggtgcccgccaccacacctggctaatttttttgtatttttagtagagacagggtttcaccgtgttagccaggatggtctcgatctcctggcttcatgatccgcctgcctcggtctcccaaagttctgggattataggcgtgagccagaagcctggaatcttatgaagagagggccatctgttccctcatttgatctgagccattggtttcacagccgtttccttaccacttgctgggccattgtttctggggagacagcagccatgctgggatgtgcagggacactgctttcccaggaacagagcgtatagtatgtagccatgcaaaactgggtcacagcaggaagactgtgggaatgaggtccctagaaccgcaaaagagtttggggagggaggccctttcccttaccactggggaaaagacagctttgtacctataggccacccagagcagaggtcaagagctaggggcatcagaacaaaagatccagaagccaggtgggcagttaaggaagatgccccaactgcagcccataccccagttctactcagccacccaagaggcagccartgctgttcctgtatttctcacctccttatgcaagactaacatcccagagtggaagaaagtcctcccgnatgagtgagtaggcagaggcctaganacacttgccctcctctttcccttctctcaaacctgacctaagaaggcctggggaacagctgtgttgcccagaacagttcttccaaaattctgccccccaaacattgccccaaaaaatcctgaacagagccctggatggtggaactctggacagagagaaatggttgaagccgtccctttctcaaattatttcagttcagatgatccaagaacgtatccccacaggaaatccttgtcagataatagagaatgggaggaccacaggattgccagcacccagcatagtcaagggacatcagaaaaacacagccctctctgcccacggcagcagccacactgggtgctcccagggtcctgggcagcaaactgacacattgcagtttctgccaaactagaatgtaccctgcaacaggaggtagggagggggtggggcaacagagctgcctccccactcattagggaggactctcttccactctgggtgttgcatgaggagttaaaaaaaatatgggagcaccttggctgcctcttgggtggctgagtacagctaggggtcagcgctgtgtgggcagaaggtagaggtagctgctcacctggcttctggatctttggagcacttagagaacagggaaagaagagagggggaggatgcaggagaaagggaggggagcgacccaggcaccagtttgggaatatactgcatcggatgtttaggttttgctttggcctcgtggggtggtgggggtggtttccggagtctgcagttaggacagtgccctgtgcgtgttttccctttttatgtccccatagcagcccaatctgaatttctgggacctgactagggaggccagagggaaatacagaggaaaatactctctttctgttagattctggtgggtttccttttccttccctggggacaggcccgagagtttggagctccccacaaggcttcagggggtgtcttattgctgaactcagaatggcagtttcccgtcttgcttaggactgatcagtggctcggacttcctgggagccgtctctctggtcttggcccagcctgtgctctgtggggtgaaggatgactctgaccccgctggatcaggctcctgcaggcatgcaggaatggagctgttgggaggcagagagcctagtgctcatctccatcttgggtcctggtgattggactggagtcctgtctgtcataggtggagggccagttggccccaagacaaacatgtctgtctgtgaacagtggactcgaatgggggttgtggagggtttgctggcctcctgcctacactaggcatgatgcctgaggagctggggtggggtactcccaaacatactgaggtttaccttgctaacttgcagaaaaggagttcggaaagaaagttactgccttgctgcttccagggctgctatttcccgcctgtcccatctcacatctgcccctggaagatgctgctattctacmaggccttatgtttgcattctgagcctgacacttaaaaatgcacccaaggaagcagcttgttaaggaattatgtggagtggcctcggcgcctgagctgcattcctgcagattcccactcccatcagctagcmtgggctgagggagcgtttccaggaacttcagtgggatgcaagccggggaccgggccagtcagcctggactgcaaagtcttttgagcctccactctctctggttgcttcccttatttgcccccaggctgggaaacagtaaggagcagagggcacccactgggatggaggttgcagtgggaaacaaaacagccaagaggtgcagcccagggaaggtgccggggctgtcgagaaatggtgtcaaggcttggagggtgggcaacagccagccccttagaggccccagtctgatctgttgccagggagttgggctcttatcctggccctttctgtcctgtgtgagagagggaaaaaggctgagaaccaggagaaacagctggttggaaccggaggttgttggggagggaagctgcagacccaggaccctagtaatgggtgtggtccaggaagcttaggactgtgtttggagaaattctcagtgcctgtgcgtatacacacacccctttcctaactggtttttccagttaggttggggctgggggagtgctgtatgtgtggttaagaccaaaggagttatggggaggagtgaaaggttgtggagaggagtgggaggttgtagggaggagtgggaggttgtggggaggagtgggagcagggcccagaggggctggattcttcctttaagaggatttgtgtgacacctttgggctctgataatccccttttagaagagtgcaaagcagaaattctcggtgatgccttttgtcccttatttcatcatccaagctgggaaaggttgagacctctggcttctccagctgggcttgctgagggccaggccttcagggaagagggtccacctcttcgtccctctccaagggtcatgtggactgtcccaagaaagctgtgtgggcaggaatgcaggtagaaatttgcagtctgccaggctccctgtctcccattcatgcccctgctgaatctcccattcagccttagctcctttagctctgtcctccctaggatgttctgcacaccatttcccagcctaccgtctcctccaactctgagccattcctttgatacttatttgctctcagctggttcagtttagtggtccaggactcagggtccacttgtctctgtacatctccatcccctggtcccctgtccacctggagagatgactgggagaatctatttgagacagctcctccggggcagtcaggaatggtccaggaagctgagagatgagttagggcagtgaagggaccaagctgaggctggggaggcagcgtgtgggctgcagccagccgtctatttgctggagaactgattagtggctttgttacattagacaggatgttaaacattgctggagaagagaggctggcacaaggggctggggaggagcaggccttcctgaaattgagtttccagagacaggacctatcttgagaacctgatgttgctggctgttttcccctgggttgtcagtgatgtgcaccaggcttgtacatctattacttccctgggcctcagtatcctatgtctttttcttggagctttggattttgtatcaatattcaaagctcttactgtagggaaaagaaggaaggaaggagggagtgaggtgaaggagggaaggatggaaaaaaaagagggctagtcttgggactcatgtcacactcagaagccattggaagtttagaaagctctatctaaagcagtggttctcagttgggggacaacttcactcttccctccctccattcctgcctccctccctctctctccctccttccctctgtccgtcccagagagcatctggcagtgtctggagacatttttggctgttatagctaaggagatgctaatgtctcctggtggatagaagccaaggttgccactaaacatcctaaaaatggacaggacagtctaccacarcaagaattattcaaccccaaatgtcagtggcttggagaaacccctgggattgggacaaggcttcctataggttggggatgacaataaaggccctggctgatcatgcagtccaaggcagtttcgatttgttgagcttggcataaatgttctccctgccgtgatgtggacagtgatgctctggtcctgttttaggggatcagaagactgtgtcctggcattctcccttcttagttcccccacctcctcactcctgcagggcatatgttggggaaggatcaagaagtagagaatccatccccaacacctccctaagtgccccacagtggggtaggctggagaaaacatgcagggggtgccgggtttgctatttggcttcttgcgacagggctgctgggccagctccgcttagtcagggctctggaatggagacaagtcattttaatagcatgactgtgttacaggaaaaggtctgttccattgctggggactctgcttggagttgggaatcacttaatccagtcccaaatcccagtgacccatctttgactcataagtttacagagatttatattgctcccactgcagtctatttagctgtcactgaaatccctccttcacacccacaccctaactctgttagagcatttcctaaattcgttgtggttctgcataagtagatgccacaatgtggagggagctccactttggaaatggaggaatctgcaagcatatagggattggctcttctcccgtgtcctctctaggaaagcttcactctcagcagcctttgttcctcgtcctccagctccttcttctgcctgcttcctgaggagtggggtctgagttcctctggggcgtaaggcacattcagacatctgtagaacaagtgtgggactcagtggcacccaggctcaatcctgctgctgagcagaggtgctggagtgagtcctgctctgcagcaggaaaatagggaaaggggtgcagagagggctgtgttctgagttccccagggacctgttcaccccacggattctgccaccaggattgagctaggactgacccggcccatggtgttactctattttagaaaatgtgtgtgttggaggggtgggggcaggagatacagcttgtggaaaggagtgccactcaacatcttcaagggcagggattctgttttggacttttctgagattttctggtaatgccaatacaatgcccgctgccagagattttagaactagtcctgagaagcaagaactcccctcacccccaccctttggcccagactccttccaagcctttcacacctcccctgtgtcacagcaggagagtttgttccaaaaggggagtgttgatggttctctttttgctgagatcagcggtagagggaatagacactacagtaggagagtcatcgaacagatcattactgaacacttcctccttgctaatcactgttccgttccgaggttgcctcagtgaacaacacaaaaccctgccctaaaagacttgttgaacggcatcgtaggtgagaagggggcctggcgaagccctgctccctacggttctgtgagttcctccatgcccaccctccaaagtaggtccccagggagatcccctgagagttgggtgaagggacagccatgtgacctgaaaacccttcctaccttgaactgtgttatctctggggtgtttgcagcagagggaagggagccaaggaaagactcttgttgctggctttgtcctctggctgggcacaggcaggggtggctgagccagtcttgtgcaatccctgaatttataaagcagaggccaggctgagctgggctgggggtggggggttggggggggtgggggcgtgggggggtgagcacatctgattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacaggtaactcagccctgacatcggcctgtagggttagcgtgagggccacagtgggggcctgctcttccaagacttgggcccagcttccactcaggcttttaccctcactagtacttgataaagggtctacggccataccaccctgaacgtgcccgatctcgtctgataaaggaggtctcctcagcaaaggactgtgcactcaaggatgtccaccatgttgaaacctctgtggacaattggcacctgctctgaggggcatcctgtcctatcttctttcccttcctacacaagctctgagctgcaaaactcagccaggagcccttgcagtctcctctctgattatttatcaccctgtgggaaacaggaagacagggccctagtgggagtcttggcattctgcaactctgccagaagtcatctcagtactggcattagggggctaggtgtrggtccccaaaccacatttggagagccagacaggtgtctgtgacacctggagccagtcctgtgggagagagtaagcatgaatctttaaggaatggatggggagaaggcagaatgacaggaaaggtgaaaagccaaaggaagctcttggacttcagctccttctgtccttgtccaggatgtcaggaggcaggtggagaggcttctctgacctccccaggtaactctaattctctttgcaaatggaaggacctggatattatatagcattggccagataatataaaatgataatataaaaatgatttcttctgsctttggaataaggtgtttgtttttataaaagatttaccccatagctgggagtggtggctcacgcatgtaatcctagcactttgggaggccaaggtgggcagatcatctgaggtcaggagttcaagaccagcctggccagtgaaacctcatctctactaaaaatacaaacattagctgggcatgatggcgcacgcctgtagtcccagctgcttgggaggctgaggcaggataattgcttgaactcggaagacggaggttgcagtaagccaagatcgctccactgyactcctacctgggcgacacagcgagactccgtctcaaaaaaaaaaaaaaagatttaccctctaattaggactcttttcaaacaggcttcccctgagtttgcattgccagattgattgggtgagaacaggaaattgggggctgtggaggaaggaggatttgctgaggagtgaggagaggcaattccagaaccagacagtggttgggtgtctgtgggatacttgcctcctgacagggtccgcgacaaggatggtgccctgggatgagaggtcagcgcatatggagagaggcagagagtagatcagggctggggagagggcagccagggccttgtgggtatgggatccaattcagtgtgaggcctgcctggcccagctttggtggtcagagcccagagcccctgtgttctccatgggagcagttaggagggccaggctgcaggatctcccagcccagcaggctggccagtaggttatggcctctgctgtcagaaacctttyaggattggctcgggagcagaggtccngaagactggttccatcacccaggcccagtaattcttgtcccatagctcaggargacccccgcaaaattcccacttagtcttctttttccactcagatgagagcacaggtgtttttagcctctgctttcrttttttgctggcagtagtgaagcttcctttagggaaggcaagtatctaatctatccctgacctggctgattagcagctaaagtcttaagagagggatggaagttccagggcaasatggcggggatccagggatgccggcccttggcctctgtgtccccatcccagcagacagacactggccaaggcctctgtggcaagcccctctcgcacgtcctctcccccacgccagctttccctgaaacccaacagccagtccctgcgcagtgggaactggtcagaaaggaagagccaccggctgccacgattacccaagaggcacagccatgacgacatgctgctgctggctcagctgagtctgccgtcctcaccctccagcctcaatgaagacagcctcagcaccaccagcgagctgctgtccagccgccgggcccgccgcattcccaaggtaccctccccagaggcagcccactggagccgggcaggtgggcgggcaggcagccagcctttctctctctttcctggcttccttccttccctaatctggactgcttcctcgattccctttgaataaattctgggtccgtgcactggcctctttttcatctgattaattcccctttcttatcaataaagatgcattaactgaccttggtgctcagatgttagaggaaggaaagtctagccgaggttccccattagtaagtgtggtgtatgaattttggggtatccgcacacataagcatttccaggctttcaaggacctaggactcaaacaagggttcttcctataactctcagcattgaagaattttcagcaatgattttcacacataggcagccaggcccaaatccccagcccaacgcagcaggatttagccagatggtatttttaacctgcaracaatgcttgggtatattgggaatttagcttcttcctgtcggggccccaggttatggcccagaggggaaaggctagaatccttgttcctgttattgcatctcagaggctctttgtctcagttggttcaatgactcttgggacccaggagctaccatcctgtctagtttgatcacagttccttcctctggggagctaagtttagtgtccttgtcttggggcaggagaccactcctgggggactaggtatatggagagctaccatgcatggctggtgagtcaccacttgaggtcggttctgcagttagaccagtcctggacccagcgggtgcaatgcagaaagcttgtaccattaagggcagggatgggctcctactcagccttcttggaagtagggcagctggtgttaaggttacctcacccatcctgcttttctcacccagcttgtccaaagaattaactccatctacaatgccaagagaggaaagaagagattaaaaaagttgtctatgtccagcattgaaacagcatcactgagaggtaggctttggtgccagagctggttcagctgtttggggcccttgggcattaggaacgggagaggcatcaatttacctgtggagggtagagccctgccaggaaatggccacntaggmgggaggagcagacagggaagaaaggtctgggatgggttccttcagactttgggctgtgaggccctgagcagggaggtgggtgtgggaatcggcttytgcaaaaggaaaggccagactcactgagcattgcggtctgtttcccatttcaaatcttgacctcctggaggcagggtccatcttttccaggcctgtaggcccctcttctggctcagcctccaactcaggccctcagcttccctcatgggtttgaatataggattcgcagtgtgagctctgaaggagcctggccccaggccactcagctccctgcctgcagatgcctgaccatgggcccagagtagcccagagaaggtagagatccatcccctgtgagaaaagytggggtggtgggggagcaaaaaacattggctgtgaggtccagcaagtatgtactctgctgttccttttccagatgaaaacagtgagagcgagagcgactctgatgacaggttcaaaggtgaggcacagctcccatgagtacggaagctctcccagcagggctgcagggaatcagccttcccttccgatgcatgtgtggttccagtgtccctaaccggcctgatgtggagaggtgacagacaggccagataccagaacaatagagcagggagccacagggaagtctgtccttatagacatgtgagctcagccctgcaaggttaaatccagatgtctccctttgccaaatgtaagggtggtgacctgcccaaactgtcccaagccattgtccatgggagttgggtgctagatttgcctggtaaatgttgtagatctcagccgggcgcggtggctcatgcctgtaatcccagcactttgggaggccaaggcgggcagatcacgaggtcaggagttcgagaccagcctggctaagatggtgaaaccccatctctactaaaataatacaaaaattagccaggcacggtggcgggcgcgtgtaataccagctacttgggaggctgaggcaggagaatcacttgaacccgggaggcggaggttgtagtgagctgagatcatgccactgcactctagcctgggcgacagagcaagactctgtctcaaaaaaaaaattgtagatctggagggtcagagaggggtacagaagattacaaggacctcttctggcaagaaatgtgccgtagactgaggaaactgtttctctggaggccctgcagtcccccatctcccctgtccccagagaggagcttgaaaaggttctggaaccttcacattccagggtccttggataaatctttgtgctttctctactgggaaaccctgcctaggccttcctggatgattatcctctcatccccaggcaaatgggcaagtggactttggatgtaggagcatgtcctgctaggggcccaaggatgaagccttcgtggatgttcgtgtattctagtccttttggtacagggacagagtgggtgccaagatacatccctgggtttgcctggcctcggcagtcctcctgccccagctcagtctccagaggctccaggaggaccaggcccgcagcttcctgtgtcagggcagagtctttgtgcaggggtcagcaccttgtgcctgccggtcctcctgcactgtgagctggggatggtatcagactaggctcacgtacttaaaagtgctccacagcaatggagccctgagccaggggtagaggagttaacatgaggcctgtgagggtccattccctgatgtgcaacctgcctccagcccacacacagcgcctggtccacatccagtcgatgctgaagcgcgcccccagctatcgcacgctggagctggagctgctggagtggcaggagcgggagctttttgagtactttgtggtggtgtccctcaagaagaagccatcgsgaaacacctacctccccgaagtctcctaccagtttcccaaggtgaggccttctctctccccaccttgcccatattccccctcttccatcctctatccgccaggcctatctggggaaggagagagatcttgttcgtcatacgtcctcaccgagctgccacagccctgaacctgcctcctctcagccaggagggaagacagggctgcagcgggggtgggtttgggccagtgcttgttcaaaggatgaggactaagaaagaacctctcaatgtgcttataataaaatccagaacaattgaataccatacagttcacccacttaatgtatacagttcagtgtttgggtgtattcacagaattgtgcaatcatcaccacaytcaattttagaacatttttatcaccccaaagagaaactctgcacccactagctgtcactccgcacttctcccaccagcctgtctctcactccgccttccctgcttgtcgccagccagcctggcctccctcttcttcctctcacactcaacccytctctctctgccattgcctctgccaggaatgtgctttctccagctcttcacgtggctgctggctccttctcatttctcaggctctgctcaagtaggacctctttcaggaggtctgtccagacacctgcatggagcccctcccctgcccagcttgctctggtacataaccctgcttattattttatttttttattcgagacggagtttcgctcttgttacagaggctggagtgcaatggcgctatctcggctcactgcaacctccgcctcctgggttcaagcgattctcctgcctcagcctcccaagtagctgggattacaggcatgcgccaccactcctggctaattttgtatttttagtagcgatggggtttctccatgttggtcaggctggtctcgaactcccaacctcaggtgatccgccagtctcggcctcccaaagcgctgggattaacaggcatgaaccaccgcgcccggccaccctgcttattttttttttaagccccgctctgagatgttgtggttgaccatctcactctgctgacragaatgtgtaaggtcggggaccttgtcccctttgttttccattgagagccaagagccctggcgcatagcaccgtgtcagatgccatatagaaagcactccgctggcatttattgaatgaatgaatgatgactctgggctctgtaagaattcggagtgggacaagggttgctgagatcatgcccgctagtcagtggcatctagggccctcaggggaggaggggcttctcagccaccaccacccgccctcaggttccatgtcatctcctggttccttcttccctgcagctggaccgacccaccaagcagatgcgagaggcagaggaaaggctcaaagccattccccagttttgcttccctgatgccaaggactggcttcctgtgtcagagtatagcaggtgaggcctggcctggcctgagggaggaaggagcatagccttctttacccccatagcgtgggcacctgagtggggcctgctctagtctcatcctctcctacagcaacctggcccttcaccccacgtgaaaatgacggtccctattcttgggggctgtttcctaggtcctctcacacctccctgatgccagacctctctttgttccagtgagaccttttctttcatgctgactggggaagatggcagcagacgctttggctactgcaggcgcttactggtgagtgaggccattcggtcctcaggccagcaggcaggggataggccagggtgtgtgtgtgtgtgtgtgtgtgtgtgtgtgtgtgtgtgtgcccttctgcaattttagcttgtatgaaatcctatgttatgcttcctgaggccaccccgaaccccctgccaacacacacactttcacaggtgaggctaccctgggagagcagggctcagagtggtgcttctgagggggccttaggatcggaggttatctggagtaaggggagggagtgggttttcatgtctttttagtttttctctactttttcgtcatttcccttgggatcatgggctctgattgctggtctctggttgcaggatcgaatcgcccccagcagtatgtgtatatgcatcagattaggtgagggacaaccttcctcacccccatacctggccagcctgtagtggggaggaggcctttctgtggtgtggtggggctggagattgggcagggacagagacataccttctctgggaatctgagagagataccttgaatctaggggaaagggattaggttttgaaaatgttagccattttgtaaagagaagtccctcaccatttcccttcccattagtcctgggaaatagattgggtagaggctcagagcctggcccctgctgcactcccagcttggagctactgggttgttgacaatgttttggggtttccaggccttagcaagagaaagcctccccagataccagtctaggggtagatgaagggggcaggagccctgaaggaaggatttggggccggccattcattcattcagaaacacttatcatcccttatcagaagccctgacctattgagagtcaggcacgtgctattgagagtcaggcacgtgctcatataaagatgagtttaacatggatctccctctcgaggaactttagatggcctgttacaggagattggactttcaacacaggagggaagggccaagggaataagagggaataaatgttgtttagaacctgtcacattccaagctagatgcttcaagtatgtcttttaaaagaaaatgatcacaatagcccatgggttattattatccctgatccatagattggaaagtcaaaactcagaggtagaatgacttgcccaaggtcatacagaaccagaagggaagtcgtttgtcaccaatttgtactcttggatcacccccagaggatggactggggagagggggcgtggggaggtagaatgcccatggaggggcaaagggcgtatgcacaggagtgatgccaggtggtgagccaggcagaggccagcatgcctctggccgcctgggcctcccaggcttggaaggagtgttgcgaaggctgcctttgctggaacatagatggagcagagctgctcctttgtagtggggctgctgcccccagggaagagcgtgtttgtcctggcgtgctcagagagggcctgggctgggtctctgccaagggggctggcactagctcggcattcctgcagattggacacaatgattctgatccaaatcccacatacttgatttaatcacttggggctttaggggaggcgggggagagggaaagagacaggagtgagtttcaggcctaatatggacaaaaacagattctgccttctctttagatctgtgacgtgtggccagcaggtttggagactgaaatagccccatctgcatttgcttagcagcctgcacgaggggccagcacctgctgctctgctccctcccsactcggacttgccaggccctccaggcctctgagtcctgctggagaaggcactgcagcctgcatgggggctccgggcctgggagctctcagtgcatgtctcccctttagctacccaccttttttttttttttttgagacagagtttcattcttgttgcccaggctggaagtacaatggtgtgatctcggctcactgcaacctccacctcccgggttcaagcgattctcctgccttagcctcctaagtagctgggattacaggcgcatgccactatgaccggctaattttgtatttttagtggagatggggtttctccatgttggtcaggctggtctcgaactcccaacctcaggtgatccacctcccttggcctcccaaagtgctggaattacaggcgtgagccaccgcgcctggccatgcctaccttttaagtcccattcttcttttgctcctttactccatagcaaacctctacccagtgtctttgttttctttccttcctgtcagaaagcagcaggctttaggggtaagacagccaaacagggccaaagcaaactcctggctccacagcttctagataggtggccttaggcaatggctttatctttttgaactcagttgcctcatctataaaggggataataatccctctctcacaaatctcttgtaaagtcccaagcccaggagtcaggtatagcaaatgttccataaacagtagctcccatctcttgttttcagtttgctctcttagaatggaggtggatcaagaaagggagaaaagaagcaaaaaaaggaatggtatgccgaatgtgccctatggggctaaaaagctacaatggcttgtcctaaggatgtaccctagtccttcccatctgctggggtcccagcctcagggctatgaatccacagacaccctgtagcctctgccaaactgctttgccctttgccagcccccgtcagcgtcctcctgggaggaagggtggagcctgtgtggagcctggcaggagcctggtacctggtgctgggagaccctgcagagctgaggcctgtcctgagagtggtggctgttccttcagggctctggttgcagagaggtttagaggaggcttaaagtcttcctccactagaagggcagtccttactcctccgttcccaaggaaaaggagccagaaatggtaatcatgcattctctgtgtctgtctctctcctcctcctccttgtcctggcccagccaagtgggaaagggccccggttgccagaggtgtactgtgtcatcagccgccttggctgcttcggcttgttttccaaggtaagaggctctggcaggcttccctccccgtcccccagctgacagctyccacaggagtatctgcagccagcttagatgagaaaaccacctgtgactgtgagcgagcgggagacagaatgcaggaacaagtaccagtgagctctctgacaccctcccattccccggcctggttctctacccagctggctggcatttccccagctcctgtgctggcagtgtctgcccctgtcacagcccaccctgggccctaggcagagccagagtccttggggaagcaggagcgcccagggagctgactcttgggtggtatttcctttgcccagctactccgctcttggggactgaagcaaggccagttagggaacagaggagtcactgagtgccaaggaaaacgggaagggtagagtgtgcagatcatggcaagaccaccttcccgtctcccagcttctgggctagcctggtcagatgcttggctgccctcttctctgccaggagggggaagggcagtgccctgacacccttcctctttgggctgctggcggtgggcacaggtcctagatgaggtggagcgccggcgtgggatctccgctgcattggtctatcctttcatgagaagtctcatggagtcgcccttcccagccccagggaagaccatcaaagtgaagacattcctgccaggtgctggcaatgaggtagggatttctgcaccctcttctctcgggctacrggctggggtggcaggaggaccatgctggccaaggtcgtagtctttgggggttgcagagcacggtccctccttgctcaaccatgtctgtgtaccccatcactagggaccaaaagagcaaacaataggaatgtacatgttgtccagccctctgttcctcccaggggccttccctgacccatttggactaaactgcattccatctgccttccttttgttcattcattgaacagttactgaatgtgtgccatctcacaatcagggattgcgccagacctcagagcagagtcagaggtagagggacgtggctctgtcctcatgaagtttgtagtctagtgggagatactgctattataaacacttttacatataaatagataattcctaaatgtgttacaagccaagtgaaagcacaggaccttatgagagtgtgaaacaggggagtctgctttaaataaggggccagggaaggtctcctctgagaaagtaacactttatcagagacctaagtggtgagtgggggcaactaaatgaagcaggaggagggagatggaaagagaaggatatgaacgggagaagattattccaagtagaggaaccagcatctgcaaaggcaaaagttgggcaagtgcaaatgctggtcagagggttgatggggtgggggtagaggggtgggttggcaggcaagaacccaatcacgatgtccctgctaggccaagttaaggatttggggttttatctaaagcaggggtatgataagatctgacgtatattttcatttcattttatttttttgagacagggtctcactctgccacccatattgtgcagtggtgctggagtgcagtggtgctatcatggctcactgcagcctcaccctcccgggctcaagcgatcctcccncttcagcctcctgagtagctgggactacaggcgtgcaccaccaaacccagctgacttttgtattttctatagagacagggtttcaccctgttgcccaggctggtcttgaactcctggactcaagcaatcctcccacctccccctcccaaactgtagggactacaggcgtgagccacctgtggccagctgatacatgtattcaaagcccactgtggctgccatgtagataatggtcggagtgaaaacggggagaccagcagggatactgttgtggcactatgggtaagagatgatggcagctttggattaagatgtggtagaacaggggaagggaagtagatggattttagaattaggaccaatagcactttgcgtttgattggaaatagggagtagttgttacagagactgtaaggctgactcccagttttctggctggagccccagggtagatgatggagccatgtactgagatgggagctcgtgaaggagaagcaggtaatgaggaggaagagcaagagtccaaatgtgtacatgtcaagtttgagatgcccatgagacccccaagagaaggtatttagtagcaaagagtgtaaatagggaagagaagagagcccagtatggggtcctcctcagtcctggggaaccccaacgtgcagaggccctgcaggagaggaacactcaggagagggctgcggctcaggagcacctcaaaaaggaagccgtgatccggatcaggaaccaccaagaggtcaggatgaggcgtggcaagatcttgacaagtgcaggggcccagaagttgggctggagtgagttgagaagtgatgggtgtgaggaagtggaaacagcctgtgtagacatcttctcaagattgcatggctgtggagagaaatagggaagagggcagcaattgaaatgtggaactagggaagcttgttagggatggtagtttgtatgctggtgggaatggctgccagaggaagaggtttgagctgcaggagcaggaggggctagcagagagtactgagaagatgtgggtgttaggctccatggagggcttggtgtttattaggagaggagggagtggcttagtagattttggattctcatctgatggctttgattttctcaaagtagaaaaggtcagaccgggcaccgtggctcatgtgcttgtaatcccagcacgttgggaggctgaggcggggggatcacttgaggtcaggagttcgagaccagcctggccaacatgttgaaactctgtctcttccaaaaatacaaaaaaaaaattgccaggtgtggtggcgcatgcctgtaatcccagccactcgggaggctgaggcaggagaatctcttgaactcgggaggtgaagattgtagtgagtcaagattgcgccactgcactccagcctgggcgacaaagcgagactccatctcaaaaaaatacatatgtcaaaatagaaaaggtcatcctttgagagtaagaggtggatgttgggttctaggagagggaagaataaataaattagttgtagagagtgggagagggactgaccaaaaaagcataccaggcttgctgagcagtggcaaatcctagcttgagggctttctcctcgcctcttttctccccttcatttagaggaactttaggcttcatggtggctgtggggcacaggataggggacccttcccttatagcgcagcatcatgcctgggagctcttcatggtctggccctggccacctcactgggctctcgtcttctgacttgatacttagtgttgcctcaaccctacttccttttgcctagaagacacttctcttcttttctctttggggagtcaagtaccttgtgctctgagaggcttccctgacctctccccacccacatgagcttggctgcccttctagatgtcctgcctgtccctgtgcagatgttggtcacatctgcctctgtcctgacactggactcccaggctgtaactactcagctccttcagccccctgggcttgatctccttgaaggcagggatgcagggaacaaggccgggagtgggagcagcctgtgtgaattstcaatccctgggggaagggggagggttgggccccagggacagtagggactggagctgggtgctagagagcagagcctgttgggctgcatgcagggagcttgcgaattttggggcggggacagggcctggagcaggtataaagggctctggcatcattgtgctacttctttctgtgagtccacgttcactgaccatttggggtgtacccagcatctggcggatcactgggccttctgggagtacaccatcaggcgggagagacagtggacacagaccgttaccatgccctgtgcccattttgctgcttctctggggcccagaaggatggatgctgagttaggagttagaactccttcatttgcttagactctgaggaacaaatgagatgacgtgggtataaaaactccttgtaaagcattacctttgatgccatggggcaatgagagagaactggtttctcaccctagttttcaggaggcctgcacatctatgctgcacacacatgctgcgggaccaaggaggaggccaggcagaccccagggacagctgctttggcacggcctgagcgtcagcagttcctcctgccctcaccgctggagtcactcactaccttccacccctgtgactcccccagagaagtggctctctgagctgtggcactcaccttgggagcagcctttggaggaaagagggccaggcctggccctgataagacagtcctgcttcctggcaaggctgcagaatggccagccctttgcttatgttttccttgtgactggcatgggacttagggtgatggagataaaggccaggatagcaggacaaacagcctctggaaggaaactctttctgcaggaaagggagggggacagggcaacaaggaccccagcattgcccttccagaggcaatggctgggattagagtcctgggatgcggagatgcctggagagcagtggggtctagtcagcactgggggcttagacctttgtctggggaggtgggcaggaggaccctagagatgtggctgtgtggttcccttcttctccctatctccaagagcagtcagctctcctctcttcctgaggtcccgatggatggcccctcaactccttccttctggagccttccccgctttcacaggcagccctcttgcccacaggctgggtgttcgagtgctacgagagcagagctgtagtccgagggatggagaagaggggtttactgcatagcagggtagacgagagacctggaaaagagcaggttggaaggggaaagcagcctccagttgcttcgtggagggccagagggcagcacccacttggctggccccggcccactttcccatcgctctcctgcaggtgttagagctgcggcggcccatggactcaaggctggagcacgtggactttgagtgcctttttacctgcctcagtgtgcgccagctcatccgaatctttgcctcactgctgctggagcgccgggtcatttttgtggcagataagctcaggtagggcccagccgggcaagaaagcagaagggaggggggaaggcacacccacaagcgaatcagcaagtgttcaggagcctaagcaggcgccggagaccagtgctggagtggggctgtgcgtagggagatggaagactaggtggaaaggtagcacmcctgtgtgggtgagggagcagggtttgggagcacacagatggcaggattgagaaccctgtggagggcttggcctgaggggagagggagggatatttcttcctttgcaacagccaagactgtgcaggtgccgggatatgtaaaggggaaaggttaagaaattgagatttttggtggatggttgcatttcttctggagggggaggcaaagccatctcaatgggatgctgagtttgaggaaagagctgctgtgaggaaggggcaagagcactgaccggggacagtgtgaggaatgctgagccagccagcgagggtcctgtggagggtgtcccctggagaaggcaactgcagtggcccagggctgggcaatgggagggctggggagaaggatgygatgggggcaytgaggtgcagagaggagagtgggtgaggaaggctggccagcccacaccgggaaacagatgatgtgcagggcctggaggtgccagggaagtcggggagctggtttaggaggagtaagaaaagagctggatgggtcacaggtcttggtctgaaatgctggcatttatgattttagaggtagaggtgtcgagaaggtctggtggtggccatgggaggggtggcagaagtgatggtcactggacgtgaggcagtttaggaagtaagaagtcggagctcttctagacagccaaggtttaaaaaagaaaaaagttttatgtcagtggtggttagggggtgacacaggcaaggcacaagtgatacggctccgatgagtgcaggaacactagggtttttggttcttatgctggtttagataaaacgacaccgacacacgtggagtggttttaaggagcggagagtttaataggcaagaagggaaggagaaaggcagaaagaagaaagtacagagacagagggagagaggctccaaagccgagagagggaaccccaagtgttgtggataccagccagtttgataagaaggctggaggaggcggtgtttgatttgcatagggcttaggggattggtttgaccaggcatgtcattcatgtagcccctcccccccccccccccggaagctggccttcccatcctagccttttaatatgcgaatgtagggcgcctgatgttctacacacgtgggaatatgcggggcagccatgctgctaggcacctgtaggggcaagggcaagaggacaacggtgggaattgccatgttgggtggacccaatttctaatggtcttcatttgcatatcaaaggttgcctgcctggctctaagagccggggctttctttccagacaagaaacatttttgagctgctttaaaggaaatgaggtacagkggctcacgcctgtaatcccagcactttgggaggccgaggtgggcagatcacaaggtcaagagatcgagactctcctggccaacatggtgaaaccctgtattagctgggcctgtagtcccagctactcaggaggctgaggcaggagaattgcttgaatccaggaggtggaggttgcagtgagcggagattgtgccactgcactccagcctgggagtgacactctgtctcaaaataaataaataaataaaaatttaaaaatttttttaaaaaaaggaaacaaaaacttttcctctctscataaaataatttcttagtaagtcctacaacaacaggatgggttattggcaacatgttacatattgttttggtcaaagaatccatcccaagcagtggtttctctagagtggtcatttggacattgattaagccaccttaaatgtcaggtgctcacaggagggcagtgaaggaaaatccccgttctggtttgtcctccaataagtcctgaatccctggggtatttccttccgtatgtatgaggaagcagttgagaggaaaccgagaaatgaactcccgattgccttcagagggacaggaacgcaggcccatcctcagcccaggagaagaaaggaggaagaaaaaccagagctgctgacttttccatagagcaccagggtttagaaaggaaaactgcccctcacttgttcccatcacagcctcaatgcttctgtgtctcacacttctaggtgttctgtgggcccatcaggcccttgtgaagaaatctagcccaacagctggaatgagctgggtacagcagttccaagaggcccctcctgtgtaccagccatggtcattgtcagccaacaaagcccctgactgcccagctttggtgccctggcctggcctgaccttagtggcccctaagagagcctggaccatgaggtttcttttcctgaaggttctaccctctaattcagggctgagcttcctctttgccaccctgcccccccccaggccagctcccgtggggctgtgaatacagctattgtttcctgtggttgcagctgcctctgagcacattccaggaccattctgggagggacgatcccaaggtcttgttcttggcctggccgggtattcaagttctgccaatctggggtcttggaaaagatgtccttcctgttctgcctggggtctgcctctggctggagaggggaggggtaggtccagccagctcatgatccgttgctgatgttttaggttttccacaagttctttgtccctcttgcctagttctgatgtggggtgggagagggtacccacgatctgcattcactggccctaggggtttacaaaacctactgcctcctcagccacgggcccactgatgtgccccccaaacccgagacagcccttttccagatctttgtcagatgactgtcctgcgggttgctgcataccttcctggctgtttgcaggtacatttccctaagagagtagcattgttgtccttgaggcgctacgcagtgggaaagcggggactttaccagtctgcagggtccctgaaccccattagcatttttgttgcactgggaggtttacgatcaaaggctgtcctgagcctccagcgagctctaagttcctgggcctrggctcaggtactctgtctctctgtctgcccatcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggtgggccaccgggggaaccagctggggggaagggtggagggggaagcaggtgctgggatcttacttgtggcccctcggcctctttaccaggctcttatcctttctccctgggaggtctatccccggctggagtacttcctgttakctgaccctgggaacctgggaggtctggaggcctggcagagggcattgcgggactcatgccctgagccactctgctaatgactccttttctcaggcgctgatggtgaatctgggatctgaccgattcatccgacaggtaagagggtgggtgcttgctagagttgggctcctgagcaccctgcaccatcacacacactactcaaccttcacaacctgtttgttgagctctctctctgggttcagtactactcacagactagtcaagggtggggagaagctggtcttggaatccttgaccttagcagggtccgcctttccagtgacatcatgagcttctagaaggcagtgtgggaatttgaagaacacggcctgggagtccacagacttggccactggactttgccccctttgagccacatggtcttaggcctctaaattcttctgagctctaaaggagaggtggtgacaacacctgccttgaaatgtttgctgggggttacacaaataactatagattgttatgtaacgtacaggtttgcaatcattgttgtcaactacaaaaagcctttgttagtcgtggaaatcctcctggctctctacaaaggagcacaacccagtrctctcccctatggaaatgtacttattgtctgttacacaccartgacggagctgaggactccctgggtaccaggcatagtgatgtggacacagaaacagagtatagagacgaaacaacagtctaacttcattcctgagacacaggctggccacagtccccctgccccaagccaactgtgcctcctgcctggagctgaagatggaggaattggggagacctaatcaggaacccctggctggtcctggtcacagaggccagtgaatgccacactggctctaccccctttttttttttttttttttttttttttttttggagacagggtctcactgtcatccaggctggagtgcagtggtacagtcatgacactgcagcctcgacctgcctgggctcaggtgatcctccccatgtcagcctcctaagtagctgggagtacaggtgcatgccaccatacttgactaattgtttttttgtgtgtgttttgcagatagagggacctgctaagttgcccaggctggtctcgaactccctcctgggctcaagcgatcctcccgctcagccttccaaagtgttgggattactggcgtgagccactgcgcctgaccctctaccacttttaatctctgtaatcttgggcaagtttcttaacctttctgtgcttcagttcctcatcttaaaatgaggttgatgatagttatgagggttactgggagagataaatgagattatctactcacgctcttctaacaggtcttagcacatagtaagtgctcagtgtcagctatgattgtcactgtgctttctttctcctgcagatggacgacgaagacacgttgttacctaggaagttacaggcagctctggagcaggctctggagaggaagaatgagctgatctcccaggactctgacagcgactccgacgatggtgagaatagtgcccgggcacggtcagctctgctccaggctccctctgctctgggtcagggccccatagggccagaactctgcctctgcacaccaaacccttkctggctgatgaggaccttggtctcactstagcgtcttttctaccccaggtagtttaggaaggaaaacccaaagacatgtggcaaccccaaagatactttctgctgacagaaaactaattattcctccttctgaggccttgcctcaagccattgcaggagatgaaaggcacttcctcttccttggaagccagaaaaatcacttagggtgagggatatgatgaaagtggtgctctggtttctactttaattcatccagcaattatgtttcaacttccatgttcagaacatagtttctggccttctgcagctcgtaggctagttacaaggctatgagcacaagaaagcaagcttccagaggccgggtgtggtggctcacgcctgtaatctcagcacttggggaggccaaggcgggtggatcacctgaggtcaggagttcgagaccagcctggctaacatggtgaaaccccatctctactaaaaatacaaaaagtgcacctgtaatcccagctacttgggaggctgaggcaggagaattgcttgaacccaggaggcggaggttgcaatgagctgagatggcgccattgcactctaacttgggcaacaagagtgaaactcggtctcaaaaagagcttccagaacagaagagtggtactggctggaagtcttgttggggagaggaagactacaccaggaagattgaggaaggctttgcaggctcttgacctgaacctcaaagattgtcttttcccttccagaatgtaataccctcaatgggctggtgtcggaggtgtttatccggttctttgtggagaccgttgggcactactccctytttctgacacagagtgagaagggagagagggcctttcagcgagaggccttccgcaaatctgtggcctccaaaagcatccgccgctttcttgaggtttttatggagtctcagatgtttgctggcttcatccaagacagggagctaagaaagtgtcgggcaaagggtaagtcttggttatcagctctcttctctaattttttcacccacagcagggctgaagaaccaggcactatgatggaagctcttggacatcagctagggccaggcctcttaacatccctttacctctgttagaaacttcaaggtagcattcttctcctccggccccagtaaatgccttcacaaggctatgcacaagctaagccacatggctagaggtaggactcatctccacctaggagcagcatgccattggttgcccaccccctcctcaaagagaaagataggagaaagcccttctatccagagaaaaggagcagactgagcaatttcgggggttctgagaacccagtggttgggaattcccttasagagcattgggccagctgtcgtaggttggtggcagtcttcatttaaggcagatggttatcttgttttttgctatttcatcagctcattcgagggctttttcatctcatcacaatttttctgtctaacctcagggttagtacttcttctgtcctctaatactatccatttagtataacaacctttttggaacaacatggtagagttgtctgaaggaagctagagatgtccacttggggcagctctgaactgagaagcagcctcctcacctagtgcagcttgggaatgtgcatggggaggcagggtggcagcagcaaaccccggcaagatgtcactaatgatcgccttgatgagccagcccgaattctagtaagatgctcctgcaaattatcatcccagatgttttctttctccttttttggcatctgtgctccatggttcccttcatgtaggcctctccttcccttcctccaatgactgttctcttccctgtgcctgtttcttttacccaggcctttttgagcagcgagtggagcagtacttagaagaactcccagacactgagcagagtggaatgaataagtttctccgaggtttgggtaagtrgccttgttactgatgagatagatgttcagcaagawggaaggggctgggagatttgtgttcccgaatactctaaatcaatgtcaacaggtgttatactggggctgtagacagaacaggatgtagacatcccatagtgactagaaggttctcagccagaattccaagggcattttgcacagtagtggtccttcaatatctgtgggggattggttcctggatacccaaggataccaaaatccacagatgctcaagtcccttctataaaatggcatagtatttgcatataacctgtgcacatcttcccatatactttagatcatctttagattacttataatacctaatataatataaattttgttattttattttatattttatttattttattttagaggcaaggtctggctctgtcactcaggctggagtgcagtggtgcaatcctagctcaccgcagcctcaaacttctggcctcacgtgatcctccctcctccacctcctgagtagctgggactacaggcatatgccattacacctggctatttttaaaatttgttttgtagagatgatgtcttgctatgttgcccaggctggtctcaaactcctgggctcaagtaatactcccatattgacctcccaaagtgttgggattataggcgttagccaccatgcccagctgtaaatagatattatactgtattgtttagggaataatgacgagaaaaaaaaagtctatatatgttcagtacagacaccaccatccattttttcccccaaatattcttgatctccagttggttgaatctataaacatggaacccatggacgcagaactcatggatatggaggacaggctgtatttaccatattgcattacaaagaggaatcccaggttcccacatacatcaggtctttctgtttgcactccttcctgagtgaatatgaaggccattagagccagtgagctttcctctagaccataacaggtctgcagacacagcagtgcgagtgcccttcctgcaaaatgcacccctccctgcagggtgctcagcccgccagatcagagaatcatagcatgtttctgtttaaagagaaattgagaccaaagaggttaagtggcttgcgtaaaaccacacagtgattaataccggtgccctaattagagctctcacgtgttttcactaccctggatcagatcacagttataatccagtcttcctaatccttcctctcccactgacagggttagggctacaaggaggagagggagtggaggttggaagggataacactgaacattctctcttgtcctctctggcccacaggcaacaaaatgaagtttctccacaagaagaattaagcctccttctcagtagcagagtccagtgccttgcagagcctgaagcctggggagaaggcccagcctgggaccctctgggctgctgtggctcctctgcccccacagatcctatcctccaagccagcccacctctgccttcatcatatcccaggatactgtttgtaaataatctgctgtaagctttcttaactgttttttgtaacaagcaaagagaatatggcaaatatttgtatattcccaaggggccgggtgctttcctgtcctgccagagcatggatgaagtttcgctgggtgctcgtgactggccagttttgtgcagctgactgtctcagccaaaccactgatcttccctggaggccttcggcbtgcctgcctgcctgaggtccccgctgccagtcccgggccctggagagcagatgctgtcttgttatgtacaggaggaccttttaaaaaaatcaagtttctattttttgctggtagtccgcatacccataccctctgtttttgaaaggcaaaggccaatcagtccccatttgtagcatggcaccagggtcttaggcctagtcctctcattcctcccaccctccgagatggtcagtgtgtcatgggaagcccacccccagctctgccagtgctctctgggcctggctcccagtcagtggtggccacgatgcggtacagggcatccctccttcccatctacgggtgttctcaataaacaatgtacagttgtttgggcccagagcctcatgtgttccttggctttgttatctagttctctctcctgggaatgggctgggactggccagtcagggatgaaacaccatcacacagggaactgagtactagattaaggggttagcttcagtgtgagtcactgacctcccctgaaatggagttctccagcctaagttgcatgaccggtcttaagagttagaagatacccagtcattgcagtagttcagcttccctcaactgttcagcctgtgcttaagtgtttccagtgatggaaagaatgctctttgcccttcggccccattattaggtaaatcttaacattttcctcttctgcctgaagcccctaagatgtcattgagtgtcctaacattggtagagtaaagcccagctaatgccaacccaggcttgggcatagccctgacctactccctgtgactcttgcatgtcactctgtgaatcgtttttccattggaaccctaggttttcatacagaaagtacggttacattccatggaagaggaaggagagaagcaaggtgggaaataaggacgatttaggcttttcacccaccaaggccttcggagagcagagactttgcaaactcccaagtgaggcattaagctgcaactattttctttggtattgtgtttgggtctgacaggatttgaaccatgagtaaagttttcctgtccttccaccctgttgagagatgatcccatcctaagtttccttcccctcttcctcctccccatctccactgaggcctgcacaggccccaacctgtccatggtttgggcctgccgtcagcctcacagaataaagtggagggtttgtcttctgggaaggcaaagtcattttctggctctgccatttgccaggactaggacagagattgaagcctcatgagtcttcagttcagatcaagagaaaagacaaggattacaaccagaagactcagagtgggaagtagttccctccagaactcgtcgctcttaactcagcctgggcttaggacagtcatagaaccagattccttaataagaaaaatacaggccatgcgcggtggttcatgcctgtaatcccagcactttgagaggccgaggcgggtggatcacgaggtcaggagttcaagaccagcaatggccaacatggtgaagcctcgtctctactaaagatacaaaaaatttgccaggtgtggtggggtgcctgtaatcccagctactgggagactgaggcaggagaatcgcttgaacccggaaggcagaggttgcagtgagccgagatcgcgccattgcactccagcctgggcgcagggtgagactccatctcaaaaaaaacccaaaaaaccagatttaattcctaaaaggctaaaaggtacatgcgctctctctcccttcctccccaattctccacccctcctttttcagcatggctccaaagaaccactttagacatgtgatccgatcacaagatgtgtatgtgtaaattttttttttaaatttgcattaacggggtctcactatgttgcccaggctagtcttgaactcctgggctcaaacagtcctcctaaagtgctgggattacaggcatgagccaccacatccagccttattcataaattttgccacttttatgtgtctttaaaatctagtatgcccttccgtgaataccagagcggtatgtctccccgctactgtggctgcagctctggtcccaatccagaaaatcagtactggcatataatggcttagaataggctgcaagggcccatagagtgattgccatggccaaggcacagcagccttatggggagaggagggtgtggacagtgggcctggcttgaggtttacaaaaaatattcagggcttctttccacgttctttcacatgatctcagggcttctttccacgttctttcacatgatctctggacctctaaaccaatgattttcatccctatcagatccaacagttttttttttaatagcaaatactttaattccctccttcactaccctgaaatgaaattcaaagataatataagctaccgaaatataccttaactgtaatataaaaggggagaaataaaacagaaatattttgttataatatttaaatatgtaaatgcttgtgtacaactgtactagaagagataatcagatgcctatactgtacacagaattactgtgaatgcaacagctacatatgcagatggagaaaagtgttgtatcagcatctcagatcctactgagtagttattggtgagttttctgaaatgaacaatttttggtaacgttctcaacaaaacaaagtatgagcttcccctgatttaaacagtagttagaatcctaggaaacagaagtatatgaaaactgcaaaaacaaaaaacaaaccaacttttgggttatgtgtaaatgaagttagattttaagttagatttctctttgttgtgtaggaccagctcatccattccaagatatttagcatccctggtcccttcccctccatgactgtgacaacaaaaatgacccaacatggccaggcgtggtggctcatgcttataataccagcactttgggaggccaaggcaggaggatcatttgagctcaggagtttatgagaccagcctgggcaacatagtaaagaccccatttctattaattaaaaaaacaaacaaaaaaaccccactgtttccaaaacactcctgtaaaagatggtattgtggccattgagagggagtatccttaaacagtggctttctgacaacactggggcagttgctcagggataacagtgctatctcctctaccagggaagtcccctcacctataggagtgtcagttctcctctattctgtaattaagttagttcttttaatgcagggcaggccacttcattacacggttctaaatgctctgataaactgtagtcttgaaataagtattctgggctttttaaaaagcaatattttgaagaattgcccttaaacagcattagtcaaactctggttgacattggaatcggtggaattagggcccatcttagtccattttgtgttgctataacagaatacctgggactgggtaattgataaagaaaaaagacttatttggcttatggttctgatggctgaaaagttaaagattgggcagcaatacctggggagggcctcaggctgtttcagctcacggcagaaagcagaaggggagctgggcgtgtgcaaagagatcgggtagtaagagaggaagcaagagagagaaactgaggaagccagacgccttttaaacaacctgctctccattcccagcagagtgagaactcactcatccccacaggagaacattaatctatttgtaagagatctacctccatgatccaaacacctcccaataggctccaccttccaacactgccatactgcgggccaagtttcaaaccacatccaaaccatagcacgacccaagaaaataagtgggattagtcacagctcagttacatttttgttaaaaacatcttttcgcatgtacacttataacctactttataccaaaatgacttacagggatacacaaactaggttatttgaaacaacgtaaagtgggaatgagaggaaaataaaaattgggatgtaaaatagagccaggaattaaatttacgctttaacctatattcttgctaggggagctacacaaaatacgtttctagagccagatgatgtggtatgcattccaaaacaaatttatttgcctgtggaggtgggggtgtaatttaaaaggccatgaaaactctcgaaagagaaaatattacttttcagcaacggcaagttctggtagtttttttttttttctcaagatactttcgctccatttatattgcctctcaatatgaaaatacgcattgggttgaacaaaaaactgcaccaaaacatacttcgtgctcatttccctaacctcctaagaggaaattccttttatgttcttctagaatatttccatccgtgtacaagcactttcttttttagcccaaagtgcccttgaatgtcgctgacgctcattaccttttagacaattgagacaaattctggaggttcccatctcgaagatttacgtaaaggccacgcccactgttcttaaacgcaccctaaaggggctcgaagtgcggcgaggttggccattcctccgcttcgaaggggacccacggccgcccaaggaccaggggtggagttgaacatcccgcctctccaggggagttatctgcgctcgcgcaccactggccggctccgcccttgccggaagtggccgagcgaggccggtctccgccgggcttcttccggtctgggacgcgggggagtcatcgtctccggaagtagaagctactcaccggaagtggttctcaggtgccggggtaagacccaaggtccggtctgtgttgtgaggacgccactgaggtcgggtcgtgctgactgatgaacgcggccgatggagccaccaggtgggcgctgcacagcttccgcccgcgcttccgacttgcagtccgtccgtgggctgtctgctcttgggctagttagccgctaagtagggtttagtagtacatttattttgattgaaagctcgcctgatttagctgcccttgacgagcactgcttgtgcaaattatgtggcagacatttgtcataaaatcaagttgcacctgcagctcccacgtttgaacgcaactatatttaaggcatatatacattagaccagaaattagatcttttgcaattcaagctttagccagccactagagatcgccagtatgagcctccatgaacacagcaggctattcaaagcttggcagtcatgaaaatattttagtaaatgcgggttcaagaaagcactggaatcggcggacttagggctcaaaactattttcgtctgttcctcatcacatgaaacagtttttagaactgttagtagctgtagcttctggtgagtgaacaagccagcaacgaaatcagtgtttctttcccaggccaggggatcggatggcctaacaactcctggggaagaaggtagccattaagggactagggatccttccccccaaactctacttccttccatgccttatcattttgtggtcggcccactacaattcagtctccaagtcccgtccattatgccgtctgaatcgtaccttttccatactcactcccattttcttggttctgccttcagcctcccattgtagccgtcctttacagcccggccagagtaatctttctctccaccatagcacttcccgtttgcctaaccttcccaaaccagtttcctgaaccagtattccctctgcttggaccaatttcccactgacaatcacatgaaggccaattgactccatctgctcccgtaatagtttgcacttaagttactaagtcaaacacaaaaattaagtgcctgggccgggcgcggtggctcatgcctgtaatcccagcactttgggaggctgaggcgggcagatcaggagatcgagaccatcctggctaacacggtgaaaccctgtctctactaaaaatgcaaaaaattagccgggcgcagtggcgggcgcctgtagtcccagctacttgggaagctgaggcaggagaatggtctgaacctaggaggcggagcttgcagtgatctgagatcgcaccactgcactccagcctgggcgacagagcgagactccgtctcaaaacaaaacaaaaaattaagtgcacggtttccattttaatctacacaatcctcaggtaggcactttcactgaaattttaaagatgaggaaattaggactaaaagtcacacaggtattgggtgaagaccaaatattgagtcttttaattcatcatgaactactgaccacttattgtgggatccttggattcaggttccatattacaagtcctctatgggccctaatggagagcccttactttttttggggggggtggacagagtttcactcttgttgcccaagctggagtgcaat

SEQ ID NO: 10870 - DNA, 15408 bp, Homo sapiens
gtttatcgcaaatccacatctctagtgtgtaaaggatgattctctagctttaccacaggccggagagaagccctctcacagccgagggcggtggctcacacttgtaatcttagcactctggggggccaaggcgggtggatcacctgaggtcaggagttcgagaccagcctggccaacatggcaaaaccccatctttactaaaaatacaaaaaattagccgggcatggtggcgcatgcctgtaatcccagctactcgggaggctgaggcagaattgtttgaatccaggaggcggaggttgcagtgagccaagatcactgcactccattggagtgccattgcactccagcctgggggacagagcaagactgtctccaaaaaaaaaaaaaaaaaaaaaaaaaaaggaagccccagactttatttaatcgagcttcttaagtacacccagcatctattttgtagggttcatatggatgaacatatatgaaaaccttaatcttctctccttgccttgggacggaatccaaaaacttatctcattcacctatccaattaagactagaaacctcttatggtttttatggctaataaaaccattaaaaaaaagtatgtgagatcgggccgggtacggtggctcacgcctgtaatcccagcactttgggaggccgaggcgggtggatcacgaggtcgggacatcaagaccatcctggctaacacagtgaaaccccgtctctaccaaaaacacaaaaaattagccgggtgtggtggcgggcacctgtagtcccagctactcaggaggctgaggcagaagaatggcgtgaacccaggaggcggagcttgcagtgagccaagatcgtgccactgcactccagcctaggtgacagactccgtctcaaaaaaaaaaaatttgtgtgagatcaaatagaaacagacacgcactatatgcagaattatcctattttactcattgaggcctatccccttgctttctcagaaaccctaaatgatcagttacccttttctctgctgtgttcatttcccttccacacacgctcaagtctcaactgtcttcaaacacacactcatatatatatatatatatacacacacatacacacacacacaatttcatacactcacaggcctattcttgcccacaaatccccttcagctactatctcccttttctcccctttcctttccaggaaaactacttaaaagagttgtccatgcaagttgagtatccgaacgttttgggactagaggtgtttcagatttcggaattgggagtatttgcattacacttactggctgaacatcccatatctgaaaatccaaaactggaaataagcatttcctttgaccatcatgtcagtgctcaaaaagcttcagattttggagtatttcagattttggatcttcagtgctcaacttgtactcactttctccattttcttgcctgtgactcatacctcaacccacttgaaactcacttctgttcccattattttacaaaaccactctaagatcaacagtgatatccatgttgctgaacccaaaggacatttttcaagctcccttatctcacctcccagcactatatgctcctactgatcaccaccttcacgaaaccctcttttcctctgaatcttagcatagcggcctgttggtatgccttgttcaacagatgtttattaagcatctattttgtgccaagtactatttcaggcactgggaacatagtgatgaacaacagacaacctgtttttgtgacacttacattttacctctctgaccccactttctgctttgaaggctcctactctcctccttgaccattaaatgctgaaattttccagagctcagtcctaagacctcttctttccagaagaaatctcatcagtacccacagccttaatggccatacatgtcgatgccacacaaatatgtatctctagcttatacctctctcctgcttcttgagaaagcagaatatccacctgccttctcagtgtatctacttggaagacttacaggaacctgacaatcaacatgtccaagactgaattcatcatctccccttctaaacccctccatgactggaaccattatccatctatagctgtgtaaaccagtactttcttccttacaccttctccctgacccagtcccaatccattaccagatcctattgaataaacattcctagtatctctaaaatatttccattttccccatctgcaatgccaccattgtagttcaagctactaccatttctggcctattacaagtttcctaggtggcccatacactgaagccatatttcaaaatctaaactggatcgtgtcatccagctggctaaagcctttcgatgacttcacactgcctacgaggcctactggcctctggatctctcttaccctcatcagtatcatgctgctccttctctaggcatttccacacaggcctcctctcaggctctcaaacccgcccagcttctttactgacctgatccccccacccccaacacacacaccaaaggctcttccacagccgccccttatccaccttcacctgcagctactctagctcgttagcactcaatgcaagcagcatttcctcagggaaacctttgtagcaccttcagaacaaggtcaggtgccagctcataagctctcaaagatccttctgagacaatactatagtttttttgtttttgttttttaaataaagagatggggtctcactatgtttcccaggctggtctcaaactcctaagctcaagcgatcctcccacctcggcttcccaaagtgctaggattacaggcgtgagccaccgcacccggccactatagttttaattgtatattcattagtgtgattatttgatttgcttatcttttccactgaaccttaaagttccaaaatcagggaccgtgtgcatttgtgttcacccatggatcccttaaccctagcacaaagtgtttacacatggtaaacactccggaaatggttatttttttctgagacgaaatctcactctgttgcccaagctggagtgcagtggcgcgatctcagctcactgcaacctctacctcccaggttcaagcaattctcctgcttcagcctcccaattagctgggactacaggcatgcaccacgatgcccggctaatttttgtatttttagtagagatggggtttcactatgttagccagactggtcttgaactcctgaccttgtgattcacccgctttggcctcccaaagtgctgggattacaggtgtgagccaccgcgcccggccaacactccggaaatgtttaccgaaacacggacaaccaggcatgacactcttggagattacattcacttggctcatgtccacagaaaaacccacattaccgcaataataatcgtgagaaaccaaaattctaattaaataaattagtcctaataattagcacgtgattaactgctttattcacaaatctctatttatccaacaactatgcattgagaatttactatggaccaaggaccgtgctggaagttattcatactgtggtggcaaaacgaagtccctgtcctcacggagcttacaaaaattaatgtccaaccaggaggtgatctgaaaagcacgcacacatagaataatttagggtggtagaggagacgcctcaccaaattctactttatggaaattctatattactaaaacagtagatatcaatattcccaaagtttctgagataagtaggtgttcaaaacagtatcatgctgctccttctctaggcacttccacacagccctcttctcaggctctcaaacctgcccagcttctttaccgacctgattccctctacaccaagggggtagcgttgttgtttagcgttgctactacagaaaagagggagtgtatctgctgggcctgctttaccttggaagttatgattgcatctcatcctagccagtcagctttgtcccaaaaaaagtcaaaatccctgcctatttgaataaatcatctggttgcaactacaactccatgtccttccttctcaaatgagtggggagaattcaaataataagcaaaaaactgaaatcaaacaagcagagggataaaaccagtatgggtaacagctaagtgtttaaatattgttttgggtagagaataaggagactggtctaagtctcttgataatccaaaacttccacctcatcacttactttaacagaaatgaaataaggcctggactagagaacaggttactcctgagtgtagcatgtttccactacataaagtcaccaaacttatttttagtcttaaagtaacaataaatcttaccccatatacttttattatctaaagtctcagcttaagtcatcttaagctgaatatagttacttctctgttatcaatgataatgatgacccagagaaaaataggataaccaaattcactgacgcgctcagaaattctttttaaaactgtaatttaagttaggttttatggcaagctttcccaaagtactaacgtagaaccctttggatttaggcatcaggcttgagtaagtatttcaaagttctaaaaagtattagtagcaaagaacataaagtcacacaaaaccagaactgtccacaaatattactaggcactaaagaagaaagcaacttactcctggacagaaattcaaacgcaaatctcagtttccaaaggattgactaaggactaagtaaaagtaatagtttcgtaattctaagcaactctaacaagcattctttaaacaccttctacattttaagacacaaagtatgtaaagaattaagcctttcattgaatatttcctatatattagacatgtgctaaatgcttcacttgaaaagtctgagttaaatacttttccaccacaaaagaaatactttttccacaaccacaactacagtgctattttcacctccattttccagatgaagaaacagaggcagagaataaagtgacttgcctaaggtcacaatatttatcatggcagagccaacactcaaaaccagttctagccaacactaaagtcactgccctacactggccctccctcaagagtaatgcatacatggcccaaaaaatccggggagaggaaagggacctccctggctagaaccgcagttcagaatataaacactgagcatatgatggatgcaacttatccgtttcaaaaggggtgggagcctagaaacgaagccatttttcctcctcgaataatcttggctgcctgtccctttgtcttcaatgttagttcctttcactattctgctcccaaacaggccaggtcccacgtcagttccaggaggaaagggctctctcagcctgcgggtcatctttgggcagcagcaggaaggaggcggcgaccctctgaatacctcctttggactcgccatctggacgtaaagggttcgcctgctccatctcagattcccaagggccttcccatgaagttgtctaggcaaccggtgatagggactccaatgtccttgctaataaaagaaaaatggcaacagtcacatcacatctagtcccattcaaacccagacggcagggcacacaccactcaggcacaacccctgggccgcggatgacacaaatgtcacggctaggatcccctttcctgagccgcccgccctctcccatcgtccgagccagcagagtccatgcccacccccgcgcccatcccgcggccccggcgcgctcccgaggccacggctactctggtccagcgggcttcccggccacggaaggagttttaagaaggccgttcagcccgccaccctggccacggtccggtccgacaatgggtctttcccctaccttctcccttctagctcacccaggccagaagcgagaattcccgccatccacgtcttcaaaaccaaaccaaccggtcccggcgtgctttgcgatcctgccgtacaaaagcatggcggcgctcagggccccgccctgatcccaagatgcaccggggagtaggtccggcctttcgggtggtcaggaagatggcggcctctggggcggagccgcaggtcctggtacaatacttggtgttacgaaaggatctatcacaagctccgttctcctggccggcgggcgcactggtagcgcaggcttgtcacgcggccaccgcggccttgcacactcaccgcgaccacccgcacacagccgcttacctccaagagctggggcgcatgcgcaaagtggtcctcgaggtgaggcactcgggcggagggggaggtgctgagacatcgagggcggaagtgggtgtggtcttcggtccgaaggcctggctgcggggagtgggtgcggcgggagttggggtgatcrttaacatttagactggagctgtttccctggaggtgcgcccttgggaagggcctgactgtgtgaagagtggacagcagtcctccgccccctgctgggctcgcggtaaagtggtggctcctgtgtccccgctgttccgcctgtgcactggccgactttttaaagccatgccccaaagtgctgtcctcctgcaaaaccgagcccgaagggacagtgcaaagtgaagtcaaactgagtatttacctgggtaggacgccaaattatttgaaaataaatactaaaaacgttagtataaattgaacctagcttcagctagaccaggcaccaggtgtgtaaatcggtacaccttttaaaatagcagtcaggttctgtttgcagatgaccaaacaaatctcacccttaccctttgactctctatcctgctgctagagatgtagcctaagaaaataatcagatgcacccaaagagctttgcacaaggatattcatgggagcccttatggttttgaagcatatttagtggtcgggaagagtgctcatgatgcgaagctaactgaactatatatacagaatgatccagactttgaaaggaaaaactaaagaaatacatctacatattaagtagtgcatggtgagattttggttatttcctaatgcttaatctgtatttttaaaattttctaccttaagcacatattttataataaggaaaaacggctttaataataaacggctttttataataaggaaaaacggctttaagccagaactcaggtggaggggtggagtaatcccttcatgggtaactggcaaagatagattatctttcaagagaaaaattgctgctggatagtgaaacatcaagcggtaacctgtaggaaaaatgccttgagaatctgtgtaggcagaacagaagctgctggcttttcacttagattttcttcctagtaagaggtctcaagaaatcaggttagactcctcttgtcgcaggtgaaactctctgaagcctacagggattaagtgactcccctgagtttaaaagagggtctcatgattcttagttgttagtcatgactcaagaaagggacttaggagtcgctactgattacattgaggtgctgctgtagtcagaagggccaataaaatataagaaaataccaggattaactacatttattgagtgcttagtgtgtgccaggcacaggtccaagcctgatttcattgatccccattaggaagcattattcctgttttataaagggacgaagaggccagcgaagtcacctaacttatccacgatcacacagtcagcaagagtttggagtccagtagtctgattccagagcctcactgtatctcactatgctctgctgctgcccgaggctgaagaagctgatgagtcctccagcagagctctgccagaaggactcagcaggttaagagtcgcaatactggcattctctaatttattaaaacaagcctctgagtagcttagtggcttctgccttcataggtaagagataaactttatgcaaaataacacaaaaataataattttctgagtgatcgttttaatacttcctggaatgggattcagcatgggtgaattggcagtaaggatgacccagaaacaatttcagaaggatgttagagaatattgtactctccctttaataaacaagtgggagccatcccagcagaaggaaaacccctctaggtttcagtgaggtagagtgggaggggtggaggaaagtggaagtggatgtgcttttagaaatccttccactaggggccgggcatggtggctcactcctgtaatcctagcactttgggaggcttaggtgggtggattgcttgaggtcaggagctccagaccagcctgggcaacatggtgaaaccccatctctactaaaaatacaaaaattagccaggtgtagtggtgtgcgcctgtaatcccagctactcgggaggctgaggcaggagaattgcttgaactcgggagccagagactgcagtgagctgataatcgtgccactgtactctagcccaggygacagagcaagactctgtctcaaaagaaaaaaaaaaaaaaacttccactaggcagctcttaaagtcagaggcacttaaaattatgggcgccagccataggagagctggaaaatgtatagagcagaattacacattacacatgtgtgtgttgggcatacaacatctcacaagggaagatacaaatctccattttctaaactggaatatgaagcctctctcccctccccagtgcaccacggaatgacatcattgctctgcagctccctccttggtaaagctgttactccactttcaggcaagaggactccggaaaccttttttggccttttgacacttcctaagtgggctattcagtttgtgttctgtgttcttctcctttaggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatrgaagatttggttagactctcctgtggggctcaaggaaactcccttccagtmactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataacaaagatgttaaaatttggccagtgtggtggctcacatctgttaattccagggttttgggaagccaaggcaggaggatcgcttgagcccatgagttcaaggttacagtcagttctaatcatgccaccgcactccagcctgggcaacagagtgagacactgtctctataaagattaataacaagttaaaatttgtgtgtgtctatatatatgtacatacatacagatttattagattcaatgaaatctgtcaagtactacagctgttttcttgtcatttcagtgccgttgccctgtgtcagcctctcattttgctcactggcgtgtcccacggtctgttcaccgccagtgtgacactccaatccagcagctgctttgccaccacataggacgactgaacacctacctgtgtagtctaggctcctctctgcctatggagtaatcccagcactccttagcttagacttcaggccctcctcatgtgtatttcctacctatcttttttgttttttcgagatggagtctctctctgttgcccaggctggagtgcagtggcgccatctctgctcactgcaacctgcgcctcctgggttcaagccattctcctgcctcagcctcccgagtagctgggattacaggtgcatgccaccatagctggctaatttttgtgtttttttagtagagacggggtttcaccatgttggccaagctggtctccaattcctgacctcaggtgatccgccagcctcggactcccaaagtgctgggattacaggtgtgagctaccgtgcccggcctcctacttatctttttagttgaatcttctattcccttattcaaacttgatgtttccacagagtccctccagttgctattctccagtctctggcatgggagttgaatgttactactcctcccctccctttcctgcccctggactttacttaaactatttccagctcaagtgctatcactgccaaaaattcttaccaagccaaaaatgatagttccttctctgaacatctgtaacactctgtacaacgtttacaatatttctataaacatttggacacatctacagaaattgcttagacatctgtgaagcaaagtttataaggggtaatttgttcaacagatatctattgtttgtctgctgtggcaggctgtgcataaaacagttttgccctcaggtagctaagaacctatacggatattacccgtcccccttagataatgttctgctaagatcccagataagatttcccttcatgggcccggtgcagtggctcatgcctataatcccagcactttgggaggctgaggtgggaggatcacctgaggtcaggagtttgagaccagcctgaccaacatggtgaaatcctgtctctacaaaaaaaaaaaaaaaaaaaaaaaaaaaaaagatttccctttatgaaaggtggtcacctgaatcaaggagagtggatgggtctctctcacagggagagttggtagagtgctgagggcagagccaaccccaggaagccaagtgaatgaggagttgaaggggtagagaacaatcaagtgcagcatagaatgtcagtaaataaaacgtggaaacatttagcaattgggaatgtactggtgaacttagtgaagtttaaatagcatagtgagggtagaaatcagattgtaacatgttgagacaagaatgggaggccaggcgtggtggctcacacctgtaatcccagcactttgggaggccaaggcaggcgatcacgaggtcaggagttcgagaccatcctggccaacatggtgaaaccccgtctctactaaaaatacaaaaattagcagggtgtggtggcaggcgcctgtaatcccagctactcgggaggctgaggcagaagaattgcttgaacccgggaggcagggattgcagtgagtagagatcgtgccactgcacgccagcctgagcgacaagagcaaaactccgtctcaaaaaaaaaaaaagaatgggaggggagggaggtaagaggtgagaagtgtcctttccagaagcttgaaagggaggagagagaggataatgactgaaaaggggctggaaagatcaatgctgggtcccctagtggggattttcttagatcttgagcaggatgatgggtgaggaggagaaagtaaggagaggagagattaagagattaaagttcccaaatagaataactgatgaagtccagagaaaacaggaagagatggggtcaaaggctacgggaagaactggccttgaactgagagaggggaaacttcttttctgagactggtggaaaggcagatggtgaagatatagatgtacgtaggtttaatagattgtaggagaaagaaagttgaagttgaccatacctgctgactttttttctattaagtaggaggcatatgcactatactcagcaaactaaagcagcaacagaaaaccaaataccacatgttctcacttgaaagtgggagctaaatgatgagaacacatgaacacacagaggggaacaacacacacggggactgattggagggtgggaggagggagtggatcaggaaaatagccagtgggttctaggtttaatacctgagtgatcaaatctgtaccacaaacccccatgacgcaagtttacctataaaacaaacctgcacatcctgcacaggtacccctgaacttaaaagtttaaaaaagtaggaggcatacgatctttcataacactgaataaacttattgagcactatattagctagcataacagtgagtaggagcctaggctttggtgtcaaactgcttgagtccaaatctgggtctcatactttcaagctctgtggacttgggcagtgactctatttccctgagacccagttcccttatccgtaaagcggggatttaaatgtgtttggatgtacaaaccccttagagcagtgcctgggacttcgtgctagaacctaaacttgggaagatgcagatggcacagccgtcagagctgccctccaagagttctccatcaagtaggccattgtctacccctttctgttagggagtgatgccatccaggaatcatcaagtaccatttccattcaagccaattaggaaaatgtttctaaatgacactgcatcttaaaaaaaattaagttctgaattcttcagtaagacatagtataaagctagacaggccaggtgcggtgggtggctcacgcctataatcccagcacttcaggaggccgagatgggcggatcaaaaggtcaggagttcgagaccagcctggccaacataatgataccccgtctctactaaaaatacaaaaaaattgccgggcgcagtggctcacacctgtaatcccagcactttgggaggccgaggcgggcggatcatctgagattgggagttcgagaccaccctgaccaacatggagaaaccccgtctctactaaaaatacaaaattagctgggcgtggtggcctgtaatcccagctgctcaggagactgaggcaggagaattgcttgaacccaggaggtggagattgcggtgagccagagatcgcgccattgcactccagcctgggcaacaagagtgaaactctgtctcaaaaaaaaaaaaaagttagccaggcatggtggcacgtgcctgtagtcccagttgctcgggaggctgaggcagtagaatctcttgaacctgggaggtggaggttgcagtgagtcgagatcgtaccactgcactccagcttgggcaacagagtgagactttgtctgggggtaaaagaagctagacagaaatgagacacagctgggagttagcagatttaggcaaatccgtaaagcagagatctgagcacaaatagcataaatgtctgcccaagggtggggaagaacaggaactcatgcgctgacgctgagtgagagcaagacagcagcaggaaagcaatagattttcttattggtatcagcttaagaccatgatcatttgaactagatcagtggctctcaaagcggtggtctggtccctagatcagtaccacttgggtacttgttagaaatgcaaattatcaggccccaccccagacccactgaagtggaggctctagtgctacctagaaacagcctgggccctggagacagccaacctaaaagaggaacaataaatgtgtgtggtttagaatcaacacattatgagagggtattaagtgctcacaggaaggagtcaaatagcagaaatctggcaccaagtgcactgtatttggccatgcatactaaggttacagaaaattatgatttctccaacagggcaaagatgtgctgcaaaccctagaatagacgctatatccttgaaaacaatctcctatgctttcatagatttcttttttctttctttctttttttttttttttttttttctgagacaagagttttgctcttgttgcccaggctggaatgcagtggagcaatcctggctcactgcaacccgtgccttctgggttcaagtaattctcctgcctcagcctccagagtagctgggattacaggtgccggccaccatgcccagctaattttttgtatttgtagtagagagggggttttatctgtcacacacatccctgtgaagagaccaccaaacaggctttgtgtgagcaataaagctttttaatcacctgggtgcaggcagacggagtccgcaaaaggagtctgcaaagggagataggggtggggcagttttataggattgggtaggtagtggcaaattacagttaaagggggtttttctcttgcgggcaggggtcacaaggtggccagtgaggagcttctgagactcattgtccaggagaaggaatgtcacaaggtcaactgatcagttagggtggggcagaaacaaatcacaacggtggaatgtcatcagttaaggcaggaactggctattttcacttcttttgtggtaattcagttgcttcagtccatctggaggtatacgtgcaggcttgggctcagtggcctgacatcatcatgttgtccaggtggtcttggacttctgacctcaggtgatccacccgcctcagtctcccaaagtgctgggactacaggcatgagccaccatgcctggctggtaggtttcttatatgtgaaaaacattgtataattaacaaagtgctcccatatgaatcaatcctgacaattgttgtgatgcaggccatctagtctcagagtttacaagattcagaaaggctttgacttgccaagatcaaagacaatggcaggactgggattgaaaaaaaggtcttttgtcagttcagtttttcttttttctttttctttagatagagtcttattctgtcacccaggctggagtgcagtggcacaatctccgctcactgcaacctccgcctcttgggtccaattgattctcctgcctcagcctcccgagcagctgggattacaggcatgcaccatcatgcccggctaatttttgtatttttactagagacggggttttcccatgttggccagactggtctcatactcctgacctcaagtgatccgcccaccttggcctcccaaaatgctgggattacaggcatgagccactgcactcagcagtttttctaatctcttgtagttggttaacaatttggttttccagccatatagatactggagggtagtttgaaaaggggtcacgagtagttcaagtgctgaaaagctgtatcttccatttttaattggttaattgacattctggattataaatcagcctcctgcgactgtaagttttctgactcaacaccctagagcccaattatcactggatgagctgacaaagttgagtttctgaacttataaagctgagggtcaaagcctaggtcaccgcttctcatggcgctggcagagcgcagagggctcccctccaggggcaggttaagaattgcctgttttattgtctaatcaacacagaactttcccacaggttctgagatgctgtcctaagggtgtgaattccttcttgcttcctgattgagaat

SEQ ID NO: 10871 - DNA, 29194 bp, Homo sapiens
tctattggacagcactgctctggagaaaaattaagattctccttttacaggatatttttaaaaaatatttaaatgtaaggaataaaaaatattgtaagaaaccgaagaaagcaaattagaatctggaggtcaggatggatttcttaatgaggacaggtaggggtgtgtgtgtgtgtgtgcgtttgcatgcatggacacacggatagggcaagcacacatacatgtgtgcatatgtatgagactgataaacaatccaataggaaaaatgggcaaaggatagaattgaaaatgcacagaaaatctgaatggcaaacagtaacataatcaaaattactaaaggaagagaaaattaaaagtaactaagacttctctttattggctgggaaaaaaataaaaacataaataatatgtatctttgctgggcaagtgggaagggagcaggatcatacattgttgtaaggaaatgtaaaggttaacagcctactgagaaagcaatatggcaacatccatcaaattagaaacatgccatatccttcgacccagaaacctttctcacaaaaatctaccagcacatgacatgtgttcagaaagttattattgtaatactgtgtagcagaaaaaaagaggaaactaagtatcaataggaaatgaagtaaatgcctatctactgacaaaaggttaaaaacattacctgcaaaacaagacctgttatggaattattaaggattataaataaaaatatcagcaaatttttaaaaatatgaaaatatcaggaatggcaccactgtaggaaaacagactacagtagttccctcttattcttgggagatatgttccaagatccccggtggatgtctgaaaccactgatagtactgaacccgattgctgttaataggaagttttttttggtgatgtttcccacccacaattttaatgacttttctatcttaaccaagtgcttaacatgcactgtggctgcaacttttccattttgaagtgtgacagtaaaactagcaaaaatttctttttcctcctttataatttcagggatagaagatttgttctgaccatggatcttagcaaactcagcatttaaaaaatttccttaagtcaagaacttttaccttttcacttaaaagaagcactttatggcttctcttttgtatatccaagttgccatcattagtactcctgcactttggggccactgtcatgtaaaataagggttccatgaatataagcactgtgatacttaggcagtaaaattgataagaaggctattaagtgactaataggcaggctgcatatacactgtggatactgggcaaagggatgatgcaaatcctggggagggatggagtggtatggcatgagatttcatcatgttcatcagaatggtgcagcgcccaatttaaaacaggaattgtttaggtgccaatttaaaacttaggaattatttctgatattttccacttaaaatattcagactgtggttgccaagagtaatgaaaccttgagaaatgaaaccgaggataaggggaggactactgtatttcatgatatgctggtgtggataaaaataggtgcaaccttactgaagttgaccatgaggttgatcacctgttgaccactgaataggccccacagacaaaagctcctgatctgaggaatttcgaagggaacaaagaccacctggtgaccaccaaacgggccagacagaggcgaaactccttttctgggaattcagaagtaattaaactttcctagtatctaaagtctggttccaggcctctttcaacttttacaagtaactaaaatttatatacatctctgaaatgccatgccgaaactctttttactatcctaagctcctgccttaaggtccataaatacctctaaagaaaaatccatggcagcacacttagtcctcttgctgaggcgccccactgcactcttctgcagtgttctgttaccgcctaaggggttcaccttgcccatgcctagacagagtcaattcatcgagacaggggaattgtgatagagaaagagtacttcacgcagaaccagctgtgtgggagatcagtctccccgagcacgggggagcagagttttaaaagataacttcgtgggtggggggaagccagtgagccagaagtgctgattggtcagggatgaaactgtagggaatcaaaaccgtcttcctgcactgagtcagttcctgggtgggggccacataatcagatgagccactttgggcagccaaagtgagtggatcaccggaggtcgggaattggaaaccagcctggccaacattgtgaaaccctgtctctactaaaaaacaaaaaaaaaaaaacaaacagaaaaagccaggcgtgatggcaggtgcctgtaatcccagctactcgagaggctgagacaggagaatcacttgaatccgggaggcggaggttgcagtgagccgagatcgtgccatttgcactccagcctgggcgacaagagcaagactccgtctccaaaaaaaaaaaaaaaaaaaaaaaagagccagtttattgatgtgggtagtgccagctgacccatcaagtacggggtctgcaaaatacctcaagcactgatcacaggagcagtttagggagggtcagaatcttgcagcctccagctgcatgactactaaaccaaaaattctaatcctgtggctaatgttagtctagtcctcagacaagaaggaagtctgctttgggaaagggctgttaccctctttgtttataaactaagtttctcccaaagttagttcagcctacgcccaggaatgaacaagaacagcttggagcttagaagcaagatggagtcggttacgttagatttctttcactgtctcagtcatcattttgcaaaggctgtttcagttcttcctttctaataaactttccttttttcaaacctatactgtttgtaggtatggtaaattcattttaccaacctgcgagttgaccacttcccggtgccagggctctgacaccttgccaggcacttacggaaagataattgtaaaaatctaatagaattttaaatttccatgccttcgaacccagcagccaaacttccagaaatttatcctactaatataatggcacgacgatctaaagagatatgtacaaggatgttctcgacagcctttatttaataagatgtggaaagaaccttaaatgtctactcaaaattgttgaataaatcacatgtctacaaaatgaataatgcagactttaaaaagagtgaggtagctctatgtcaccaaactggaacaataaaagccactataaagtataaaaagcaagctgaagactgtctctatgtttgaaatttttcataataaaaaatgaaaaaaatggagggggattagatatattgccttttcatgagtaagaatctcacaagtcttggacaattaaaccccgccttcatccctcccatctcatcatatctgacctcaaccagtttcctacctacactgcttatatgcccatttgctctatatgactcagtcatttcaagattgcttctgttttcccttattgatataaaaatattaaaaatgtatatttaaaatttgtttaattacatcccattattacagttcatttttgcatattcctgtgttgaaaatcctttggtataaatcaacatcaaaactcggtgttattccacttttcttgaactgtaatcctttttaaacaaggaatataccttttcttgtttagagaatatacgtacattcataaatcttggcaactttcaaaggccataacaaatttgtgttaagaattcagatcccctttattattgtggtaaacagacagatgaaattaagagattatagcttgttttcactctctcccaattactatcgcttgaaaaataccggatatttcattattatcctgtccggagtcggcaaactacggtctactatctgtcttcgtatacgtcaaaagctaagaatggtttttacatttttaaatgactggggagggagggccagaatccaaggggagtatttaatgacacttgaaaatgttattaaattcaaattttagcatccataataaagtttcattggaacacagccatgctcatttagcttttgtttgtttttggagacagagtctcgctctgtcgcccaggctggagtgcagtggcgagatctcggctcactgcaacctctgcctcctgctttcaagccattctcctgcctccgccttccaggtagctgggattacaggtgcgcgccacacgcgccacacgcccggctaatttttgtctctactaaaaagtagagacagggtttcgctatgttggccaggctggtctcaaactcctgacctcaggtgatccacccgcctcggcctcccaaagtgataggattacaggcgtgagccaccgcgcccagccttcatttagtactgtctaatgatgttttcatactgcaaggagaaagctgagtatggaccacaaggccaaaaagatgtcctctctggctctctacagcaaagatttgccaagccctgttatatgtcatactacttgcgcttcataattttatagttttacctagacagtctcccttttttccttccatattcagcataaaatccccttaatatcagtctctaggcaagcacattcttcacagtccttagaactggacctcctcttgttaatttccttagtctaatcacattcctcctggttatctacaaacagaaagccagaaaggagggctatcaacatcttaagcgccacaaattaacaaatcaaaaccaaatctctctctccctccgaagccacggctaaggaggctcactgcccagttagtggctttcaaactacccttacaagtgagacatcttgtgaattagaacaagtgctgctgctaaaatccctaacggctacatagcaatgtgaaaaaaggtatcaaatgtaattttctcaaatttaatcttcttcaattcttggcacaaaaaaaggaacagtaaaggtagacaactgtaattagcatgtgtgatcccaaatctttataccttagatactggattatattttcagcaagtaaatagtttctggctcccaagatgagaggttaaataatgcagggtgtttgtaaacagcagtacaatttacaccggaaattagggccctttctcaccgaggagagtacagcaaaatctgctcatctctttcaatgaatattctccatgactagtgctggcggcggggaggcggagcaagctatcttttctaccagccgtgtcacacccctcctagcactaacccctcctcctcagccttttcacacctctacccactactagcccctccccagccccatcacctcttcccgggcccctcacacctctcccagcatactcttccccagcctcatcacctcacccacttcctccaaaatcactgacctgctaagcttccagcagcaggcgggcaaagcagggaggctgtaatgcaaaagtccgcagtccctacacaaacactatctgctcctgcggagaaactcaagtcacagccccagaagtggaaagaacaggccttggctctcacccagttaacaagcgtttatccagcgcacgtgttgcggtcggaccccatgcgaaggagctaaggacacaaaggtgagcagcagagacgcggttccagctctcccccggctcccactccagcgggataggtagataatttcggtaaatttcgccaagcaggggcaggacaaagagtatttgaagtctaccgcggggagaacttacctaatccttgaatgttaaaaggctaaaaactccactagtcggaagtgacgtgccagcttagccccgcaggtccgccacgtaattggccgccgccacagctagccaccctctccccagactggcccgaagagaggaaaagtgtggaagtccacaagccgcccccgccccgccctcttcgtcgactttcagctgcaccgggaggcggcggygcctggccagagccggggcctggagcctggactagacagcctcgccggccggggcgccagtccagcgccctgcgggcaatgggcttcagcgctcgagcacgcgcatgcgcgggcctgtatctccagaggattcctcgggtcacctggacgccagcatctcagccacctgcccctctgggtcccttcttgcccttgattccccctgctgcttctcatcgccagccctcctcctccttcttccgcaggcaccrctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaaggtaggtgctgtcccgccgccgcgcccgagcctggggcctgcgctcgccggccggctccgcaagccgcgtcccagcgccccgcgactgcgtcaccggccccccgcacgtaaccacagctgcctccgcccgcctcgggcccgggcggacgttttgccgccccggcgacgtcagcgcgtccggcgttgcttggctaccccgccgttcccccgtcccgctgctgctcacctccccgggtgaaactctgacgcagtcaccgcgggtctcggcagcgtcatagcggcgggcatcccatctgcacgtcacacctctttctcacctggacacgcatcccttcctaccctgccagccacgacgtttcctctttcccctctccaatgcccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcaggtgaggaggccacttaatttgtaaaagactgaggaaggggtaggatcaccacaagtcaaagttggattcccacagatagaaatcatctgactgaacttctctcctattgctgacagaagaaattcaaatccaaagaagttatcagttcctactccaaatcaaacacatttgtgtgtgccaacaatatatacaggaacaattgttgttaacctacctcattacatggccacttatctctcagcacatagatctaccaaatttccttccttccagtaggtccctggagaaggatgggggtcgggaggagaaaaggttatggggatagttaaatcaacttacccatggctaaaagtatggatgttttaaggatggagtagggggccagccttgtgttttataaatctctcctatgcatttccaattcttctgaggctgcgcttgagggagatctcattgcctcttttgtgtctcttaattcgcaaccactccaggacctataagttggagacacactatgcccagggtgttagttatcaatagctatattgaaagattccagtcactacaaatagactcgttgctctcttttcaagaagtygttggcctgagctcagcaatatttaatatggttgccataatttatcagttttcagcagttctgagtgtccagatgaacacaagagaaatggaatgttgcgtgaaatgtcattccaagaagagagcagatttcctttaggctagtctgatggataaaaggaagaataatttcagattttcctgaaaagaggaggttgcctttgcctcattcattccatttgttagcctttagagcagtggtatctaaccctttcaatatgaggactctctttgcttatctgtggtggctgataaaaattatgcatggaccttctgtggtggtgatagaacaaaagttatgcatggacttttttttttttaagcttatcagctgtcattagtgtcaatgtattttatgtctggcccaagacacttcttccagtgggcccagggaagccaaaaggttggatattgtgatttagaagaatgagagaacagtgtcagagaatcaagcttagactccagtggattaatcataaagctcttataacattaaactttaaaatatggttaatttaagaaatgttaatatttttatgacattttttacttctcagattcctttcttgtctrttagaaacgtatgtcaaacgaggatacagtgtctggaactattggttctaagatataagtggaatgagcctggatcaggagaagtatgctgagctagagttgaaggaagcttctctttctaacaagagaaagcagaggtaagagacaagatagatcaattgggggttgtgtgtcagtttactaacaagaaaaaaaaggttgatggctgggagtcacaagttttgaaaatggagaaacaaagaggttgaattgattggaagagaagatggagaataacaagaaggggcaaatctggagttaggacttaacatagggataaatgtcgggtcagggatgcaaaaaaaaaaaaaagaaaaaacctccaattaatatttttattttctctgtcctcttccccactcccaagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcycacaccgttgtgccactggacgaygctacacaggagtacaaggtggggaagcagacacacgatgtcagtgtgggtaaaaagggagaagcggcagaggrtgagatactccctaggtagagatcgtaagctcctactactcactttgtattctcagagctgcatatgcaggggcacacagtatgtgtgatcagttgtcctctagcctgaaaaagagcaatggtgagaagtgccctaaaatttctctctgacttttgcaatacatgtgagtcttatgggtgaatattggtatgtgtggtcatatttttcataaatgaatgaaaccacatggaaaagattaaacttaggaagaactgaaaagtagtctggtttcttcattctgcctgcctgctcagaatgctccttgttttcacactggttattgggcataggtaatatcgcttgagactgatacctaccggactaagctgaaccattcaattgtttgcagcttctctaggtaatgggtaacatggcatatcatttaacttactgctgagacaaaggaaaatgtttgaataaagggaacagagatatgaatgtgttagcattttatcatatactttgcttagttatgttactcttgaaaacaagatttcaggtaacttacagtataataaccatgtttttattgtaggtggacagaggtggatgggaggacaggtttaaagagagatattagggtacagaaggttgcttggatggtaataggcagttgcctcagtaagaaaatggaaagagttgagaaaggacacagagttgatgacagctatctcagattcagtaaaaggacagttgggtgagcagagaaggtgatgtggacaggctagtggcaggaggagggactgtagaaagttgacatcccaaatgacrggcaaggaaggaagtcagatcaagaggcagtaagatggctaggaagcaaataaatggtttaaaacaaatggtttaatctctgaatggtaggtataccagtcaaccccaaatgtcacctctcccacttcctccctacccctcaggaaaaactgcagaagtgtctggagcccctggaacagaagctgcaggagatcactcgctgcaagtcctctgaggagaagaagcctggtgagctcaaggtaaaggcaggcaatcccatgtaggctgctctgaagggtatttgcctatgagggaattaactgtacactatttaatccaccagttccggttcattagaaaaatgcagttctcgccggacatggtggctcacacctgtaatcccagcaattctggaggccaaggtgggcagattgcttgagctcaggagtttgagaccaccctgggcaacatggtgaaaccctgtctttactaaaaacaaaaaattagccgggcatggtggcacatgcctgtagtcccagcgacttgggcggctgaggcaggagaattgcttgaacctgggaggcggaggttgcagtgagccaagatcacaccattgtactccagcctgggcaacagagcaaggctctgtctcaaacaaacaaaaaaaacaaaaaaaaaaaaagaaagaacaatgtagttctctcaaaaatgatggcattttattaggcttgattgtcattaaacattgtacttaaattacttgtcatgaattaagtattaagagggatttaagagatgaagaacagacagaatatcttacatctggtgagctgagagagttcgtgcctcttggtctcctttttttgttaaagcagcaaaggaggctttctgctgagaaggcagggatgggagtttcttagaggacttgaagagaggagaatatggaagattcactggggagaaagggaaaaggagctgaccaagagtctcagaagaactatctaatgacattaggaccacattcttaaaactcaagtaagcttacatatgctagaatgttctccccctccccatcctccaccataggatcttattcatctctcaggcgggatgaaagccacttcctatgcagcctttcctgacccttcagaaattaacattcttaattttcatacaattttgcacctcttttatagcattgccttatttgtagcatggtattttggtgtctgtctgtcttccattgaacagtgaacaattatcatttgtagcaaaaataactagaattgagtcctatgcattaattcattaggtatccgtaacattccagatttatagggttgttagggtcttagagttcaggccaaattgggataagtgagacatagaaaagctacgagaaagagacagaaggaaatcctgaggccatctttagtaagatgtaggggtaaacctagatattctttaaggtaggtattattaccttcagcttacacagaaggaaatggaccttgggtaagtgactagtccaagatcataaagccagtaagtggcaaaaccaggaatactagttcttcgtgaatcagtaaatatttgttaagctcctggtttaggccaaacccggtatttgacactggggaacaatgatgagcaaaaacacagttcctgccctccttgagcttaaagttaagtggagaaaataagtaatggcacaaaatgcacagctgcaagttcataagaagacaacatagaaatttggcctcattaaaggtttcccgaagaagtaatgagtttttaagagttgacatgtagagatcaccagaagctaaatccaagttttgattcatagaaacatgaatttttaaatgaatgataacatttcatcagaaagcaagtattattaccttagtgccttatacattttagcaaagtaagcatttgaaattttaaaatttgaaccaattttggttagaaatgtgaacttttaaagttttttgttcttttagaggccttccaagaaacctaaaaatatgaaaatggtgcttattgctagtcattaactttcttcttcatgttgatcaccttcttgaaggtaaaggatggagagagaaatatacctttttaaaaccttctaaatgcttgaacagaactgtcctgttttttaaactgtaaattgtcatttcagtggtctccaaaactaccaccaacattcctcttgtgaccatttgaattctccctccttctccctcatcagactcaatgcccctttaaaaaataatttgtaattatgctgaactgaaaattacaggtaatataacctatgtgcataatgttaaattttaaagagtctatcatgtccaaatataatataatgaaacataattgatgataaaatgtggtatgtaatatttgggcatgactaccctgaacgactttacagtgtagctggttatatgcttgcccctatatgtgtcattatcagcaacgccataaatacaaattcagactgagatggatgtgtgccaatatgattgaaataccataagtagcttagctcttggtgatatgatttttcatagtaataacttttggtaaagttctaagtataacaatataatcttgggttttattcagctattgctgaaaaattcacgtatagtaaaaccatgtaagaattactctgtgtttatactatataaaatggcattcaagcccaggcctatgtttttgtttttgtggtttttttttttttttttttttgagacggcgtctcgctctgtcatccaggctggagtgcagtggtgccatctcggctcactgcaagctctgcctcccggrttcatgccattctcctgcctcagcctcccaagtacctgggactacaggcgcccaccaccacacccagctgattttttttttctatttttagtagagacagggtttcaccgtgttatccaggatggtctcgatctcctgaccttgtgatctgcccacctcggcctcccaaagtgctgggattacaggcgtgagccaccgtgcctggccgcccaggcctgtgtttttgaatatccagcagaacattagaaaatgttgcaggtcagttcactatgccggattgtctcacacattggaggagtgcttgcgtcattgtcaggaacttccccaaccatggaaaacaagaagatgtgcctatttccaaaatatcctcagagtgtgttaacagcttcatcaagaaccactgccctaaaatatagagtgaaaaaaagagaaaagattaccggtttataagaggaagggcctttttgcttcctatttatcacagtcatgaatgttaaacttacacccatacctaaacaaacacacatgcatgcacacacatgtgcaaacacacacacacaaaggctgtgttttattgagggcaaatgtgagaatatattttgttcagatgtacactgagaaggcagtggtggaaagtgaagcagcaagtggccctaaactagaagagctagtcagcctctgccaggaactagcttgaatccacaaatgccacgcttgtcaggcccatcctggctttgcatccccactctctctccaccctcaagcctgcctttcattccctatccacttccttctagagtcccagtctctgcttctcactttgcttcatcatcagtcacatgatgcttggggaattctttctttagggagatcactatttgttgtagtggagatgcagaagagaggatgtgctgataattctcagaaagtgttatggctggtgtttgagtcctatattatcaaatttcaggaatgttagaggcttaagtctgtgtgctggcttaaagaaagcatgtttcaaatttcaagaaactaaattactaacaaacttctgtaacctgttcctggggtaggaattgccagttctctgaagtgacttgaaacaatttaacaagttcagccctgaaatctacatatgtatattttataataacccatataactcttactgattcttacactttcccagttctctggtttttatctggtgcatgtgttgcaatatgcaaaggatgacaatcttatttttaactttttattatttgtactttcctttttgtttcgttgttttttgtttgcttgttttgagacagaatctcactcacccaggctggagggcagtagtgatcacagcacactaactcaaactccagkgttcaggccatccatcctcttgattctttttgagtagctaggactgcagatgtgcattgccatgcccgactaatttttttttctttttagttgaaacaaggtctcactatgtttcctaggttggtcttggcctcaagtgatcctctcacctgggcctcctaagcactaagtttacaggcatgagccaccatgctgagcctatactttccttttctcgacagattgaattaactagaactttacagttgataataacacagatatctctgatatctgtaatagttaatgtcatcatattattgagttctttatcttaaattaaaacaaatatatatatccgcagtggtcttcactaccaagtcatcagtaggggggtgatagtgatggagccattctttacagaaggaaattccaatggaataaaaaatgagtgttctgttaaaccattttctctcattttctttctttcttttctttctgtctttgtctttctgtctttctttcctgtctgtctgtctttcatctcgatctgttgcccaagctggagtgcaatggtgcaacaatttcagcttactccaacctctgccttctttgctcaagccatcatsccacctcagcctctccagtagctgggactacaggcatgcaccaccagactcagctaattttttgtattttttgtagagttggggtttcaccatgttacctaggctggtctcaaacttctcatcccaagcaatccacctccctcggcctcccaaagtcctgggattacagtcatgtgtcaccacacccagcctttgttaaaccattttcaatgaaactggaagtctgtgttaattcatacatatggtgggtgagagaaaggcttccttataccacactgaccctgctgatacaacatcttccctctcttctcagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggttcgacctttgcccctgcatagcccctcaggctgagtgcagcgtagctttgcgtagcctgggatttgtcagcctgggatactcattcttctgctctccttctctaaatccagttctttctgccaggtgtactcaaagggtctttgctacggaaaagtgatttctcccatccccttctaaccatttttgtgttcttatctctggtcagcaattatgtgcttaatctgttccaaagaaaagattcattcttttgaaaggagggaagtctagcctgagttagtgaaaaactatgcattaaaaattttgtaaatgcagttaccattacttttaagtcctgaaatttgatttatgtactgctgaaaaaggacagaaacatagtttaaaggatacaggcatacctcagagatattgtgggttcagttccataccacttcaataaagcgagtatcttgataaagcaagtcacattaattgttgggtttcctagtggaatcatatttttgctggtggagggtcttgtgttagtattgactgatcgaggtggtggttgctgaagattggggtgactgtggtaatttcttaaaataagacaacgacgaagtttactttcaactcttccttttatgaaagatatctctgagcatgtgatgctgtttaatagcattttactcaccagtagaacttctttgaaaatctttgaaaacccacatttgcagttacttacaacatgggagtcttgaacccctaaaagtcatccataagggttggaatagacttcttctaaatgcctgttaatattgatattttggcttcctttcacaaatcacaaatgttcttaatggcatctagaatggtgaatccttaccagaaagccttcaatttactttgcctagatctatcagaaaaatcactatttatagcagctttatgaaatacatttattaagacttgaaagtccaaattacttcttgatccatgggctgccgattggatgttgtgttagcggacgtgaaaacaacatgaatctcattttacatctctatcagaacttttgggtgatcaagtgcattgtcagtgagcagtaatattttgaaaggaatctttttttctgagcagtaggtctcaacttaaaattttcagtaaagggttgggcacggtggcttacacctgtaatcctatcactttgggaggccaaggcaggtggatcacctgaggtcaggagtttgagaccagcctggccaacatggtgaagcccaatctctactaaaaatacaaaaaaattagctgggcatggtggtgggcgcctgtaatcccagctactcgggaggctgagggaggagaatcgcttgaacccgagaggcagaggttgcagtgagccaagatcatgcagttgcactcctgcctgggtgacaagagtgaaactccatccccccaaaaaaaacttcagtaaaggctaggcacgttggctcacatctgtaatcccagcactctgagagatcaagccaggaggactgcttaaggccaggaattcaagaccagtctgggcaatatagcaggaccccatctctacaaaaggtaattttttttaattaaaaacattcagtataccatgctgtatacaggtgtactgtcatgtaggctttgttattccatttctagagcacaaggaaagtagatttagcataattcttaagagccctaggatttttgaaatggtaagtgagcactggtttcaacttaaagtcaccagctgcccttgcttctaataagaaagtcatcctgtcctttgaagctttaaagccaggcattgacttctctcgaactgtgaaagccctggatagcaccttcttcaatagaaggctgtttgttgacattgaaaatgtgttgtttagtgtagccaccttcatcagtaatcttggcaagatcttctggataacttgctgcaacttctgcatcagcacttgctgcttctccttgcacatttttgttacagagatggcttcttttcttaaaacaacctacctaactttaaacttttcttctgcagcttccttacctctctcagctttcatagaactgaaggagttaacagccttgctctggattgggctttggcttaagggaatcatgtgatcttatatccagatcactaaaattttctccatctcagcaataaagctgtttcactttcttatcattcatgtgttcactggagtagcacttttaattttcttcaataacttttccttagcattcacagcctggcttggtgtttggcacaagaggcctagctttcagcccatcttggctttcaatgtgcctttctcactaagcttaaacatttttaggttttgatttaaagtgagagacatgtgattcttctttcacatgaacacttagaggccattgcaggattattaattgatataattttaatatcgttgtgtctcggaatagggaggccagaggagatggagaaagatgagggaatagctggtagtggatcagttagaacacataaaatatatttatcgattaagttgttcgtcttatatggatgcagttcacagtgcccccataacgattacaatagtaacatcaaagatcactgatcacagatcatactagatataataatgaaaaagtgtgaaatattgtgagaattaccaaaatgtgacacagagacatgaagtgaacacatgctgttggaaaacatggtgccagtagacttgctcaacacaggttgccacaaaccatctatctgaaaaacatacaatgtcaacaaaacacaataaagcgaagtgcaataaaatgaggtatgcctgaaattgtttaaataatatattgcttttgatatgtatatattaataatacctctaaagtgtttgaaatattttgttctcttacgtaaatgaatggtgttagcaaaactagggaacatattttttatcttagagattagattaccagcatttgaagcagtgaggcttcattgtacatttatttttatgttacgtattgcttggtatttgttcctatggcctttcatgtatgtgtgttctgccttccatattaaactgggaaatccttgtgggacagagatttgtcttctttgtcttctggaccccaagtattcacaaatcagtattagcacacagttattaatgtgtttattcttscttttttttttttctgagagagtcttgctctgtcgcccaggctggagtgcagtgcatgatctcggctcactgcaacctttgcctcctgtgttcaagcgattctcctgcctcagcctcctgagtagctggggttacaggcgcacaccaccacacctggctaatttttgtatttttagtaaagacagggtttcaccatgttggctaggctggtcttgaactcctgacctcaagtgatccacccgtcttggcctcccaaagcgctcagattacaggcgtgagctactgtgcccagccagttattgatgtttattaactaatgcaagacaggggataccaaaccgtaacaggaatgtgtgatttgttcctatgccaccagtctggaactctctgtacttatcctcaaggagagtgagatatgtggttggtacttgggggacagagtaaagaattgatacaatccctgtcccttatagggagctcccagcatccttgaggagcaaagacaagcataaaagaaatcattgggaagtgatataaatgaccaagcttcatgatgaccagaagttgaaagtagggattaggttgggagaagtgcattcaggtcccgctggagctcttcttgcactgtgtgaccctcagtttatcctatccctattttatagctgtggaactttggggaggagggggaaccttttgccttcaggaccactgaataccaggaccaatattgctttcttttctccttccttctaggatgtcaaaagtaccctggaaaagtaagtgattgttgtatctctctgagtgagttaggtcttggcttagagaggaggggtacagtcaggagtttgggttgggggtgaggttgggaaagtcatgtagtgtgtctgggcagggtatgggagaatgttcattgtgcccatgaagccagttagagaacaaattattgggaataataatcccttttcccctttgaacatcaggacttcttgagaaggagaatgataaggtagaatcagattctacttgtgccagtgggtggaattgtgtccaaacaagatggcaggaggaaggggttgggagagcagggagggcaatcatccatttgcatgaaatacaggaatattcctagaaagttcggaggctcactctcaacgatctgtccacgggatcataaggctctccttggattagtaaaagaaatcaacaggtgagcttttcagggaggaggaagaaagtgggaagatggagaattttaatttctccctaaaaatgttaacatctgaatagtcacttggctggagcttctccctaaccctgccctttcttcccctatctccctatccctcctagatgtgaaaaggtgaagaccatggaggtgacttcagtatccatagagctggaaaagaacttcagcaattttccccgacagtactttgccctaaggaaaatccttaaacagctaattggtgagttgttcccaaaaggaaactagaagaaaccactagagagaagaaagtttttaggtcctaccttatatgggtttcagttatcctatgtctcacttttcttaytcccacacacacctacccctttatctggcttttagtctcaccctgagtcacagaacttggagtgagaggaagccttaagcgttatctactcttaggtccattcttttctaaatagagacccagaaaggttaaataatttgccaaagtcatcgggtagagtggttatataatttaccatgtaaacttgcataaccttcaaaggccgggtgcggtggctcacatctgtaatcctagcactttgggaggccaaggctggtggatcacttgaggtcaggagttcgacatcagcctggccaacacggtgaaaccccatctctactaaaaatataaaaattagccagatgtggtgttgggcgcctgtaatcccagctcctctggaggctgaggcaggagaactgcttgaacctgggaagyggaggttgcagtgagctgagatcacaccactgcactccagcctgagggacagagtgagattccatctcaaaaaaaaaaaaaaagaaagaaactgaaagggagtgtcattatattaatgtgaatatgcagggaaaatagtcataaaccaggccagttcctggaaaacacacatggtcaccctatccctaraccatatgctgtcttgctcggcatccttcttaacactttccgtttttttctgcccctcagactacaccttgtacttctctacatagtgagataaatgataatgtcagagggagatgaagagaggaccaggcgggaacctagattaccagccactgcagactcaagagattattatctgtttactttagggtcagggtgagaagtgagccattgctttctccccttccttaggtgacaccatggattgagaaagttaaccaaaccaggttgttctggggacctttaagggaccaggctctgtaaaggcaggctggaagagtgaggcaggggcatttagctattcccatcctcatctagctccccactctggcttctcccgccagcggatgtgaccctggacccygagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaaygacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtraaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtgatctctgtgttgtgtggtaatttggtgacagccttgtactgatgtgtaagaatcactgggtgttagacatgcatgttcctgggtctcacccttagtggttagtcaaggtctggggtgggccggacatctacattttatttatgagacagagtctcgttctgtcgcccaggctggagtacagtggtgatctcagctcactgcaacctccgcctcccaggttcaagcaattctcctgcctcagcctccagagtagctgggattactatggactatagccatgcaccaccacacccggctaattttagtggagacagggttttgccatgttggacaggctggtctcgaactcctgaactcaagtaatctacctgcctcagccactcaaagtgctaggattacaggtgtgagccaccgtgcccagcctacatctacattttaaacacaccactctcatttgagtccgaaaacccttgtgaaactagttccagaggaggtttcagccatgtccttcctcccagctggagccctgcttgtctgtccccgcctggcactgggtctgaaattggagagaagtcatcctctcctgacttatgctgccctccccatctcagggttcattgatcttctacccctccaattcatgtccctctgcttctgacttcagtaactgatagtcactatgagtcacaggacaccagacagaagaactggaagatagaagaggtcagagggaggggtgtgaggtgaatgtcagtgtggggagtggggtgaagtttcaggggcaggggatgctgttgacagatttctgtgctgtacctaagcctaggagttagaaaccattcactcagaaagtgaggatcacctactgtgtgtccagcactgcataacaggaagtgtgtttctttggtaggtggaatagtaggagtaaactgtgctttctgaggaccgggagtccttttccctccctccagcaccctcatgatccttcccactttcacccccactggcaccagtgcttttttttaatgtattacctctgtgccttccgtctgtagatcttacaggcatctgcctcggacctcaggagagtagggcagaagctctagctgggtataaattgcacataaccatctccccaacgtagctacataaagagaccagccttctgtcctgaaaatggccgatttaagatcctcacctgctccactaggtctctaggtgatataattggtcatgagcttgaggaagacaaaagcactgaaaattcataaagggaccctgggcatggattgctggggttgtgtttagaaaccgatgagtttgtgaggcctccgggaggctcccgagggcgcggggactacgtttcccaggaggcttcgcgcggacgcccgggcggggctgtgcgaggggtggggctgcgggaggccctggagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcggtgagacagccacggggcgggcggcgggcgggacgcgggaggaacgcgagagggagcgcgggcgccagaccactatcctcctccgcccccagggatccctcggtgaagaggactctctgtcgaggctgctcttccctcctcgtcccgggcctcacctgcacccagcgccagagacgtgagtgctccaacggaggtggaagactgcggagcattgggggcgcggaggggggcggggtggggggcgggcactggaggccaacagcgcctttctcactgtagatggatgttgggtgtgggattcgcaggagtcttccttcttcgggtttggattaagttcctaacgccacttgcacaaactagggtttgggctcggctgttttttttttttttcttccagtgtgggcaataaataataacttttaagaggcaaccccacccatgcacaataatagatgttgttcggctttgtggaggacgattcccatcaccattcatttattaagcaaatacttattttctaaaatgtgtcaggtactgtgctagattcattattctcattgaaattacggtctgatgggacagactaagaaacaaaatggtgtagaaaaagattaactgggggagtagaatgctcacttactcatgccagtggtggcgaagtttatgataagcaaagggagtgagagatggaaattctaggcatgtgtgcagactctgagacaagagagcttgtggtgctgtcaaagaaatgagagttcaggaggctggagtttgaggtaggagggcaaaacatgagactggagggggaaacaggccagttcttgaagtcttgttagggagtttgaactttatcttaaagagttccaggaaatcgatggagcttatgccgaggcctgacaccatcaaatgtgcattcaaattgggggtgtggtgggggagcggggatacctactgaaaaacactggaggcaaaactggcagcaagagaccgttacttctaaacgtggacagtctttttcccatgttcaccctaggctgcaggggacagcgctggaccgtacagacctgcctaacatgccagcgcagccaacgcttcctcaatgatcccgggcatttactctggggagacaggcctgaggcccagctcgggagccaagcaggtgagaggtgagggagaaaatggaggacaccccagaggatagggacaatggagaacgtagagtgaagaggacacatggacaggttctgggttggtgtgagaagtaccacagtcagaaaactaattctgtttctctgattctgctcatttactcagattccaaaccactacaacccttgccaaacacagcccactccatttcagaccgccttcctgaggagaaaatgcagactcagggttccagtaaccagtgatggattcaccccatctcccaaataaagtttacttgttttacattccatgattctgttctgtgggtatttcaactcttaattccattttcttctgtttctgtctgtgtttcttggtcacctttgtaatcccaccatgcagggagatcgtgatttccatagaccacttggcctcactcagcagcttgcatttccaaggccatggccccagttccctatcaatgtcctgagccaccttagggcattccatgtttgggcagccataattgctgactgaagagctggagagaatgatgccactgctgctgtttttaaacaaggggagaaatatggggcagcggagagtgtttgtatcctctaggcccactcatagtcagaaaagactcaggtcttttcccagtctcaaagttgtctttaataaaattctgataaaggaaatggcgcaaacctgaactaacaaagtcaaagatgctaacaaaggacaccgacagacattttgcaattatgtcccataggtaaactctcagagttttcttaagaataaacaactaaaatgttttcttcgatatccctagaaagcctactgaagtacagaattcttagactgacctttttgctaaatgccagctaataaggttataccaaaagcatacaaacaaaatttactacttccagaatgcagttttcttttatttctcttataaaccctgtgtttgcttatcgatagctgtataaaaaaatcacttcatcatgttggagcttaaaacataatgatttattatttcctctggttctgtgaactaggaattctgaaagactttggctgggtggttctcctgttacatatgaaatcagcttaaatagctgcatttagctgctatctcgtaggtggtctggaagacccaagaaatttcactcacgtgtttagcacctcattgcttctccaagtagccttgctccctcgctagctttgatgttcccacagcatggctgactcagggtagttgtatttcttacatcccctctggcttctacaaaagcatcccaatatgtaagtgtttggctggatgctgtggctcacacctgtgatcccagcactttgtgaggccgaggcaggtggatcacttgagttcaggagtttgagaccagcccggacaacatggtggaaccctgtctgtacttaaaatacaaaaaaattagcagggcgtggtagcaggcacctgtaattccagctactcgggaggctgaggcaggagaatcacctgaacccaggaggcagagttgcagtgggccaagatcgcgccactgcattccagcctgtgtgacagagtgagactgtctcaaaaaaaaaaagtgtttatcgagcctctgttggggtcacacttgctaatgttcccttggccaaagcaaggcacagtgccaatgccagattcaatgtggaaggggctacactggagtttgaacgctgggaggttcattagttccctggggatcaccagtgtaacaatctaccacaggggtccccaacccccaggccctgtggactggtactgggctgtgtcctgttaggaaccaggctgcctagtaggaggtgagcagtggtggaagggagggatgggccagcattactgcctgagtaatcagtggcagcattagattcacataggagcatgaaccctactgtgaactgcgcatgcaagggatctgggttgcatgctccttatcataatctaattgctgatgatctggggtgaaatagtttcatcccagaaccatacccttcctgctccatggaaaaattgcctttcacaaaaccagtccctggttaacctgtccctagtgccaaaaaggttggggatcactcatctaccacattcttgttttgcctttgtccctgacttggtctctccactgcctccttcacatgtcagtaaattatttgcgtagaaaatactaaacagtgtacatgtaagtaaatgtttctgagtcatcctttgacattttatttctggaaatagtgcctacctgggtcaactttcagtccaacaaaaatgtgtagcctgaaagtaacacctcgtgcatacctgggtcctttgcatcctcagctcaccttccatggctcctccagtaagtttaatttgggatgactgagctcgactcttgcacacttaatctgatctttggctaagtttgtcttgagtgtgttatgattgcatgtgactgaacatgtctacagtgggatagcagtggggaaactgagtttcgatttcatggctcagtcactaagtgattcctctcatgtgggagatcatgggaatcaggtcccagtcaggatgagcggcagacaaaacagtatctggaatctggttcacttgtgagtctttgtggtttctttatttgttgtgggtttctatcaatatataactctaaagatcacagccctcttcctctttccacagccctcttcctctttcctttttcatgtttaattataaatatatgattacatatataacatttatattctatacattgatacatgattctatgtattaatacagatacatcataaagatatataatgtgatagtggcatattatatgcaaaaatggatttcctagatgaaagatgaaaataaactgaatccctggaatgcagtagctttctcaagtgtttctagaagttcaataactcaaaatttatgcccttttaggactctaaataaaattaaaggagagagaagaaacttaggttattcaaatcgaatcaagaaatgaggtcttccagtaaccatagaaactatgccttagtcactccctgaacattaagttcatttagcactttcaaaactagtgaaaaccagtatcgttattgtcaggaggcaaaagagagaaggattgagagactgttattttgaatt

SEQ ID NO: 10872 - DNA, 16162 bp, Homo sapiens
ttaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctgtctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagtgggtattctttcccctccctctgctcagtctgtttgctaactaaacaaatccagtgatttatttttttgtacgaaatggccgtttcccttggtcccatcccttatttctgtgcagttctggtaatagggagatttgtagttgttttttatttttttaagttacacttttttaaacctttttataaccagtgaaataaaccttttaggattttttttttttttttttttttttgacagggtgtcgctctgtcacctagcctggagtgcagcgaggcaatcttggctcactgcaacctccgcctcctgggctcaggtaatcctcccacctcagcctccaaagtagctgggaccacagacacatgccaccacgcctggctttttttttttttttttttttttttttgtatttttagtagagatggggtttctctatgtttcccaggctggtcttgaacttctgagctcaagtgatccacccacctcagcatcccaaagtgctgggattacaggcatgagccaccccgcctgacctacttttaggatatttaaaaggaaatgaagaaaaaaaaaacaacataagaagcaggtattgtttagtggtcagcatcttatactgcagtcttcaaccgcagtcaaggtagctttctttggagagaattagtcacacatgacttagagaacatgggctttctgaatgcttttaagacctcatttttgtctttggtgttctgcagtcactatagtatatcaaaatacgattttcttttattctgtttgggatttgttggactttctgaaactgagagtggacttttttttcatcaaccttggaaaattatcagccatcatctcttttaatattctctttcccccatgttctcagtcctcacattctggacctcgaattagttactagaaagaggtttctctcttctgtcctccatttctctcaccttcttttcatattttcaattgctgttctctttatgccaccttctgagtaatttcttcaggtccctcttccatgtcactaattctgtcttcagtttatttcaagtattattattttttactattgttattattttgagttctatttaattacttttcaaatctccttaatttttaaataattatcagttctttaatcatattttaaattgttccttttattattctttaaatatatatttaaaatattaaatatggttattatattctatgtctcataattctgatatctgcggattttgtgtgtctgatgctgctgtcttttgtttctgctgtctctctcatagtgctttttttctttgttttgtgatttttgactataaattcgagttttttagaacttgaactgtaggaattctttgaggccttgggcgagtgctgtattctcagcatttgtgtttcttttctaggtgccttgaagcactatcaagctggaattactttaaataaattcttggcttcatgttttttggagcagacagatagtatgaatttgagctgcaaatccatgtaagggctagcttacagttagaaattctcaggagagagttttctctctttctacctactgagacagtcaaattccccttctatagagttgaattttttcttttcttgttcacttttacaagaaagggcagccttttgcagttcccaaatttatgcacgggatctcctatcagaccttatacattttgtccctcatttcctatgcttccagtgactgtcaaaacagtataaagggcaccatagtgtcactgtcacgtttcatagggacattagttttaacttccctgtctggatttctggttttacagaacttttaaccagtgtgcagattgcctttactttcttgccatctcatcaaaggattaaaaatattcatagtcagatatatcttttaaaagtatttttttcctatcactggttgtcattttaccaaaaaaaaaaaaattttttttaaataaaaagaagattttttttcccagcgtgtggcttgcctattttcttaaccctctttaaatgagcagaagttttaagtttttataaggttcagcttatccttttttttttcttttacagctagtgctttctgtgtcctaagaaatctttgctttgaggttataactcattggatatatttttaatcccagaatttttagttgtcttggaattagaattggaagtttgtttaggggagccagtcctcaatgatgtcataaataaaagtccttccttgattatttgattgcatatcttatcttatactactagaaactcatcttttggtgaatataacaagtcctttctttcctcataggttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgacatatgtatgttacttataatctgtcttattccaaaaggaatttaaatgagtttccagagatatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacagaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaagccctccttttcctcctcctgagcctactcaacatgaaaatgtgatccacttctacttaatgaatagtaaatatattttcttttccttatgattttcttaataatgttttctctagcttacttgattgtaagattatatgtattataagtatataatacatatacaaaatatgtgttaatcaacggtttatgttattggtaaggcatctggtcaacagtaaagttttgggggagtcaaaagttatatatggatttttggctgttcagagggtcagcaccccttacccccatgttgttcaaggatgaattgtatatctattataatagattcttatatagaaagaaagaaaaaagtaaagtcacaaggaatcctactccacagagataaccaaattatactgtatatctgtgcttgtgtatatgtatgtggctctgtatatgtgtgttgctatatatgtgtttggtttttttaatggactagacatgctgaactatatcttgcttttttctgtttgaactaaaaactttcaaggggaacaaatgcatactcaggtcccgcattccttggctcaaatagtgatcaaggggttactgtaataattatcatataattgtgtggccctttatatatattcagagctctcaaacatagctatcttgtttgacccccacagcaacctggagaatgggcagggcagtcttccccactgtacgtttgaactgttctggcagttgactttcctgacccactcctgaaatctgaaacaaacctgttcatgtttctaccctactttaagcctttctctggcccataacagtgattggattaagcttaatttcttagcaaagcatacaggttcttccatataaccactgcctacctgtcaagcttcatctggcactccctcagatccaagcggtacaaaactccatttcctgtagtgcacacatctacaactttttaagctgctcttctaaaaaaacctacttgtcggccttcctggttcttgttttaccactttcttttgctctctaagaaacgtgcatatatttttataaaatagcctatactgtaatttacgaccatttctctgcttcatcctactcatcaccccagagagaacgaatatgttggcagtatgtaactacattcagatttacaaatcagacatggcatttgttaatgccccagtgtttcatatttttgttagttttcagcatgcctgtctttcctactagagctaaaaggcagggtctgagcgtcttacgcgcctccatcttcaaggcgtagcacagtgactgaaaaaaactgacgttgaacgtgcactaaactgaactgctcaaacacctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgtgagtacgcgtgctgccccagactctccctcctccacccacacccgcagtgacaccccttccgccaaatttgtttctctttctttcagcgcctgcgcgctgtcacgttacggcggaactaatccagcgacgcctgcgctttgacgcatttggtgccgtggaagggaaaaagggggactgcagtatgcgtcacacccggaagcggcgagccggaagtggggttagccaggttatccccrggggtggagaagcggaggcccaggaggagggggaataaagaaggtggaggatcctggctaccamtctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgtgagaaaggcgggggggcggtgctgtttaggggtctgggagatactgggagggaggggacagggattagaagagttgttggagkagctaggcctagggatatgggaggtgtggggttgaatatctagggctgggagaatcggaaggtattggagctatttggagtggcagagatggtgcaggaggcaggtcaaggaactkgtaatagggaggtacagttaggatataggtgttgctgcttggggtggttwtgtgtgtaagtaataaacgaaagggaaattgaggattaaggagccaggaagatgttgggaggaaatcaaaggtagtgtaagaaagcatggttggaggccaacttatcaatattatcaatattgatattcgaataaatatttattgaatggatgaatgtaaaaggaagtggcaggaatgaggaaacaagaaaaggagatgaaaagaggtattttgagaaatcagagagcaaagatgtaaatggagaaacaagaagtatttatccaaaaacatgttaagttgccttcaaagggagaaggttgcattgggcttaatactcttggattaaaggaagtttagtaattaatagattagtaatacttgctactagagatgccaggatgccagagaataggtggataagaggtagggagggctggagcttgagaatgagagaggttttgtttgtttttttaagagaaaaagaataggggatctggaaaaaggaagggagatcaaagattaggtgctggggactgaaaaataattttcatgtattaatactaccaaggatgatttggggaggaagacggagaaamascaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgrttgagctaaagaagaaaagagaggaggttccctgggagggagtgggaaaggttagtaagagggsactagataggtatgctcatccttaaccttctaggagaaccggagccttaccatcaaacttcggaaacggaagccagagaaaaaggtagaatggacaagtgacactgtggacaatgaacacatgggccgccgctcatcmaaatgtgagtaattgttggcccgcagtagccctggagttctggctcccttcagcatatcttgtatctactcatatccactggctttccagaagcccccagatgttcatagttctgtcacttttttggtggtgctgtggtatcagggaaagaggtagggaagggctagaactggaattgcctaggtctgacagcaagaagtgtcagaggtgggagaagtggggctttgaattcgtggctctctaagaggacaagaggggtggggcctgagtcccagagggtgggcctggggaagctggatcctggaaggtaggagaaaataggaattttcactgagtttgagtgggaatggaactgactatatatcttacccttcctcctctttaactgggctcctccctctaaatctaggctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaayaagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatcyggttttcattttccggtccttttgccatacacagttacagagatcagtcaaatccataccaccactragatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccrgatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagyagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcagctgcagggccagtggccgggccaaacttctagttggagacgagactcagctttccgctggtacaatgcggagcggagcacgagggtcgcaggtgcagaacagcgggaagatgcgctcccccagggggccaggcgcctggaaggcgtaaagcaggtcgagtgagcggccgtcgtagaaggccacgcggccccgctcccagtccaggtccacgcgaatgcgccgcggcgggggctcaacaccgcccagcagggtgggttcgggtgccgtgagggcccacaggcggccgccgcggccctccacggcccacacggcccccgcagggcacagccttacgcagcccttgcgttgcactgattccccggccgcgcccactgcatagtggctctcctcgtcgtccgcatcctccccagaagagtctctgcaggaggcggcgtccgcagtctccacctcccagcagtggcggccggccccgaagccctgcgcacccagcacagctgggagctgatcgaagcgcttggggccgtcagggggcgcgggcgtccctggtggggccagttgtacgctgcggcggtcggcggagatgagcaggcggcggtgtgcggtcccagggtccagggtcaggtcggctggagacggggaggcagggagaggacctcatgagagagttttctaaatcacaggcggggtagggtggagaatagtcaacgaagatcacgtaaaagactgagagctagtgaccacacaacagctcaaaaggcgactgcaggaccaaaaagaaggaaggcatatgaagagcagacctgggcaatatcagaccttgtactgatgcaccacttctgtagaattggacctggggaaggatcatactggcccagtgcagggagcacagcaggaagatcaaatgagaggttgtctcgtttgtggggttgggggaggaagagtgaggctgatctgacttcgagggaggagtaaggactgatacctcaatctgcatcatctggggtggggcatgggagctgggtcagcaaaatggggaaggttcatctaaagagaaagtcgtactgatactggaacctcaagtaatgggaggggcacagggaggaatccaaggtatcctgagaaaccagcccacccacccacaggaattggggggtggggtggacagtcctatttctgtaggggttgtggggcagaggaggagagcaggtggtgatagccagagaccagaaaaagaaccattggccttatatgtatggggtgctttgaagaaaaatttctggattaggggtgtcagaagcaatctggactgggcaagatggtggatgaccaagatggtggaccaccttctctaggcagtttaaagaagggtagaggcacccttcttcttgggagtgagtgaggaaagaagggtcaaggagatgctggggtccccttccagggaggagtgacgagaggtggtggaagcagagatttttgagaggcacctaaccttcagggatctgttgtttgaatgtatgaaaaaggaagagggaaaatggctggaatatgaggaatcgaggatagacattgttataggctgaactgtgccctcccccactccacacacacacacaaagataggttgaagtcctccaaacctcagaatgttaccttgttttgaaacaggatctttacataggtaatcaagttaaaatgaaggtcattagggtgggctctaatccagattgctgacttacaaaaagaggaaatttggacacagagacaaatgcatacaaaagaaaatgtgcagacctatcacccaaagaacatgtgaggctaccagaggctaggagacaggcatggaacagattctgtctcatggccgtcagaaggaaccaacactgctgacaccttgatttcagacttctacctcctgaactttgagataaatgtctgttgtttcagccacctactttgcggtgcttcattagagcagtactaggaaactaatgcagacatcaaaaaggacctgatcactttttagggctaaaaggaagaaaatctaacacagactttcattcaattcccttccctcccttcttctttccttacctgtcagtctatgaagcatttttttgaccactggataatcttcagggagatcatcctctgaattagatgacttggatgttgggacttcaaatctacacagatgaggggaagggtcaggaaatcagccctctgatcctaatgcccccacgcataccccactcacatctctggaggaagaagggatgagactataccccagaaaacctgcctattaatgggaacaaaggtgtgggcccagtgagaacgtgatggctatggcagctggtgagaaaaggagggaacagaaaagtggaactcaccgtctccatgtcttcctcatatcctaggatgggcagaaacaaacatggatgtgagctctgggcttcattccctggggcatccttccctatctctcccctcctcaggtgagttctgtctgagttagcagtgtccctcctcacctttcagagtgatctcacctctttacacactgtgctcctttccctctcattctcctccttcacctttcatgatccctccttcctctcaccccatcacttttccctcatcctcctaactccatccccactgtcctccccctttccactccccaagggttctcaattctcttttcccaggctcgtccatgactgtttcttgtcctcagagcccttgccttccttgctgcctcctcagtcccattctctgtctctttcagcggccccatccttatctaccttccccagtgcatcccagaaaaacatctgtcccttcctccctccatcacacagaccaaacacacacccagagccctcgggctaagagttggtatataaaagccttacaataaagctgcttcccctcttgcaataaaagcccagtggcatttattgggccctttgctttgtgtctctggaccctggccagggaggcagctagacttgaatgtgtcccaaaaggcccagcagatccacagagtactatgggagccaggagagggcactggatgctcccctccaaacactgggataccgacccctccacttcactgtctagtgctgatggctggagcaggccgatatggtggagcgggggagagagaaacaatttgcataattgtgccaattactttcagactaattaggtctatgaagacttcaaagggcagaagcaagacccaagaccagcttggctgctgggaagaagccagtcaggagtcccagacgcccaggggtcggtcgggcaagggaatgggctggttagtggccaaggagccggggcccaggagaggcgcggggggtagatgggtggtaagactgggatgtggagaggagccagaggccccagcggctgttctcccgcacctcgcctccacccctggccgctcctgcctggggccttgggaggagccgaaataacaataacaaacaacacagggcttagcttgagccagagtccgagaccaacccccacgacgctacggggaggtttggatatgccccaaccccttgctcccttcctccatcctcttgtcagtcccctcctccccagctttttctccgcccccaacccaccagcccagcctcctgctcccgctcctctaagcaggttctgccctcgcccaccatcctcccaggacccctcctcaccctcagctgggtcggctctcccttccgcccgccgctccctcccctccgccagctctcctcctcccgggcgcctgcggctgccctgccaaaacttctgcagttcccatgcccttcgcggcgactccagggctctccgcgttctatccggtaccccttctctgcctccccagtctcttctctccagcccctctcacaaggctcaggcatcggtccagcctcctcccctgtggaccaagtgtcaactccatccatcgtccttccgggcgcctctcaccttgaggacccagggtcctcgccccctcatcctttgcttttctctccccaccccatcctttgcctaaacttccacagggcctccggctccagacgtgccattcccggcttccccgggaatctcccgcttccaccaacaactccgcgacgcgcgcccagcctcacctctccgggcaggtccaggcagcccatggtggggatgcgcccccctcggcgtctccccgcacgggccccaggctcagccagcttctctcgcagctcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcctcatctggttctcctgcttcccgggtaaggtttgggggagcagggaggggagaatagcacacctggttcccagagcctaggaggcggtcactagagggcgctctggggcggggtagccctgtgtggggagggtagccccctgtgaccccccgaagagccccaattttaccttcccctccgcctgtggtacgcgcatgggccgggtgcccaggctcactcttggcatgtgcgcccacattgccaaggtgcgagtcattccaggtggctggcacacctacatctgggggctgggggccggaagcacagatcctggtttgtgtggctttggcaagcctctgagtgttgatgtgtggttttcattcctggtgcctctcgcctttccatcttccttccttacctattaagggcttaagggcattctgcagctctggggtaaggggtggggagcaggcgcccacacttcggcctcagggagtcggggcagagctctttcagctctacctctggccagctcccagggcctctccttactttcttcgtaagtctctctttctggttctttctctctgtttttccccgtgtgtgattttattaccagttttctctttccttccttctttggaatgtacccggtattatctatttcaactctggtagttcacagaggcccagagaactggaatagccaaggtcacatagcaagggaatgaccagaagtggagccctaccctggtcttctgacttgtgttcttgctgtgactcaaccctgcctttttcagttgcagatccctgggaccccctcctgcttcctgatttttttctggtgttcctttgtgccttcattcctcacctccattctctctttttctccttacctgctcctctccccacctctcctcttcctccctgctccctcctcttcctagcttctctacccttccaatgccaggcctagctaactggatactcatgggggtttgtgcataagtaaacatccagatgtctacaactatgatcacccacactgttatataacatgtgtctgcatccatcagtgtccaaatgcccaaatgtgcacaaacttgcagacagaagcattcatgtaatacaaacatcacagctaaatataatgtgtatgaatagcctcatatgcattgaatatcactgggataaatgtccagtattatttaggaacagacggacatgctcaaagaaaacaggcaaagagacagatactctatcatcagttttattattaataagaataacagtataacagcagtaagtctttatggagcagcaggactttattaggcaccccctccaggcactcttcttctgcctcccccatacttatcggggagacactcaaatatgacaccctgataaacaaacctacacaaacaaacacacgtacattcatcttggaacaaccctcccggctcagtgctcataaaacacacagatacccaagcataagactacagttgtgactgaa

SEQ ID NO: 10873 - DNA, 56836 bp, Homo sapiens
  misc_feature (1)...(56836): n = A,T,C or G, or insertion/deletion polymorphism (see Tables 1-2)
aatgggaaattcttcaggtcggggtgaaagaggaaaaaaaaatggttaccaaggatgaactgtagctcacttaggaactgagctttcagactcccataagagctaaatgataaaagaattttttttttttaagaaaaaaggaaaagaaagaaaagaagaggaagaaaccaggaattcaataatgtcctcagaaaacaaagcagtgattccttcctcattacttttgagcaatgagaccctacgctatagcagagcctatcctagcttcacttatcaataagaatgcatcagtattaggtttctaagcagcataaatgaacccaagacctcttcccaagcagtgtgacatgatataaaaatcccaaatttcaggtgatcctgacaccttcttgtaggatgaacccagagaagtcataattgaaattttattttctgggatttttttttaaagggcagggctaacacccttccttgctttcttcacattcaaggcaaagaacaactaagatgacatattcagaattgtactggaaaacaaataggctgatgcaaatctaaggaaaagcacaatataaatgaatctactgaaattgtttttacataaaaaaggcaattttacctatttgtaatgaataggtctttggagggatttcagccttcttttcacttgtatgaatcagacaagatctagcatcaatttggttgatgatggctggacagagatagttgaactctgttgcattcagcggaacctggatgcccatgccatgagatgtcagtagctttgatgcattgaaacactgaaagaaacaaagcagtgaaaatcaccaaaagccatccccattagagtagtctgatgacacaatacccttttttactaatgctacttcgttttctcgagttaatgaaaattaaaatcaacttctgttttgagcactttggaacttgcctccagctacctggcgatactatgtcaccacagtggtatcccacctcttctacctcatcagagaagcagtacatcacgagtcacctagggagaaagcctcaggtggaacaagcatgaggataaatggagattcacaagcctgttaactcactgtataaacgtattaaggaaatgagctttaatttcaaaatggggctcatcagagattgagaaatatgttgcttcagtactaacgctatcctacttggcctaaacaagtccaagacatgcctctcttctagtaatgactctacttgcaaaaactcagttctgtctacatacctggcaaagtaatgctctgcaatgagaggatattaaattatgcagattattcttgtggagggcaaggctggttaataaaacaaacctgtaccggcaggcagatgttttcaactatttaattagatgacaaacttagtttgaagatactcctctgtgcaatctctcccccaaccaaaaaagaaaaaaaaaaaaaaaacaacaaaaaaaccccaaactggctttagtaccagtttctcatcttctgtaaagacattttcaactcccaccacaattctcagttggtacaactcagagcaaactttatcaccagggctgctatggctatggccactactaggattagtccagaattagtacagtcacatgctggtttgaatgaagtactaaagttttgcttattaaactgtatcaactaattccttgttccttttttttttgacataattccctgttcttgacatctctcagccaaggtgaattacgtacagtctggaagtctactctagaaaaaccacatgaactcagaacctcactgtcccaacttttcccttgtccagcatgacattcatggaaactgctccaatttcaatcattcctcaagtcatggtggaccttctgtcaaggaggcagcagtggtattctcagtagtcttcagccccttcagtcacacctttccctacaatatggattctaactcctgctttcaacccctcattttctattttttattaataatgttcacctttatagactttctctaaagatagccttgatatctttctctacatattttatattctgtattagaaaaaattgtaggaggcagcactacgctcaccaaaagaactgttccctaagttctgaattgggaatgtttacaacatagcaggcatgctttgtggcaagtgccttgctgagaaggtggaaattcccttttcaataacttcaacattttacttttactttaaactcctcataactagagatagagtagcagagacaggacagacacacaggtatattaaaataatgaacagcactcatcttacctcctgaggattttcatttgtgtttctggaatacataaagccttttcggggctcactcacagattcatttgttttcctaccagccagccggctcacccggctctttgatgtgacactgggtggagtggagctgcttacatctttggggaagagttttccaggtcttggagtctctattgtctctagaaagtgagttccttcagagacagtgttgtacacagttgaggtcacttcactagcactaacactgtccttgacattccttctaccactggcatgttctggtcggtgagctcctttcccctggctgtttctaggatctttacctgaactatctgagtcatggtctgggcaaagagcttttcgcttatttttaccagaagcagcatgattatggtgagagtgatgatcatggtcagagtgatgctcgtggtctgagtgatgctcatggtctgagtgacgctcatggtctgagtgatgctcgtggtctgagtgatggtcgtggtcatggtgtatatggattcttttaatcttatctatgcctatattttgaagtaattttctgaacccttcaactgacaaagaattattttctccatagcggtagaaaagctgttgtagatgatattgccgtgtggaaattgccaagtcaacattaatgccagattcccaattcggactaattttctcagtggtctgggggaaagcagctgcttttagttcatgaaggggatttgtgacagagagggcaaaggtcaggatcaagattacagataacttcctcgccattgcgccttcctagaaaagacaggaaaaaaaaattcttgactcacttctaaaacaaattgaattaagaaacctcatactgaaaattaatgtgtaatcaaataatcaaagttgccagagcatcatgtggtgtgaccagtgtgacgctaggtactgtgaagatggaaagaactagagtcctaggctctacccttgcattcctaaaacacatgaaacaactggagaagagctgagtgctaagagactgccattagcactgtaaaagcaatagtaattcagagacaagggagatccatgtggccacagccatcaactgcttactgaagttgagaatttatttgaacgattatttgaatcattgaggccaatgattcataattaaatctaggctgggtgtggtggctcatgcctataatcccagcactttgggaggctgaggcaggcagatcacctgaggccaggagtttgtgaccagcctgggcaacattgtgaaaccctgtctcaaaaaaaaaaaagaacgaaatgaaatctagctaccttgatcatcaccatcatttcataaaataaccttcaaacaccaaaaaatagaaataataatctcagaattcacatacttaaaaaattttaaactaatacactctccttacatacaagcccatttaagacccctttccccaatcacaatcctcaaaggtgctcaattttgccagtgtatccctcaggatattttctatgcatactcaaatacatgtatacttaatttttttttttaaagttttttttttttttttctagagacgaggtctcactatgttgtccgggttggtcttgaactcctggcctcaagagatcctccacctccaattcccaaagtgctgggattacaggcgtgaccactacgcccagcctcaaataagtgtatactttaaatacacattgaatcttttttccgacttgacaatgaatcagacacattatgtccatacatagaattcttaaagtaaactgaacttcatgaaaaactcactgtagcatccttgtgttactacaaaccagtcaacatttaatcacaggctgttaatcatccacagtagtgtttggaaccaaaggcctgtgccccaaagaggaggaagcaattgagttggagcttgaaaagcagaattcagttaagcagagccagaattcagttaattcagatccagcaggatgtccagcaccaacggtggaggtgatggtggtcaaactcacatctccagcaaaagacgcagacgtcaagtttacaactaagcaagagcatggggctatccagctctaccacggtcagctgttctttggacagggctctcgcattcattaccttatctaaaataccggtaaaacctattttgcaaggcgaaggaggaaaacacatgaaggaatgtatattacaagtactcgttaaactcatgtgttgcacaagtgcgaggtatcatacagggaacagtgggaaatggaggtacggcgtagaacgaggctcctgaaagaggaatctttggggcttgaagtttcgggaattcttttactaggtaaaagataaacatttagaaatcattcccaggagagaggcgaggagcggggtgggaggggactagcacaggggacagctccgagcctttctccagggaggatgctgagcgcggtcgtggacccgttgaaggatctcctttcctgcaagttggtgtgtgctggaggaaaaaggaaagcagaagggaagggccttagagaaaaaggcgagtacagaaaacggaaaagagggcacaaagctctcttctaaaagctttttatttctaaacacgtcagtcccttcttcgaatatgggatgaaaagtacggatcttttcctcaaaaaatcctccgttgcaccccgaagcccatctgagcaccttaagaagtccggctctctagggtgagtgggcgcctgcggcgggctccccccagcatcctctttctgtagcccccctgcccggtccgcaggatccggttctccgcagaaccacccctcccccgccacgcctgtctggcctgaggagctcccctcccagccgccctgctcccggacctgaaagactcacgtctccgcggcctcgttgtcccacggcccggccacgcgcgcaggtttggttccacacgggcggtccagagggctcggaacgggcccactggtgtcttcgagaaatctctaccaggcgcgaacacgcggtggtttcattgggttggctgcccctcggtccgggggcagcgccgcgcagccacccggcagccgcgcccctagccttcgcgaagctggaagacaatcactaattaccgccgcgcgcagcgccgcggggaaccaccgcccccttcgcccaggactgcagggcatgcgcagtgcgaccccggaacccggctccgcagacggatccgcttttccgtgtgttcgccgacgccgcgggggcgtggcgcggccctagcgcattgtaagcagttgggggtcatttcctcgaggccctactcgctagccagcgcccccggggccagccctggctgctgctgggagccgggtcgtaaggggcagcgagatgtttctgacgctgccccaggcacatgagccccgggtccttcgggagggtcccgagccactcgggtcggatttcgctcttgagacaaaggcctggctcgtgcgcggagcggggccacggtccaagagcagagctagcaaagcggcggccttgcacaggggttccagcctgcggtgggaacggagagtctcaggggggccgggctgcctccgtctggccctcggctggctgcgaaacgtggactgggtgatgcctcaggagaaaccaccctagtagttccgctccgagggcggaagtgcgcgtctcttgtttstgcggctgaccagttggcgacatggtggcacccgtgctggagacttctcacgtgttttgctgcccaaaccgggtgcggggagtcctgaactggagctctggscccagaggacttctggcctttggcacgtcctgctccgtggtgctctatgaccccctggtaagagaggtcgctggacggccgacccttgtgcttttcgggttgaacctgtggacgtgctccgggcgcgctgttagttgccgccccagacctaggaggcgagtcgggtcggctcaggggagcggggtttgggctyggartctccagtggacctgccggactcgctcctcacccctcaccctttgccgtctcacgcgtggcgtcatcctagggtcattgctgcccatgagctgctagtaacctgttagtcccacgcagaaacccgaatgataagcatcttacctgaagccttccttgggaactgtagtaccgttaatcaatttgggttttaaaacaattgaaatttatatgtagattaaaaccatcatcccacaggtgcaatctcatttcagtatttccttcagttttggttaatgaacttttgttgtattgaatttcaaggaaatgttacctgtgttttagctacgggaatggacattttagagaaagtgtcagtttgggggaaaggtcataggggatggggatcctaagcactgattataaggcgggacttccctcgacttcacccagtcagtyggttattttcttggtgctttcctcaccatatttctcaagtgaatagtttttgcatgctccccggaattcattataactccattcccaatggctaagttggtctatacagttagtcttgcatctcaaaaggaggctcagtgtaaaaagtaaaatgttgaaaattcaaatacaacgcaggagatggctatatgtatttctgttcatacggctttattaatttggttaaaaatttcattattggccaggagcgtgtctcatgtctgtaatcccggcactttgggaggcagaggtgggagcatcgcttgagtccaggagttggagaccagtttaggcaacagagcgagaccccagtctctacaaaaagtttaaaaaaaaaaatagctggttgtggtggcgtgcgcctgtagtcccagctactcgggaggtagaggtgggaggatcgcttgagctcagaagtttgaggctgcagtggacgggggtcgcaccactggactccagcctgggcaacagagccagaccctatctcaaaaaaacattattctcacaccctttggagattcaaatatatatatgaaatatttgtaaccacattaccccatcttgagcttgcttgcctcttcctggtttttgtttcttgttatttgcattcttgaatggcaagagraagtgcaaaaaacaagggtaaactttaaagggaccatgaggcaaggaccgactgtagaatgggagagaccacagcaggctctccatcatctcccacagcgtctcctcatccagcgccgtgagcgcggagccttgcggcattgcggcaccgttccgccatggctgggcactgggaggaccctaagaggggcggccataggggtggagttgtcagggaagcaggagcccgggagagccagggtgacaccctkttaaaatcaactccgtcgtaaaattagcaaggcacactctttgccagtcaacccacggtcctgagatgtttacggcagaggaagcatcttggtaaagtctgcaaggacaaacttgccsctatatcacaggacaagatctgcttttaagatgattatactcatgctttgatgtacttaacacactgaaatgaaattctgattcagctgtagaatcccatctttttgcagcagttgaatggatttgtttccatgtattccatcagattttaaatgataacctggtggctgagctagtgaattttagcatattgacaaagaagtgttgagcctaaaaagtactttgtcctgttaaatatttgctggtcgggctttttttttttttttttttttttggagtgtagtgacagtaactgctcagtgcaacctgcaacctccacctcccgaaatcaagtgattctcgtgcctcagcctccctagtagcagggattacaggtgtgcacccccacacctggccaatttttgtgtttttagtagagacaggttttaccacattggccaggctggtctccaactcctggcctcctgaagtgctgggattaaaggcatgagccaccacacctggcctcgattgggcttttaagtaaatatgggaataaaagcatttcaaatgctaaaataaagttttgggaatgatgctcattcagsaaatcttcgacgaccatctgtgggctagccctgggctgagtgatgatgacacaaggtaatgagtgataacgcgcgtggccaccaaggaattctcagtctagtgggagagacagtgaagtacagtaaattgttttccagcctcaaataacctatatgtgaaatatattagtttatgcacatttgcctcttcctttttcttagccatgagaattctagttggcgtataagcagatacaaagccattgccgttgacaacagatagagaaaggggctgtaaagaggaaggtgcagtagtcacagttaaaatctttaatggtgtgtgaagtatgagacctccaagtgtggggtgaagttggtgaaagcagtctgttgaggatctgtggagaacctggcaataggccctgcaggaatctgatgtgtgaggaccttagtagttgtggccttgtgacattgtgccactgggtctgaaaaacccaccgtctcattggccattggcatgcaaagtgaactgtgcttgtacccattaatcacagattcttctattggagggcttttttttttttcttttggtcagagaaaccctcagattggtgcaagcatagtaggcctacttccacaaggaagcagctgcttgtctagtttggtgtgtcaggacaggctgcctaggtgaaaaggatgtgggcactgtaggagagtgagcagaagcaggtgggtggatgcagacgcgagagctcagtgtaatgggaggacaggatgcygggaatgtggagtctcaagaaaggcaggactgatttagaggaatggatgacttaagccatggttaaaagtttatagattgaagaaggcaaatctgtttgatgtaaacctgatctttttactagcatcgaaaacactgaaatctgyttttacttayttattaatttttctgtaggataaattccagtttactaactgtattttcttctctaaagaaaagggttgttgttaccaacttgaatggtcacaccgcccgagtcaattgcatacagtggatttgtaaacaggatggctgtaagtawtaaccagattttaaagttgatctcaattgttttctgatamaataaggttagccatttttttctcatcacttctcttaatttagcattaccttatatgatgttatgcaattggagaaacaagaaaaatggtattcccagtgaaatatctgaactgtatttttacttcgtagcagttgaagcttggattakacagcagtgcttaggatgagggtagtgcagcccwagactttggcaggatcctgtcccacctccccagttgcctgtaacctttattaaaagaacttgtaagcagggcctagactgaggctgtgttttagagacttggtttcttggtctgtttctgccataaacaagctattggtttttctttttattcttttttcttttatttacttatttatttatttatttattttttttgccaactagttggagactagaatgtttatttttttaagagacaggatctctcacttgttgcccaagctggaatgcagcggctccatcagagttctctgcaatagctgggaccacaagtgtgtggcaccacgcctttctagttttttaggggttttttttttttttttttttttttgagatggagtctcgctttgtcacccaggctggagtgcagtggcaagatctcggctcactgcgagctccgcctcccgggttcacaccattctcctgccttgctctgtagcccaggcttgtctcgtactcctaacctcaagcagtcttccctctttagcctcccaaagtgctgggattacaggattagctactgtacccggccagctattgcttttttaggcaagacattgcatctctattgaccctagtttgcaccttaataacatgtgagaagtaagagattggactagatcaagggtgtcttagaggtttgtaagacctatgagatcaaattattttcataatgatatcaagaagttattcacagtattcattctcattgtcatgaatgtacagtgttttccagcagccacatgatgtatgatactgcagcagattaaatacagaagcagatatgaaaatccagctatattctaataaaatcatatgttaaagagatttgtaggaatgtaaaatagttcctctctttcattaagtttttgttttggaaaccattggggtttttccccatcaaaatgttatatatgttcacacatcatagaacccattgttatttttaagtaaatggttaaacacatatttttcatatttctcagttttaatttctaatgtggttaatattggtacatatggttcatataatcaaaagctttttggggtcctcaaaaattgtaagactgtaaaggaattctaagaccaaaagttatgaaaatttctggacaagattatctccaggtctcttcatctctaagattctgactccagaattttcagttaaaatattagttgcctttagatggtgctcccaaaatcctatgatatttctttagttatcttaaatatatctactgtagttttgatatgggttctgaattagttttatttttcattacacactcatttgagggcattttgagccaggcacaaatgcaaaattttctgaattattaagactttgctatgattttataaatgatgtttaaaaaagttttaataagctacttatttgcttctgtaggattagtcacatgttaggtcaataaaaatcattaaatggtacaagggatgcctgttagtatggataataaaacataattgcaattatattaattgccaccagataacatcaaagactgactttcagtataggagtttgttataaaatgttaatttaggcttgtatgttttatcttccgtttaaaagtgaggttacataaaatggattgcttgtgtattactgtaatctataactattatgattgatttcctttcattgaactgccagataatgcagatagcctttccaaccctttatcggtgatatataaaattttaatatcattttgtatttttaatatgtctgaattttaacattacttttatgtatagacattcttaaaatcatatagttagttaagtggctcaattgctgtgacacatgaagttgaagcccatgatcacagttggctggcagcagagttaggacatgaacctgggccttctgagttcaaatctaatgctctttagtccagctgcttccctgaaacaaataaaaagaaaatccaaacccaaattaggttatttgccccttttttggtactactttttcttttgttatcactgagaagttgcaagtatttaaaagatctattttgaagtgtgtctctaatttcaacaataagtcatattcttggtagtagcacctgactacaatgtttcatatratgttcctgccaagagtgtttagcctgcatctaatcatgaggaaacaatcaaacagattgagggacattctgcagaacaastgctgggtactgtcattgtcacaaaaatgagggggactaggaaactattctacattaaaggagactaaaaagatttgatatccaaatgttgagtgtatttccttagattctgaatcccaaacaaaaaaagttttaaaaggcattactgagagaattgggacattttaatatggactgtatattatataataatacttatcaatgttagaatttttgaatgtgataattgtattgaggtaatataggagaacgtttttgtccttaggagatatatggtctttgaggatcagagatcacagtgtctgccacttatttttaagtagtttgcctcctaaaargtgtgtgtgtrtgkatatagaggaagagtgagatattaagcaaatatggcaaaatgttaccagtttgtgaatctaggtagagggtacaggggtattgttttttggtgtagcttggaaatttttaaaaattgcagaaaaaatgaataaagatatttactgagatataatttttttcagccccttctactgaattagtttctggaggatctgataatcaagtgattcactgggaaatagaggataatcaggtgagtggacatgtttataatcaagaaatgactttttttgttcatttgttttttaagaggtagagtttcactctgtcacccaggctgacgtgcagtggtgcgatcgtggctcacctcagcctcctaagtagctgggactacaggtgcctgacaccatgcctggctgatttctgtttgtttgtttgtttgtttttgtagagatggggtcttactttgttgcccaggctggtctcagaaatgacttttatatatacttttattttaagtttttttcttcaactatgttgttcttttatgaagttaatcttgctcatcagcaacacaaatgctgtatcttttatactacacaggccctgtaccctttgctctgatttctactcccatatttgtatgctgttaactgtctctgtgaatttcctgtcattttggaataattttcaaactattcttacttgggctgatctgttttcaatgcttttggcatacgaatatagatttacaagactcttctcagtgctaccccacacttctgtcatgttatgtttttaaaaattctctgattgagctataactgcttaaagatgtgaaatgagtattttcaatagatttagttttttcagggggtaatgacagacttgttaaaaaaaaaaggttataaatacaaaaagtataaagaaggaaaaacctatgcaaaatctgagcagagttaactttctggtgaatgtcattccccgtctctagttatgtgtgtataattatgcataatagagattctattgtatccaaggattttttaaacctttttgaggtgagatctggctgtgttgcccaggctggagtgcagtggctgttcataggtaagatgatggtgcactatagccaaggactcctggactcaggtgatactcctacctcagcctcccaagtaactgggactgctggcacacaccactgcacctggcttaagtgttttttccaagaagtcaaaggctaatgattctaaagaaagttagtgtacagacmcttatacatgagtattatgtgcatcttctttagtggcagaattctgttttaagtattataattggaaaaacaactgaagagacatttaaggaacaccactatttcagcagacagttgatagaagataccttttaaaagaagtggtggaatgtcacacatttgaaacttaaaaaaagataaacccaaaacgtcagtagaagggatgccagagggaataatcttgatggcaagcagatagatttgataagccaatgggatttcccacttctctttgctatttttctattttgcagccctacttgatttaggcaagtatcatgagtggatgctaaaagtacttagtaaaagtttgatgaggaatagaatgtttattcaatcccaaagtatactcatattatcaccaaaaaaaaaaaaaaaaaaaaattaacatcacggtgaaaaaacctggcagacaatacttctactaaatataaaggttagcttcactaaaacctggacaaactgaaatgatgtgcctcctgatgggatgtgcttatgtagtaatgctgtcaaaatgtatattctgaatctcttcataatgaaaatcacactaatccaaaaagaggaacattccacaaagttgacctatattcttcagaatacctattgtctcctcagagtagattcctagatatgagattgctgtgtcacagggcatgcacattttgtgtgttgttaacatggtcagacagacttcttgaaaaattcttttcaacttagaggacctatttctggctcagccattttattggcacatttatccaattaaataaaggtaaaaaaaatccttttttycacaatgcttctgtcattctttctgattcagcttttaaaagcagtgcatcttcaaggccatgaaggacctgtttatgcggtgcatgctgtttaccagaggaggacatcagatcctgcattatgtmcactgatcgtttctgcagctgcagattctgctgttcgactctggtctaaaaagggtccagaaggtaggtttggagacatgataatccagacaaatgaaataatatttaacaaatgaatgacgagtagaagagcatatatataattctttacaactttggagcaactttaaaaatactataattctaatctaaatttttcttttgcacttatttaaaattctctataccaagactttttcatgtaagtcattttgctgtctgtaacatcattaaaatttggccatttaacttcacatggtcagtgggggctcaggattgacttctctcatctcccttctgctacctggggctgtgatgatgctatccaacctgtctagttggataagctctgaggtagttagttgttcattgtgttttttattatttcttagtaatgtgccttcagactttaaactttggaaatggatttgctttggctctctgcttatcttttttgccaaatactgatggtgagtatcctgttaagtatatgttaaaagggcagtatatttgcatactgtcatatgattagaacctaaaagaaatgtattgggtcttaattttgtatctgaatgtttctatgaaacaagatgtgaataacatactttccttataatattcaaatgatctgagtatagaacataaagttaaggggggcttattaggattttgatagccrttgataatttaaatgacttactgtgtacccaagattgatactgttatcaaatatactgtggatgtatayaggtctaatttgaggaaagaatctaattctttagaaggtgaaggtctggggtaagttgaaaaagtgttgaatgaagatggcatatgagcatttctctcaaaatgatagctccttcacatcccgaataatgacattttgcccaagaccacttaaaatctgcaaacagaaaaatttcccttttgctgtgaaacccatctgtatttatctttgagtatcttctacaaagataatagccagtgtgagtgagtcagcctctttgcctccacagttacctggaagactggccaggtggaacgaggcagggcctggaagccaccagcttctctcgccctctgtagcaggagctgcgactctatggtttcatgttacgcttccattctgtgcaaggctctgtggaaggagaagctgcacacattctggcatcataacagaatttcatttcttccatctgcattcaggccaagtgactggagttttgtttttattgtttttatttttcttttttctgtagttgatctaaagtaagaaaatctttgaaaaacacattggtggcaaggcatgtccttagaaaaagtctcttatctagcagagtcatcagggctgccctttggtaatgcaaattattaatgattttttatcttaytaaaataattttacagtcacatctttcatagctttttaaaattttaaaatttaaaatttatttatttattttttagagacaaagtctcattctgtcactcaggctggagtgcagtggtgatcatagctcactgcagcctcaaactcctgggctcaggtgattttcccacctcagccaagtggctgggactacaagcatgctccaccacgcccagctaatttttttattcttgtagagacaaggtctgtttatgttgcccaggctggtcttggactcctggcttcaagtggttctcctgtctcggcctcccaaagtgctgggatcacagatgtgagccactgcgtctggatccccttgcgtagctttgtaaattttttattttatttttttgacacagggtctcattctgttgcccaggctggagtgcagtggcgccatcacagctcacctcagcctcctgagtagctgggactccaagcacatgccaccatgcctggctaattgccttgtatagctttttagccacatgcttaattatatgctcttttatttatttttatttttattttgggggatggagtctcgctccgtcgcccaggctggagtgcagtggtgcaatctcggctcactgcaatctctgcctcctgggtttaagtgattttcctgcttcagcctcctgagtaactgggattataggcatatgccaccacgcccagataatttttgtatttttagtagagacaaggttttgtcatgttggccaggctggtctcaaattcctgacctcaggtgatctgcccacctcagcctcccaaaggataacgccctaggattacaggcatgagccaccacacccagccttttattttgttttaaacaaaataaaacataaggttttcaaacaaaacataaagtcctcaaattaacaaacatacccttaaatctgtgtgcattagccatgttggtagggctcatagtagctgttcattatttagttgtcttaacaacttttcatcttggtctttgggctgacatggtgaaaatgctctctagttgctcttgagcttatttttcacttctatcataaatgtcatagaatggagagaaggactggattctcatttaatagtcattatatttaccaagtaaccactgaatagaacgttttagagtgttcattgtattcctgcagacatttattgagcattttcaattattcgtgtagtggtgtgggaaattgaagtcaggattctttacttagagcttacaatccagtacagttgataaatcataacgtggtggaatagagaactcacagtgaagcctgttttttcttcccccagtaccaatattagcatgtggcaatgatgattgcagaattcacatatttgctcaacaaaatgatcaggtaataatgtttatattaagaggctggaattatattctgcttagttatatctcaatacagactatatccagattatagaattttagggaawgttctaatctaaaccaaaataatccaatagaatctttttttgacagtcctctgttaagatggttgtctaytctgaacaccaagtaaccgctgccttgaccatcaggctcagagttgttagggggaaacaggtcattaggtgggggaggagagatggaagatgctgtggtagttgtttttctcttaaagatttaaacgagatataacatacctacagtgaagcattcctagtagtgtttatttgcccttctgagctttacttagattttgagtggttaaactaaaggagagaaatttagaaaggggttggttaactctaaactcatttatttaataggatactcatttctttgcattctataagaaggttaaaaatggttgkgaaagtccagctattcaacttttttttttttttttttgagacagagtcttgttctgtctcctaggctggtgcagtggtgagaacatgcgtcactgtagtcttgacttcctggggtgaagcaatcctcctgcctcagcctcctgtgtagttgagaccacaggcgtgtatcaccatgcctgactactttttaaattttttgtagacacagggtctcactttattgccccggctggtctcagtttcctggcctcaagtgatagtcccacctcctcagcctcgcaaggtattaggattataggtgtgagccactgcccaacccacctttttttctatattatatgtatagtatgtatcattttatatcttaaacatttaaaatatttgagattacaaatattatattatctactcagaggtgctccagttagtgatttagatattacgtgatgggtttttcattcccaaaggaaygctttttcttgtctaatcaaatagtgttctcagtaaaagagcaacgcagtaggactgtctgagaccaaatgatgtcactggtatacatgaagatgttaaattcttacatcaagcccaatgatttttatcttactagtttcagaaagtgctttctctctgtggacatgaggattggattagaggagtggaatgggcagcctttggtcagtatgaaattttgctaatgcacatacaatgggaacaaatatgtgttacttccaagaaagcagccttttttgttttaatttttaagttttctttgtatgttatgtttttctrttgtcccaattagaaaggaggatgcttatctcttctgttgttagttggatggtagatgattaaataaattggtatttatcagatgacattagctgtcttgttcacatgcagaccttcttgaaaagttctttgtagaacttagtagactatatactacatgttgtaaacatgtattagcattgtatgcatatttgtcaatgttattaaaaatgaatatagatcaaatgaattggagggtaaggaaacaaagtattgttttttttctggaaaatctggaaatatatatattayagacaaaaaagtcttatacataaacttcacaatataatgttttaaaattaatacaacttattttttaattaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgagtaataatgaaaatatccaatataacgatacttaggtctcctagttggttgatttttttttcaccacccacctatgtgaaggatagtttttcacaattgtcagattcctacctgaaatttcttttttctttctttttttttttgagacagagttttgcttcttcacctcggctggagtgcagtggcgtgagcttggctcactgcaacctccgtctcccaggttcaagtgattctcctgcctcaggttcaagtgattctcctgcctcagccttccaagtagctgggattacaggcacgcaccaccacgcctggctaacttttttgtatttttagtagaaatggggtttcaccatgttagccaggctggtctcgaactcctgacctcaggtgatctgcccgcctcggcctcccaaagtgctgggattacaggtgtgagccaccgtgcctggccttttttttttttttttttgagacttcttacccaggttggagtgcagtggcataatcacagctcactgcagccttgaactccttggctcaagtggcttagcttcctgagtagctaggactacgccatcacacccagctaatttttaaaattttctgtaaagatagggtcttgctatgttgtccaggctgtttttcaactactggcctcaaatgatccttccaccttggtatcctaaagtgttgggattacaggtgtgggccaccatgcttggcctgatactttgtattttcctatttttatgtgagaatgagtcatttttcatatgtgaaatrtttttcttctaaaccatattagtaagatttttaaaattgctgaggataatgtttagtgcttctcattaaagtaatttgtaaaatattactaaatttgcagttttagcataggaagacctaaaggaataatgtgaattacttacacattttattggcctatgataaaagacaagctaaatctcaccatttgagtagtatatttaattctgattttcctattgtctagccttagaacagtatccctggatggtagatcctgttgggatgttgtatttgaaagagatatttttggatgtgacagttataaaggtagttcagtgaacattgttcacctrggtgtattctgttttttgttactattcttggtggtaaagtccatcagagttgagattttggtaacagttttatggggagaacgaaaaaatgatataaccagcatattaggagtagctatacccaaatatgaatttttttctattttcattatattgtttgaaaggtcaaaatactgatttcattatctttatttctgcatttatccttttaaaaaatgggatttgtatttgtccattcttacrcttctataaagaacttcccaagactgggtaatttgtaagagaaagaggtttagttgactcacagttctgcaaagctgaggaggcctcaggaaacttaaattaatagcagaaggggaagcagacaccttcttcacagggcatctcccaccagatccttcccttgacaggtgggacttagggggattacaattcaagatgagatttaggtgaggacacagagccaaaccatatcagtattttaggctattatattcttataatgagtgaggataataaagaggctggcatgactgtttttccttcctcattgtggtttaacaaaagtagctgtctcagaaaattgtaaaaatataagatattccttcatatttatttatgaccagctagaacagaatataaggaaaaatgtataactttttctcctataattttgaacagcagttgaggttgaagaaatttagaatgcatgttctttttttgaatcccaactatcatattttgtcctaatttttttttcttacataattgcccaactgtcttggttatggaaatattctttttagaagagctttgaggaaataataccttcattgcttttgttataggtgttaaaatagcatttgctgttactctggagacagtgctagccggtcatgaaaactgggtaaatgcagttcactggcaacctgtgttttacaaaggtaggaagaaaaccatacacatatcccttactccagttaaatcttatggcacagtaagytgaccaaatcaagtggagaatttttttactgtgattagaaatctcaaatacatgacattttcaagttgacaaagtataatactgcattcctggtctgctggacactcarttccattgaacattgaactcctaagtgggaaaagtgtaattcctgccatgatgctgaaactaccacacccccagtaactttttatcttaaaagtttccacttgattattatgggattgaagaaaaactgactttcaagccaacttcactggatcctttaccctcagtaataacaaagttggtaccactgaaatacattatttatgagaaagtaagactgttactccttctttcttttgccatttatctccatttatagagtgacagttctgtgcatgttcaggctggtgctgggtgtatagctaggtaaggcatagcctcacattcttccctggcctcttccccaaggcaataacagtaataattaattcttaggcaaactaccattcacctcttccttacattatgctatgtttgctgtaatttaaaaaacaaaaaaaattggaattatagatattacagcttgcctttttagcttaccgtgttttggagctgtatccacattgatttgtgaagctctagttatttgtttttattgcatggtagtagtctgttgtctgaatataccacaacccatttatctcttcttctaatggtagacatttgtggtgtttgcaattttttgctattacaaataatgtgcagtgaacatccttgcagtacccatgttgtttgttgtttttttctggtcatctacaaacatgatgatggttgatcacctaaagggattaggttttattttttagatggtgtcctacagcagccartgagattattatctgcttccatggataaaaccatgattctctgggctccagatgaagagtcaggagtttggctagaacaggtaaaaatgttggatatttaaggaacagaaaattaagttttgaactctgtatttaaatcccaagtctatattgatagacctgcaaattttcactgtgtacattaaaatagtgggaatttaacagtctctggaatcagcgatttctgttgtgagaaacatagactattgattaagaattgttttctgtctgttattgtacaggttcgagtaggtgaagtaggtgggaatactttgggattttatgattgccagttcaatgaagatggctccatgatcattgctcrtgctttccacggagcgttgcacctttggaaacagaatacwgttaacccagtaagaaaagagtgtttaaataaagcatttctaatcaaatagagtacattcyaggtaaatagtattttgcttataacactctacagaaacatagtagaggcasttgaagttcaagtgacataacttttttctgtagacatygttaaggtattgaaatttgcatgtaggtaaatttgctacgtaagtgcactgtattcctttaagctatagaattttttaatgataatttttctgaaatgtgtagctttcctgtcttcttaaaaagttaacataattggatatcttgttggactgctagatccctattattgaatgaatgtcagtcatttattgtgactgacgttcaacacctgggcatggtggctcttctcagcaacttgaaaggctgagatggaggattgcttgaagctaggagtttgagaacagccttggtgaaagaataagacccgtctccaaaaaaaaagaggtagtcttctccctttagtcatgtaactgtctctctacagcattccttctcttactttgtaatctgatttgcttctaatctgcttctagcttgggaaaattagatagcaagaacggagtggccaagagcacaggcccttggagctagacagcctgggttcacttactagctatgtgtccttgaggacattagttaatccctgtctcaggttcctcatttgtaaaacatgggtagtttttttttttttttttttttsttttaacaggatcttactctgtcatccaggtgtgatcatagctcactgcaacctcattctcctggggttaagccatcctcacgcttcaacttcctgagtagctgggactacaggtgcacmtcaccacacccagctaatatctaaaattttttttatagacacagggtcttgctttgttgccctgcctagtcctgaactcctggcttcaagtgatcctcccgcctcagtctcccaaagtgctgggattacaggtgtgagccactgcatttggcatgtggattgttaatattacctactgacagtttttgtttgtttgtttgtttgttttgagaccgagttttgctcttttggcccaggttggagtgcagtggtgtgatctcggctcactgcaacctccaccttccgggttcaagtgattcttctgcctcagcctcctgagtggctgggattacaggtgcctaccaccatatctggctaattttgtatttttattagagacggggtttcaccatgttggccagcctggtctcgaactcctgacctcaggtgattctgcccctccccccgcctcagcctcccaaagtgctgggattacaggcgtgagccaccgcacctggtctactggcagggtttttatgaggcttaaatgagttaacatttatatgatatgcaaaacaaggcctggcacatactggatgctatgtaagtgtattttattttattattattgttgtgttttttattaacacttacttttttttataaagtatattgcaaaggaaacagaagcagagacgtgtagggtgaggtatgggagaaggggtgccaagctcccatgccctccctggctgtgccgccctccaggaacctccatgtgcttagctattcggaagctccgaagctccctgaactgtgtcctctttggtttttatggcagcttcatgacgtcagcattttttcccccagggtggaaccctctcatggtcaggtttttttttttttttttttgagatggagtctcactctgtcacccaggctggagtgcagtggcgctatctcggctcactgcaagctccgcctcccgagttcacaccattctcctgcctcagcctcctgagtagctgggactacaggtgcctgccaccacacctggctaattttttgtatttttagtagagacggggcttcatggttttagcacctcgtgatctgcccacctcggcctcccagagtgctgagattacaggtgtgacccactgcgcccagctggtcgggtttaagacacacagtcaaacaggtggggaagattagaggcctgaccctgaagcctaatatacccaattttgtaggtgaagactgtaacaagggctatgggagttttgagccaggaagttttgtcagagaaaaccagtgtacttaacacctcaggccatggatccctcaggccagggatcctttacatcaaaaaatataggctgggtgtgatggctcatgctggtaatcccagcactttgggaggccaaggcgggaggattatttgagcccaggagcttgaggccagcctgggcaacatagggagaccctgtctgtaccaataattttaaaaattagccatgggcttgcagccctgggtatcgttgcaggcgcctgtggtcgcagctacttgggaagctgacgcaggaggattgtgtgagcctgggaagttgaggctgcagtgagccatggttacaccactgcattccagcctgggtgatagaccaagaccctgtctcaaaaaaaaaatgtgtatgcacacacagtcaataattagtccagtccatcatactgtatgaatgtctcccaggctgaggccactcaggtttgcagatttccttcaatcttgtcaggtttcagaaggagtagcctcagtcaatattatatacaacttcactttttcaggcatctgggataattaagctaagagacaatgtcatctcttgctcttgagactcttatgagttgttaatgtgatattgaattttcctcaatgacccatttattcatttctttactctcagctgctatttctccttctctccattaatacccaaagcttttcatctttgaaaggcacattagaattgccattgtgttgatctagattgctggcagtaatacaagtcaagcaagtagctcctcagtctactacgttcagacaggataaggttaggtaggtgcagaactagtgagctatttttaccaccaggcaatgtagctgttttcaccattagccctaattttgctagatggggtgaaggtacaaccgtacaacccattcccgtcatgccttaggaattttgatacaagacttagaaacatagttgcagggttttttgttttgttttttttttttttttttttgcttagaaatcatccctgctgttccagtacttgttgttgcaggcctggtcctggaccactgcatcaggtagaggagaaaaaataaattaaaaaaaaawtttttttgaggcgatttggggaagaaagaaaaaaaatatagtcattttaccagtgtattcctcctttggtaagaaccgcatagtcataccagcatcctccccaacccccttccccatatcaacaagaaaaacaaaaaatctagcagggacactcaagttccactcatgttgagtgtgagtacacactcatgaaggtgtgtaagccagcccttcatgcttttatctccccttattttagacaaccgatgtttcaatcgtccatttctacttctctgtcaaactgtgactctaaggaggagatatctctrcccattgttggacattatgagctgtacagtgtatctttggtctgaagaaatgatggtcggccatccagatctatttaatatcttctgttctggtttttttatggcatgttgagcattttcatctttcatttgataagcaaaacctactacacagtcagtttcagttcctgtcaagacccatttatagctccccaggtctactagcatcagtcttacttgccagccatgttcagggccttcccaccagagtctgccctgtagccatcagcagtctctgttgctgacaaacagagcagttctttctggcattatgtgccttggaattgccatctactaacccagcagctcttgagagctgttcatctgacactgcagaatccagcagtttttcacacagttccagtgtcagttctaggggaaaagaaactccttgctcaagggtatctcctccttccattctccaggtagtataaagcatttccgttttattatggaactcttccggacactgccatccccattagaatgtttctctgacatcactggagacagtatgggtgtttcaggtgtcatagggatagcttcagctaatgtttcatagcaagacagtaaatgcccctcaagtggaaatactctagtccaaaccccagtagttgttgctgggagctactcagaagctttagccataagctcgaggagctgtttcacagagggtgatgaagtggagaatttatccttcccagcactctagcttctaccctgcattgtgtggttcaggcaattctgctggttcccatttagcatatccagttaatattgcttgaaggtcagatttacatgctttctgttttacagtaccaggtaggggaaacattccccaatcagacacaatgttcagccccatgatacaatcaggtaaaagagatgcaaccacttcatatgaagtgtgttcaaatatgccaactttcataatcctattaacccttagatttttatgttctgttttcaggaacttcacccccagaccattttaccctttcttgtacaaaaagctttgggtcccttgctgccaagggttgagccaaaggactccagcccttttgtcagtagtttccccccctattgccccacgccagatcagatttttcactgtagtctctgccttccagctttttttttttttctctttttttgagacagtgtctcactctgttgctcaggctggggtacagttgtgcagtcatggctgactgcagtcttgacctcctgggctcaatcgatcctcccacctccacctcccragtagctgagactacaggcaggcaccgccatgcccggctaatttctattttttgtagagacggggtttcaccatgttgcccaggctggtctcagactcctgggctcgagcagtctacccgcttctgcctcccaaagtgctgagattataggtgtgagccaccctgacctgccctgccttccagcttttaccatttctccaaactgggagaagtgcagtaaactggtttggcatcctttaatgttgggagaccaggcgggactccctttggtccacccagcctttgatagtgttgtattactacttcgttttaggccaggcatggcgtctcacacctggaatcctaacacttaggaaagctgaggtggatggatggatctcttgagcccaggagtttgagacaagcctgggcaacatggcaaaaccccatctctacaaaaaagacaaaaattagccaggcatggttaattctttgggctgaagaaatgatggttgggcatccagatccatttagtatcttctgttctgttctgtttttttttttgaggtggagtttcgctcttgttgcccaggctggagtgcaatggcatgatcttggctcactgcactctcgcctccctggttcaattgattctcctgtctcagccgcctgagtagctgggattacatgcacccaccaccatgcccggctaatttttttttttgtatttttaggagagacggagtttcaccatgttrgccaggctggtctcaaactcctgaccgcaagtgacccaccttcctcagcctcccaaagtgctgggattacaggcctgagccaccatgcccagccagttctggttttttaatggtttttttccagctactcagaggctgaggtgggaagatcacttgggcctgggagggagggtgaggctgcagttagccgtgattgcatcactgcactctaacctgggtgacagagtgagaccctatctcaaaaaaaaaaaacaacaaagatctttgttttaacaccatcagtttccattttattctttgtttcttaataaccatctaaagatttccaccctgcctttgaatctctcccttttacctttcctgttttcttgtcaacctaatgtttttattagcatctgtaagactcatgagaagctgagacagcaagtttaatcaggcttcttgaacggtttattgattctgcaggagtaccatcacatggggtgcccatgtagaaggaacccccttaaccatagcatttactgtgatctgggtaacaggcatattcagcaggtgaatatccctgtcatcacatagccagtctcacaaggcttgcatacaaagcatattagctgccccatctggggtgttacacttggcatttatagatgatgttaggcagtccccatttttgggggtaaacagaccttacagtggcatttatccagtccacctggctggccgttccctcaggaataatctcccgtgtgtctggattatatatccccacccacgattgttcactagtgagctgtgggtcctgcatcaacccaaacatgctcttccactctgtagcatttaaaaccaaagatactgcccctaaattaatcactttcatagtccactttagcaaaggttccccaggaaactgatgataccagtctataagatggaacaattccttaacactacaccctttggtttcagtagttacttggttttgcccttcccccacattgactaccttcttggtaaccacaggacttagaaatattttctgttgtccctgcataattctctgctttgtgggtgactttgaggctggtggcctgagctcgcacccacattttgagctgggtccagcctcaagtccttatccagcaccctcttgtactttcattttagccattatagataacagtgaccaagggattgaattttggattgaatatttcacttttttctttttagtttgcatttccttatgtatccaatgaaccaactcttggagttggatctatccgtaaattccactggtaactttaacctttagtaactgatctcaacacagctgcagcttcataccattggtgagcacatgatcaaagattcctcattccccacccttttatcctttttcttcccaaaccacacgattccgtgagtcagggcctttccagcaaatcctgcttcactaagtatgtagggaaaactctctctcttacaccacagcaatcattaacttctgtgagcaaatgtgtgggggtttcttccccgacaccaagcagcagacaccagctgggtgttctctaattcagttccaacactctctacccagagatagtgtcagatcccagaggttgagggctcagtccccaagactgcccctaccccagcagtcacagtccaggcctcaggaacttctgactgaccagcttcaagttaggattccctcgaccccctctttaggttcagttaatttggggtgactcacagaactcagggaaacacttaacatttattggtttatggtattgaaagtgacttgttttttatatagacttttttttttttatagagcagttttaggttaacagcaaaattgatctgaaggtacagagtttccacgtccctctacccccacacatcaacttgtagcctcccccactacattgttacagtcaaggacgattttttaaaagccaaacactgcccttcaggactgttactgtgggaaactgttagtccaaaagtgctgtccattgctcaaaactttttgtaaactcccattagtgctaactttagaatcagtttttgttcacagagggagtaacattttttgtcacaggctttttttttttttttttggccagacataatatagtttagtcacagacttatccatcagattaggttttgaatgacctattagctatttatacacatttaattttcctctaaaggttaagttttagtcccacttgaggttgttcaaaaaggtgctctgtggaccaggcatatgacattttctatattttgttgtcattatttgtttatatggttgttgttgcaggcttcttagtaggtgaaccaactaggtttgattcagttgtctgtcctctacacctgtaactctttttacttaataaagccatcaggtccacatgcagaacccactgactcgttttacacaatatttttasattttatacaatttttatttagtttaataaatacatagaacctagtgtatactagaattgtcctgtgtactttacaaaagtaactcatttaatcctcataataaccctagaaggtaggtgctgttataactgttttattctataattgagacacagaaaggttaagtagtatctggctgctcaataaatgatgaatggagggaaatttcccacagttactgatttaaaggatacaacacatatttgaatgcttaagctcttacatgattgattggaaaatggatcctattattctgtgatccgatcttgtatacttagcttttcaccttgccagagggctttagtcttctctgttatcagacgtgagtgctttactttggtggtagtctttgagtattttgatatgtgatatgagcacttccattgcagagagagtggactccagagattgtcatttcaggacactttgatggtgtccaagacctagtctgggatccagaaggagaatttattatcactgttggtactgatcagacaactagactttttgctccatggaagagaaaagaccaatcacaggtaaaatgtcttatttatttatttattttttcttgggacagagtttcacatcacccaggctgaagtgcaatggcacgatctcagctcactgcagcctccgccacccaggttcaagcgattctcctgtctcagcctcccgagtagctgggattataggtgcccmccaccacacccatcttctttttgtatttttagtagagatggggtttcaccatgttggccagactggtctcgaactcctgacctcaggtgatgcaccgcccctccccccccccgcctcccaaagtgctgggttataggcatgagccactgcagccggcctcttcttattttactaatgtgtttaaaagaaaacatccatgaacacaagaaaagtagggcagccacgctagccattaggaaaatgcaaattagaaccatgatgagataccaccacacaccctcttgaatagctaaagtaaaaaatatattaacaagtgctggtaaggatgcagagcaactggaactttcatacattgctattggggatgcagaatgatacagccactctggaaaacagttggacattttattttttgttttttgtagagacaggatcttgctatgttgctcaggctggccttgaactcctggcctcaagtgatcctcctgcctcagcctcccaagtaactaagactacaggtgtgagccaccatgcccagctaatttttagattttttgtagagacagggtcttgctctgttgcctagtttcgttatgtcttgtaattttaggtttaattcattaggaagcattatcaagtgtacaataaaagcctgaagtcatatagtattagataatagtagtgagggcagtttttgtttaaggaaattttcactgtgttaggcacctagaataaaacaaaatgtaaaagatagatcctgttttcaaggagtttaccatctagctgtagggtagggctataggtagggggcagtggaactaatgtttctgtaattattagataagaccagttaattgctaagtgttggccctgagctcaaacagttgtaaaacttcactactggtaaactttgaactgctatgtggtagagaaaatcaggatcctctgcttcagtttctgatagaaattcacggaactgactgtgggtcagtccgtaagagctagtgaagtttgccactaacactactgcttgagtaacacgtggtagattcarataaatagagttgagaacattgggaacagcatctatagtcaactgaaaaacaagtcaaatgattttgagtgatttttctgyggctcttggtaatttttaccaatactgcccagttgtggtttattcatggatgaatatttgccccatggttatatttccattgtatartaaataattttcatctaataatttgcttattgaaaattcagcttttgaatgatcatttttgtttatcccrttttacccaggtgacttggcatgaaattgcaaggcctcagatacatgggtatgacctgaaatgtttggcaatgattaatcggtttcagtttgtatctggagcagatgaaaaagttmttcgggttttttctgcacctcggaattttgtggaaaatttttgtgccattacaggacaatcactgaatcatgtgctctgtaatgtgagtatttctctaaatattttacctaaatctagtcacttcattttaaatttaaaaggatttttgccttaggctttaaatggaatatatgggtagaaagaaagtaatattgtttcttaatgtaagatgtgacaaagtttttgtgcactgtggggtgtaatgatttaaatactaaaactagaaattttgtgtagcaaatgagctcaaaatactacaaagctgcattartgttcaattgagacatgaatatgatgttttatcactgtgttaggtacctagaatagaacaaaataaaagatggatactgttttcaaggagattaccatctagctgtatggtaggggtagaggtagggggcagtggaactaatgtatctgcagttgttagatgagaccagttaattgctaaatcttatggtactaaagtaaatttcatagaaggaagaggtcattgtattggaataacgagaacatgtttaatgggacttgatttgggttttgtaagggtaactttcttttttatgtttatacgcccttctaagaaagatttgagctacttataaaagtacatggattatacaaattatgaagtaattttgaaagaaggaaaattaagtaggaagataggttacacagaagtgcatattatacagtccttcacttagagttgagtcacgaatttggttctgagctcaaaaaggataagtacccttttgataggcaaaaagaaggggagagagagggagagagcaaagggaagagagagagagcaaaggggaggccagagctattgtggtacctgttggactgaagactggatagaagtggggagaatggggaaagtccatggtggaagacttgggaggcaggcacagtctgactgtggggtgctgttggaggctcctacacaaagagtgatgaaaaggattttggaagagagttatctggaagccaagagactctgaaagcagtgaaactagcaccagtgtgagtaagactggagaagaaaatggaattcattagaaatgaagtagccaactaaatttcctggaatgtatactcagcacctcatgctacaggctttcttgattatgtgaagaggatttaagattctgttatgcttgtttctaataataatggacaataggaacaagatcaaaagggaagccttaattgtggttattatgtagagctaagcgtatggaggtggagggacagctagtttcaggatctcttcagttctaggaattgaaatggggttttacgattccatgagaggcttagtcccagttgtacacttagttctgtgtcctaagatacagggatcctgtagagtagcgagctgcttgctctcgtttgggttttgctcccatactaagtgttgggataggtatgtaggaatgcctcttactgttcttttccatgttagtttttctttgtttctgagataaagcatactgtttcttgtgtcccaggtagccatttttgatggttttaaattcttactattcatgtttgtgtctagtttcagcttctgtgttaaagtctaagttgtacagaacactcttagcaaatgagcatgtgccagttttgatggttagcatatattttcacatgtaataatttgattgatataaattgcaaaatctaagcagatattgccttttcaaatgacactcatacgaagttttaaaatactcagttagttaggtatgtttaatgaaaatactatgactaatgctgtaactgttcccttctgggaagcatctgtgtttatatgagcatcatcaggggatgtgcctgtgagattatcttggaagtagagctctgggccttccattttcagctcactgcatttcctgtcagaccctgaaacccattgaaatgttatggttcgatgaggtccctttatggatgagaggatgcccgactttatggattgcatgggagttggaggcctggtagggcttgtctgttggagagtgattgcttagcattgcattgttggttcaggaagtgaaagtacgggtagacatccacacaagatggtctttaaactgtttctcagcatttatgagcgtgacttttttgtagtgcctgaartaacagtaacttttagttttaaaattagcaaataaaactttagcatttataacttagatattatattttctattctagcaagatagtgatcttccagaaggagccactgtccctgcattgggattatcaaataaagctgtctttcagggtaaggcttttgtcttcaaaattattaaacccatagtggtacttaaaccccagtcatacacttgtgtaatgtctacctaatgtttgttacagctgattttttttttaaatcacagtatatcttttctatcacctatttcgtgataagtactctttgtacacactcagaccactgaagtagatgcagttttcacaaagcatgttttttccctttttttttttttttgagacagagtcttgctctgtcacccaggctggagtgcagtggcgcgatctcagctcactgcaacctctgcctcctggcttcaagcaattctcctgcctcagcctcccaaatagctgggactacaggcatgtgctaccatgcccagctaatttttgtatttttagtagagacagggtttcaccatgttggccagagtggtctggaactcctgacctcaggtgatccacctgccttggcctcccaaactgctgttattacaggtgtgagccaccacgccctgccacaaagtatgtgttttggtgttagaactacagatgagaatgtgggtaacctgaagagttggttgtgtagttttaaaagtttggagactgttagatcaaagaaaatggaaagaacctttatggagttgattaatgctgccaggagcatgtttggaaaatactggagtaatggaaatactcttgcctttggaatcacatggacacagctgtgaattgcaccactttgaattaccactgctttctatgtggtggccttaatattgagacaagtgaaggagatataaaaatagtgactatattcttgatgtgtttcttcaaactaggagatatagcttctcagccttctgatgaagaggagctgttaactagtactggttttgagtatcagcaggtggcctttcagccctccayacttactggtaagatgtgacaaagacaatttaataaatcgctagaacacacagtatgttatctattgctgctgacctaaataagtgctatagaattcacttttacatagaaaaaaatagcttcaatttattctagagcctcccactgaggatcatcttctgcagaatactttgtggcctgaagttcaaaaactgtaagttaaactgtatttagctctttggtctgattctgtcrtaacttctgacttttcctccccaccccacaatctgatgtctcctttttcttccttctacctacctttttcctcctcttctatatatctcttagtggctcttcataaggaatgagaattaaaccttaacgtttatttttatattactgtttattatgttcattagttttgtttattcatcttatttttaaagtagagaagcataacaatatatattttttctttattaaaaagacttggctgggtacagtggctcacacctgtaatcatagcactttgggaggccgtagcaggaggatcacttgaggccaggagtttgagaccagccttgacaacatagcgagaccccatctctacaaaaaattttaaaaaattagccaggcatgatgatgcatgcctgtagtcccaagctacttgagagactgaggctggaggattgcttctgcccaggaattggaggctgcagtgagccatgattgcaccactgcaccccagcctgggtgacagaatgagaccttgccttgaaaaaaaaaaaaaaagacttaagttttgttgttagtcatggtctttttgtctttgatggttcctgatgaagacttttccatgttttattgtttagatactggctggttgaaagtaggaggtgaaaacttgtatgttaattgtttgaatgagttatattacttataggaagctgacrtttttctcccatctccctgtctttctctcaaatgtttgcctagacaaacatacaatgttccttaaaagaattgtatattagctagagaggttgatgttattctttttactttcaaaaattgtgtggcatgagaatagattcatttgctaatagtactttttttctttttaaattttagatatgggcacggttatgaaatattttgtgttacttgtaacagttcaaagactctgcttgcctcagcttgtaaggtagggaagtttacttttgattctgcttggtcacaggttatttgggtcatcaggctcctgcaagtttggtaatgatttaggcagaactctacgtgaaaggccactagtgcttggttttttgaatcttactttctcaatttctcttacccttctgtctcttcaaaagcttatggtttcattttaagtctgtttcagctgcacattttgagtttatctgtgcctccctgctaaaagtgatttaatcaggtatctcaaaatgacacctgcaatcccggctactcaggaggctgagacatgagaatcacttgaaccccagaggtggaagttgcagtgagtcaagatcgcgccactgcactccagcctgggtgacagagtgagactctgtatataaaacagcgatatctcaaaatgacacctaaaaatttgatgaattttaaataattggagtcatagagacacagggaaatgagaagaggaaacctggagtgaaatccatcagactgttttttgaggacactcttggcactgacctaaggtagatgacttttgcatttacctggaaggatggtcttgaattcatcattcagtatttatccatatcctgtggaatgatatagcaattgtggaggattatccgaagggtctgaaacccacacattcgtcttaaattttctgaaatttatttacttgttttaaatatgatgataagagccgcccacctgcatgggcttgtgtccctgcttttaatgtggatttatgccactgatctgcattttggacatcataagaaatactgctgtgcttcccctacacccacccctaccccacttgtttattctttgaaatggtactgagaggacttccttctcttataggagcctttgggaaaaatggaattcagtagttcaaatgtctgggcttctactgagcagataatttgtttctaacttagggcactgtcaatcctgtaattgattttttttccccctttttaagttgattcacaacaatatgtgtatcctctaaacattttttaacagctttatttagggttattaacatactataaatggtatgtttaatgtgaacaatttgataagttttgacatgtttatccctgtataaatcatcactacaatcaagatactgtgtatatccatcaacccccaacattgtctgtgctctttggcaattcctcttttctacctctccctttcccctcctgcctccatccctaggaaaccacttgtctgctttttgtcatgatagagtagtttacattttctaaaattgtatataaataggatcatgtaagtatgtacttttttggttttgcttctttctttcatcataattgtttgagatttatccatgtttttgcatgcatcagtagttcatgccttcttaatgctgagtagttttactttgtacagatgtaccaccatttgttgatccattcacttattaatggacatttgggttgttttccagttttgggcttttactcatggtacagttatgaaaatttatgtacaaatctttgcatggatatatgctttcattctcttgagtacatatctgtgagtggaattgccggatggtatggtagatatatatttaaaattttaagacaattgacatgctgtgttccgcagtggttatacatttttgcagcagtgtattagatttccagttgctgtgcaccctcaccagcacttagtatcagtctttttaactttaaccgttctagtaagtgtgtagcagctcattatggctgtgatttatatttctctaatgatattaagcatcttttcatgtgctaatttttatccatatgaaaatatggtgaaactattcaaatcttttgcccatttatttattagattgttttcttactgagttttgaaaagtttttaaagttttttttatagatttaggggtacaagtgcaactgtgttacatggatatattgtgtcttgttgaactctggattttagcatacccatcagctgaatagtataccttgtaccttgagtatttcattcctcaacccctcccacctttttgattctccagtgtctactattatttcatgccatatgtccatgtatacccattgtttagctcctgcttgtaagcaaagatgtctggtttttggctttttgcttctgagtcatttcccacttaggagaatggcttctaattcaatccattttgctgcagaagacatgatttcattgttttttatggccgagtagtagttcatggggtgtgtgtgtgtgtgtgtgtgtgtgtgtgtgtgtgtgtgtgtgkatacaccacattttaaaaatccaattatccattgatggacactgaacagttttttatataccctggatacaactttatcacatgtgcttatgtagatattttttctcagtggcttgtcattctcctaacagtgtctttcaactagcagatgttttatgttttggtgaagtccagtttatcaatttttttttttaattaggctgtgtctttcttatatctagtctttgattcaaggtcacaaggatttttctgctgtgttttgttctaggagttttatggatttttagcttttgcctttagacctatgatactttcaaattaactcttgtatttgtcatggagtatagattaaaactgattttcttttattgtagataccagtttcagcatcatttttttaaaagactatccccttcatcactgtgctttgtccctttgtctaaagtcggttgttcatatatgtgggtctgttccgtagactttattcagttctattgatcttttttgatatgatgccagtaccatactctgttagtaacgatagtgttttaataatacatcttgaaattaggaagtatagagttattttgcctatagtagatcctttattttgcattttagaatcagcttaagagtttctgcaaaaatacctgcaggaattttgatggagattgcattgattctctagatcaatttggggagaattttaacaatattgagtattttgacatatgagtgcaatatgcctgtcattcattcaggtctttaatttctctcaggattgatctttttaaaagtaaaccctttattttgggataattttcatttttttcccccttcatgtcacagtttttcattttatttttccccctccatgtcacagttttgatcatggaataatttttcaagatctgagagctacagtgaaaaggaaaaaaagaaagaaagaaaacatgatactatagtccctgatgattgattttttttaatcccaatcatctgtaattcttcccagagataagaaatggttgtagtatgttatctcctaggaattttttttggaattcaaacagataaataaaatatactcatagaaacaatgtgttgtttttaaaatrttttctcttcagtttatttttacttactagcttcattgtttcatctctgtcctataggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcggtaaaacagcttctgattgggaaagttattagtgaaacagttatgtycattttatctacattaagcagcttyagttaagagaaagataacagagtgaagggtagagcctcatgtctttgaagcctttcaaagttcgtggataactgaggaagacttgaccttccttgtaagatttaaatggagatgatctttatttgggttgacctacttgtgattatgtagtcaagatggcatgcattcagatatctcagttcaagaaacataaacatctgtatgtaggaagttaggttttgcaaatggtgatagaatgctaccacaaaacctaatggataacttatcctaagctaggattttatgggacaggaataatgaagatacaactaagaaaactcatggttgagtggtttcttctctctgaactattttattaatatagtactattttaaattatgaaatgtagaggaaaccattatccttagctttttcctaccctctccagtcacctccttcattgagaagggcatattaggcatccatctggataaatgacccctgagcaaggtgttagcccacctacccacattctactctgaacctggcataaactgaaaaaaaaaaaaagaggactaaaaacctttgtgtagttgggtcagtggcctattcctgttcccccagattcttttggtggataagttctagagagtgtttaaagtatatttgcattgtttaatcctgttttaaatttttccattgataagactcgcatacagtttggttttgtgatatttctggtctctttgtttcttgtgttttagagaacacccagggactgtaaagtatactcagcaatatgttttagaacagactgttttcttttgcatcactaatcttttcctaacatgcagcatttactgtttaaaaagctaaagtccaccaggcacagtggctcatgcgtgtgatcccagcactttgggaggccgaggtgggcggatcacctgaggtcaggagttcaacaccagtctggccaacatggtgaaaccccatctctactaaaaatacaaaaattggctgggcgtggtggtgcacgcctgtaatcccagctacttgggaggctgaggcaggagaagcatttcaacccgggaggcagaggttgcagtgagccaagatgatgccattgcactccagcctaggcgacagagcaagaccccatcttaacaaaataaaaaataagttaaagttggacgggtgcggtggctcacacctgtaatcctaccactttgggaggctgaggcaggtggatcatttgaagtcagaagtttgagaccagcctggccaatatggtgaaaccccatctctactaaaaaaaatgtaaagattagccaggcatggtggtgcatgcctgtaatccccgctactcaggaggctgagacaggaggattgcatgaacccaggagataaaggttgcagtgagtggagatcccaccacggcactccagccagggcattagagtgagacttcgtccccctgcaaaaaaaaaattgtattaataacatatttattaatttgttatatctttatggattatggagtaataatagatacgctcttattccctcctcataaacagttatgtggtttttgttttttagggtttttttttttttttttttttttttttttttgagacggagtttccctcttgttccccaggctggagtgcagtggtatgatctcagctcactgcagcctccgcctcctgggttcaagtgattctcctgcctcagcctcctgagtagctgggattaaaggcacctgctaccacacctggctaattttttgtatttttagtagagacggggtttcatcatgttgggcaggctggtcttgaactcctgacctcaggtgatccacccgcctctgcctcccaaaagtgcggggattacaggcgtgagccaccatgccttgccaacagttaggtgtgttaggtttagtccatataagggctagaacttcccttacacttaaatcttaaaaggaaaatattttcttaagatttctttttttaaacattaagtggtgcattaatcttttttctatagcctaatatgcaaatctgcctactttgagtaaggctaaatagcttcaggcttcttctgtaggcgtgagttgaacttcagttgagtgtttggaagatgtttgtcatcagtcactagagagtgaccagtcagtacaaaagcattccctactagaaaaatagctgtgtccacagccttctggtgaggggttggttgcctggcttcagtctatttcaaaagtcagtgcatataaattgaatattaagtcatatggtgtatatggcacttaaacatcacttcctaacaggtaaaaacccagctttctctgctttgtgaatagtgtatacatatttctttcagagccagtttttagtctttttgccttcaccaacaaaattacttctgtgcacagtagaattatttggtcttgtgattggagtcctgacagcaagtatttcttcactgggagtcgagacaaaaaggtaattatttaaaaatttaatattttttcaaatgtaaaaataatatttttataggtatgtttgaataaaaaatgcataatcctgcctttctgttacagcttttaaaaatcagctatgtattcctttctgtttttcgtatatgtacatataaaaaaagacttttcttgttaaattctataagtaaatttctctgaaatgtcaaaaatatgaggagaagacctttcagacatatgaccttcatcaaatggtcccagtggaagaagagtaataaatgaaattaatcaagaccaagaaactaggagggcagcgggaggtaggggaataagggaaaaactattttctagttttcttacttttatgaatttaacatttttctgtaataaatgattgttaccttttcatttggtgmtagaagtgggtggagtatgactgacccaagctttaaaaaaagtcaaaacaaagtagctaggaattttttttttttttttgagacagggtctcgggtgcagtggtacagtcacggctcactgcagcctggacctcctgggcccaagcaattttcccacctcagccttggcctcccaagtaggtgggactacaggtgctcaccaccatgcccagccaatgtttttattgtgtagagatggggtcttgccatgttgccaggctggtcccaaactcctgggcgcaagcagtcctcccactttggcctcccaaagtgttggaattacaggcatgagccaccacacccagcctcagagtatgttctccaacatgaccttcacctttgttttctgggaaatgtccacctcacctctggtctttcctttgttttcatactctttaaaatatccttttgttcctacagactagaggtggtgaagcagtttagtgttggccattcctctccctgccttctttagtcacagacaaggtacagatcactgaagtggagtgctagcacagacagggtgtcactcaggctaaacacttacatgtcaacctctatggcagactttacgtctcagaccctcccttctgttcatttgcctgttctttctttcttggcattggtgtgcctgtgctgtgcttgatgctgaggaagaaggactgcttttgtcccccacagtcatactgtattaatctgttttcatgctgctatgaggaactgcctgagactgggtaatttataaaggaaagaggtttaattgactcacagttcctcagggctggggaggcctcaggaaactcagtcatggcagaaggtgaaacaaacacatccttcttcacgtggtggcaggagaaagaagtgctgagcaaaagggggaagcctcttataaaaccatcagatctcgtgagaactcactcactatcatgagaagagcatggaggtaaccgcccccatgatcctattacctcctactgtgtccctcccacaacatacagggattatgggaactacaattcaagatgagatttgggtggggacacagccaaaccatatcacatgcctatagaacatggtccagctgctactctcagggataggtcagggatccagcagacaaagcagcattcgctggacattctctgaaatgtacttcttcttgcttagacaaagccttctgctcagtatcttgctttggttctgcattttgctactgttgtccacttcacttctctctccatttctttttttttttttttttttttttgagatggagtttcgctcttgttgcctaggctggagtgcagtggcgtgatcttggctcactgcaacccccgcctcccaggttcaggcgattctcctgcctcagcctcctgagtagctgggattacaggcacccaccaccatgcccggctaattttttgtatttttagtagaaacggggtttcaccatgtgggccaggctggttttgaactcctggcctcaagcagtccacccatctcgacctcccaaactgctaggattataggtgtgagccaccacgctcagcctgctctccatttctttgtgaccattcacacatccttgaggcatgagcttccagggaagcctcatttcatgaggggtatcatctaggtcaggttttcctcatagctgagtagattccctgagcaatggacagtgtagaggaagagctagaaagctgataagttctttttttttttttttgagacggagtttcactcttgttgctcaggctggagtgcagtggcacgatctcggctcactgcaacctctgcctgctaggttcaagcgattctcctgccttagcctccctagcagctgggattacaggcacccgccaccacgcccagcttattttttgtatttttagtagagayggggtttcactatgttggccaggctggtcttgaactcctgacctcaggtgatccacccacctcggcctcccagaatgctgggattacaggcatgagccacygcgcccagcccaaaagctgattagttcttaakcattttgtggtagcttcttggggaagtgcatgagcctactgatgggactccactggatcagaaccaatttgtgagtatagaaggcatgttagacacctctctgtggtctctgggcaggaacgctttgtctttggaccaaggtgagctctcggagacgcatgtctgctgtaccgtgccttctttctgatgcttgaaatgytctcaagtcctggcacrccatacacgaatgtaatgatgcattttttaaaataccagagcaaatactttgttttatctttgccgatgaaactgtagtacatggctagaaaccttgcaaagagaaggctttacagtgtgtgatctgtctgtattaggtggttgtctggggtgagtgygactccactgatgactgtattgagcacaacattggcccctgctcctcagtcctggacgtgggtggggctgtgacagctgtcagcgtctgcccagtgctccacccttctcaacggtcagtctctgtgtggggcttagttttaagaggaccacttggtttcttaatatgtagccctcrtgtcatttcatttgtgaattctcctagcctctgagttactgtcttttttttctttttttttttttgttttgagatggagtctcactctgtcacccaggctggaatgcagtggcgtgatctctgctcactgcaacctctgccttctgagtttaagcgattctcctgcctcagcctcccaagtaggtgggattacaggcatgcgccgtcacgcctggctcctttttttatatttttaatagagatggggtttcaccatgttggtcaggcaggtcttaatctcctgacctcaagtgatccatctgcctcgtcctcccaaagtgctgggattacaggcgtatgccaccgtgcctggcctgagttactgtcttttgcaaaatgcttatgtttctcataataatttttaaattgatagaacctaatgattcagaatgtaaaatacaggttaggaatggggctcaaagattcttacttcaccaaatctaggactataatactttctctgtaacaagcatcttcagtggaacaagggtccctacagccagctggggaaacactggctcgtgggccttgccagcagaggacacagataaatctgtgtgcagcccctgtaaagaggaggctccttgaggacacaggagagcagtgcagcatgtcctgggctgatgcctgcagagtcttttgtaaggcagggacagttgggacactgtgaagaactactttagagcaatgacgaagataacaatttcatgctaarttaatcactgttgtccccctcccttaaaaacagatrcgtggttgcagtaggattggagtgtggaaagatttgcttatatacctggaaaaagactgatcaagttccagaaataaatgactggacccactgtgtagaaacaagtcaaaggtatttctttcctatttttgtttccatcagattaactagaaattgtggggtctttcatggcaaattttatgccacattttcatggagagggacatatatctgtattcgtcgtgtctaccactttgttttgtggtaatctgaaattgatacatgtggtaawctgaaattgatatattgcacttgatttttaaaagtttgcttgaccaaattgcttgcatgcataatattatttttataaacaaccatttgagatgaaagtgatttccataatggtgtgttgtagaatttgactacagtagattcttaatttgattcaaaatgtttgtgatttttaaaaatattctggattgcactttggtagtcgtatccttatgattgagccctttacctcaaaagatcctatagtggagctttcaggcatagcaaggctcatgccctgggcctcatgcatttgccacctgagctggcatagagcacctgctgtttacaacctcctccccatcccacccacctagacagtagggatcacttttaatctacccttttacaggttttattctttttgtgtgtgtgtgagacagggtctcactctgtcacctaggctagagtgcagtggcaagatcccagctcactgcaacctccgcctcccaggctcaatcagtcttcctacctcagcctcccaaatagctgggactacagacacgcaccaccatgccaggctaattttttttgtatttttagtagagacggggtttcattgtgttggccaggctggtctccatatcctgggctcaagcaatcctcctgtcttggcctcccaaagtgctggagttacaggcatgggccactgtgcctggcccacattttattctttaaaaatgcctaaatgtggctgggtgtgttggctcatggtctctaccagtgagacccctggtctctaccaaaaataaaagaaattagccaggtgtgatggtgcatgactgtgggtcccagctacttgggagggtgaagtgggaggatcacttgagcccaggaggttgaggctgcagcaagccataatcacaccattgcactccagcctgggtgagtgagagcctgtcccccccaaaaaagtataaacrttcagaaagctactaatatcattctgtgttatattttcttaggctttttcaaccttcgtatatctgtactgttgaaaatacaatttcaaatagcaatttcaaatgacaatatgatgagggtgagtgcttaatggagagagatttgtgagcaatgtcttaagatatttcatccagcagatcttgtctccatgtcagccaagcatgttagtgctcattataattatatttattaaaatgagatattgccatgcccccatggcttctctcctgcctctctgggctgggtttagcagttgaactagtttgtgctgttggcttgctgaagagggaagaagtctgttgaaattccatgcttcaggcatttgaaattttctctcttcctgggcaccctttccttccactttgcctgcccacagtgctcccttcacctctaacctggtgtgaagacctcttcaatggccaccatgtgggacactggtgggaagccccttagaaagtgcaggaagggaacacgtatagaatttgagttttttgtctgaaggggttgtttttttctttggtcattatggtgacttaggrtttgcaagatggaactaatgcgtgacttaacatatattatttggattgctaatatttcagttaccamgttccaagtacctttcaaatgaaagcttttgctagtaataagatttacagaggtaatataagcaaacactaccctttaggttggtttgccaaactccctatcttcttaaatatgacatgttaatattctggatttaaaggacattaccaaaaaaagaaacccactatctcaaagcttacatagccaaacaagtatgttcctcaaagtagctcccttggaaagagttataccacatatgtttatttccgtgatttcactacttcaaatccttcttttaatgaaatgagataactctaatccataataattgagattccagtgatgttgctatcacttaaaatgttcttggaacttctctgtaggaattgtgttcagaactagcttactaatgatgcaagaaaacaaattataatgccttttataatattacctgtttcaatcatttcctctttttaaagcttgccattcatatctattaagcttgccatttatatttattataaagcttacttccaggtgctttcaacagtcagattcatcctcaaaggaacatgagctatcactgagagtactcaaatcatagtctgcataatatggaagcattttctctagaataatttcagaaaacagttgaggcacagcagtcagagtgactatttgtaagggcacgcagtcatcttgttgcataggttcaggaggactgatttttaaaatgggtttcgtgacttcattcttcccttttaatcatgagaatgcatctggtgacagggactgtcagcaaatgaaagtgtaatgtgtgtgctctggtattgttttcagtgtttattgccctaaaacctacttaggtttttcactttattcctttttggtttgggaagctaatttgcaggttaaatttatagaagatgttgtattttcatagagatttattcctaacatacgttggtaacactctgggtctgcctttttaaagggctggggaggtagggggtagggagcattaatacgatggtcttgcccaaggtcacgcagttagaggtcacactggagaccaagactctttcattgtgcagtacattaaatctgtcattgtctttctttacccagtagtaaaaatgcaattccatccacctcacagggatgtcaaaatagtaaaataatctagaatatattgtaaagttaaaattgttataaatttagtaatgttatctaaaagactaacttgaatatccatttcatgaaattccattgatcattaaaacaacattcatttaaaaaaattttattttttgtttttttttaaacaacatttgacagagattcattgtctgtgtcttgctcattttggtgatgttattgccagtgagtaagattaaaatttagtcttgcagttttaagtaaatatagtaaaatattttccaggttaaaataaaatggctaaaatgttaatgatgygattttaaaacctgtacatttcaattttcaggttttaacttccattcatgtttacaccattaattggaaaaacatttcatgatttctctatctttgttttagccaaagtcatacactggctatcagaaaattatgctggaagaattgcagtggaaaaactgnacagaaggaagyagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttttttttttttttgagatggagtcttgctttgtcacaacctccacctcccaggttcaagcgattctctttcttcagcctcctgagtagctgggactagaggcacaccaccatgcccggctaatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaatttttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatgtatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcatctgtatactcttgtgccgtcagctggggggtggggtgtgtgtgcgtgtataccaaggcagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggttttatcttaattaaaatgacatcaccaacaatgggccctttcctgtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttaagggaagttactgtggtctgtaacttatgaaatacataaaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactccttaaggggtgttcactgtacaattctttcaacttttctgcatgctgggagtttttttggtaacaacgtgttggggaaaatggccttggaatatttcattcaaattggagccaagctaacacaaagctgttgctgctagtgggaacagccctgatgtccatgtaacaagctgccctccccaactccctccttcctgtttctccctcctcggcacccacttctaggattaacaggcagggagacgggagagcccagctctgggtacagttgggccacagcagaaggagggccagggtagaggtttgggccttggctctgatgcttgaacataaacacacctagtcagaagtacatcagtacaaagtgggccctacaaaattatagggtcagaaaacaggtaagtggttaccaggggctgggaatggggagaggagtgactacagagggacctagattcttcaacaaatacattacaagaggaaaagggaagggaagggaagcctggagattgaaagatacttgagacgtgtgaatccagtgcaatgtgtgaaccttgtttgcctcttgatctgaactagccaatcaatcttgtaaaaatgtgcttaagggacaaagcaaatttgaactctggctggatatttgatgatattaaggaaacaacatttaaacatatgacagtggggctatggttatgattggttttgttttttttttctctagagactgggttttgcagtgttacctaagctggtcttgaactcctgggctcaagcagttctcccacctcagccttggtttaagaaaaaaaaaaaaaaagttctcttgaatcataatttcagtatttatggatgaaatcaatttatgtcttgggttgtttcataatgattgtgtgtgtgtcaaggactagatgggttttagatgtgtggattattaatgaagctgggcagtgttggggtggtcatactattctaattttttaatatacttaaaatttccttataagaattgtttagaaagaatgagcatatccataagttaaatacaaaaattgttacattgtgaggagttcttccccttctagcatgtagtggatggtccagtattaaggctctgccatgcttaaacaaaagactggcactccaaggacaatgaggctgaggccagaagagagacagcgtgttggatggctgcatgtggttggtggatagaggactctgagccccactctggtggactcagagatctgggacccgggccgggcgtggtggctcatgcctgtaatcccagcaatttgggaggctgaggcgggtggatcacttgaggtcaggagttcgagaccagcctggccaacatggtgaaaccccatctctactaaaaatacaaaaaaaaaaaaaaaattagtcgggcatggtggtgggcgcctgtaatcccagatgttccagaggctgaggcaggagaaccgcttgaacccaggaggaggaggaggttgcagtgggccgagatcgagccactgcactccagcctgggcaacagagtgagactccatctcaaaaaaaaaaaaaaaaaaaaaaaaaatctgggacccagtactgagtgaagacaccagagtgaaggagagaggccatgctgtgtccgagaagctcctactggggtggaagggacagctccacaaaggctgctcttgcaggggctctcctgcagcaaggtgcctgctgactgtccccagactgtctcccgacacagagggatgcaaaggcagcctcttcctgctcagtggaatagggaaattatatcacctttcacttcccactctcacttctgcccctgctacccttagtctttggcttttgctgacattttcccctcttatcttttctcctgaccaagttctaggtatttcatagggcagtctaggtgagggttggaaccccaatgagttgggcaacagaaacccagctcacactggctgtcactgtgggcaagctgttcccctcatctctaaaagtggagatgagattagtgtatgagtctggcttccattcaactgtgtgtgaaaaaaaattgtaaaattttctttctggtttacgcaagttaaaagtttatttctctcatatgaaaggagtcaaggcagacagaccaggatggggagggagatgtctacagggtcaaggacccaggctcttatttcgctgtctgacgtccttagtatgaggctttcaccttccaggatggctgcttggcctcctgccatggtctttgcattccagccagcaaagaggaagaaggcatgaagaaaggcctgcctctgactttaaaaacatttcttggaagtcccatactattttgcttaatctcctcgggcagaatttagtgttgtggccataccgagcttcaggagaagctgggaaattaaatctttattgcagatgcccatgtgctcagcagagaactggggtgcttcattctggaagaaagggagaacaacagtaaccagtgtgtaggattgttctgagaattaaatgagccaatatatgaaaaacactagtttggtccctgggatataaataagacagcagtaatttgtatctggtactattatgattaaataaagctctgctcgtgtcaactccatagagcctttggtaaacccctcaagtattcttttttgtttttcctctgaattccggagtattttattccagttttgttttatggcacttgtcaccttatatcttctatttttgtgtatgttttatgctgtgtcaggtagatgccttctattgtaaggaagttcatctcaaacacaaaggaatta

SEQ ID NO: 10874 - DNA, 50010 bp, Homo sapiens
  misc_feature (1)...(50010): n = A,T,C or G, or insertion/deletion polymorphism (see Tables 1-2)
acctgggaggcagaggttgcagtgagttgagattgcgccactgcactatggcctgggcgacagagtgagactccgtctcaaaaaaaaaaaaagaaagaagaagaagaacagtacgttgctgtcccaaatcagggttctgttagcaagataatgggttggggtcatggccattgactaagcatcactgtatcttctacagatatctttacacagtcggcacacactaaaccttcctatatcctgtggttcattcaaattggattatactgtaaacatactcttaatttcttgcccttgcattcttacttatgctttgtcctctatttagaagtcatcatacataggattttgtatgcatataaatcttacccatacttggcagtctattgaaaatgtcatttctgtcatgaagaattatgtggttcccccaatagggtgcaattgtcccacctcttaaatccttaagaatacttacctttaaattctaattaatgtgtttatttaccttatcacccctgtagtgaatattgttttgtctgcctagcacttagtaaggcatcttgctaattgggccataataatgggcatgcaacccaatccagtgagtcagagtctttctctgtaatttttcaaattggatctagggaaaagaatcccctttcctcactggtcacagaattaaaaagttgcataactggaatgctttagatatgtccctaatgtatccctaaccaatgccatgtatcaaggaaaattctaaatgaaagatccaattaaaaagagtactctatcaaggcttaatttagaattttgatagaaaaatgtaagtcagtatttttgcaacctacaaccagaaagagattttaaatacaattttaaaaggattaatcaataaggaaaaatatctatgactgttattacattttttggggggtgggggatgaagtcttgctctgtcgcccaagctgtagtgcagcagcacgatctcagctcaatgcaacctccaccacccgggttcaagcaagtctcatgcctctcagcctcccgagtagctgggattacaggtgcgtgtcaccacacctggctaatttttgtattttttgtagagacagggttttgtcatgttggccaggctggtctcaaactcctgacctcaagtgatccacccacctcggcctcccaaagtgctgggattacaggcgtgagccaccacgcccagcctgttattgtaaaaaatttaaggatttctgtttaggaaatgacactatggacaaagttaataagcagctaacagagtaagagaagatatttacaaagacaaaatctgacaagagattaatatctagaatttcaaagaataccttcacatcaacaagaaaaaggtaatgactacatacagaaatgggtgaatgatatgaacagccaattaaaaaaccagaaaaccaaaaactgagcatgcacaggaagtgcttaaaatcattagtaatcagaaatataatttttttaaaaaagataacatttcacactcattacactgccgaaagttgtgaatcagcatgatgtcaagaattggcaggggtgtggacatacaggaaccctcatgcaagggcggtggagagcaagctgtcattactcaggcaaataaaatagacgtctgtcacccaacggttccactgctgtgtgtacggaacgctctcacacagtttataaaggaacatgtaggaatatgttcactgtagtattatttatgatgttcacagtggggaaggtagatgggcgaaatatggtggatgtacaccatgggaaatgctgtggcaggcaggcacgatggattagaaatcacattgtgttagtttcctaaagccattgtaacaaattaccacaactgggtggcttaaaacatcagaaatttagcttctctcagttcttgaggctctaagtcccagattaaagaacttggcacggccatgttatgaagtaaataatactacagtggatatgttcatgtatgtcccttcgtaaattgtatgaggactttttgtacacaggagtggaatcactgggtcgtagacatacactttatttgactaagtaatgacagcttgctctcacagcaggggaggatacttccttgcctcttccagtttccggtggcctcatgttctttggcttctggcataatgactgcaatctctgcctccatcttcagagggctgccttccttctgtctttgtctctgttttcttatttttatttttattttttttgagactgagtctcactctgtcgctcaggctggagtgcaatggcacaatcttggctcactgcaacctccacttccgggttcaaacaattctcttgcctcagcctcccgagtagctgagattaaaggtatgtgccaccatccccagctaatgtttgtatttttagtaaagacggggtttcaacatgctggccagggtggtctcaaactcctgacctcaagtgatccgcccccctcccaaagtgctgggattacaggtgtgagccacctggcccgggcgtctcccttccctccctaggctggggcaggagaatcgcttgaacctgggaggcagaggttgcagtgagcggagatcgccatcaccgcactccagcctggacgacagagcaagactctgtctcaaaaaaaaaaaaaacttacagaagaaaacatgaaagattatcttcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagacagagttttgttcttgtcgcccaggctcaagtgcaatgactatatctcggctcactgcaaactccaccttccaggttcaagcaattctcctgcctcagcctcccaagtagctgggattacaggcacccaccaccatgcccagctaatttttgtatttttagtagagacggggttttaccgtgttggccaggctgatctcgaactggccaggctggtcaaggcgatcctctcgtcttgacctcccaaagtgttgggaggtgtgaggcaccgaacccagcctgttttcttataacagcaattatattgaagagggtctatcctgaattgagtatgacctcatcctacttgattacatctacaaagacccctctctaattaaggtcacattcacaagtactggaggttataatttctacctgtctttttgaggaacacaattcaacccacaacaaagaatagcaggaactatttttaaaatgtagtttttagagctgagcatggtggtgagcacctgtagtcccagctactcaggaggctgaggcaggaggattgcttgagccctggagtttaagacaagcctgagaaacatagtaagaacccctctctaaaaaaattttttttaattagccaggcatagtgtcatgcacctgcagttccagcactttgggaggccaaggtgggagaattgcttgaggctaggagttcaagaccagcctgagcaacatagcaagaccctgcctccaccaaaaaaatgtttttttacttagctgggcatgtagcctctgtaatcctagctacttaggagactgaagcaggaggatcacttgagcccaggcatttgaggttatagcgagctatgaccgtgccactgcaccatagcctgggcagcagagtgaggtgctgtctcttagaaaaaaaagtttttcataaaaaaaaagaaaacaatataatatatacaataacatgcaggtaggtaactttaaaatacatttaccccaaaaattatgtttcagaatttataaaattcagctaaaggagttcttagaggaaaatttatagtttaatagtttaaatgcctttacttaaaacaaaaaaaggttaaaatcataagaaacaaaaagaaagaaaagtaaagtaaacctaaagtgagcagaagaagtgatgaagataacaatgaaaatcagtgaaacaaacaaatggaaaaacaattgtagtaattaataaaaccatgagctggttctttgaaaagacaggtaaaattaataaacatctagctggactagtgaaaaaaggagaggacacaaattaccaaaatcagaaatgaaaggacacaacaaagaaaacaacagagtgagagaaaatatttgcaaaccatatatccaataaggggttactatcctattctaaatatgtgaagaaagcaaacaactcatagcaaaatcagatcacacgactaaaaagggggcaaagggcaccaggtgcactggtttacacctgtaatcccagtgctttggaaggctgagacaggagaattgcttgaggccaggagttgtgaaaagcctggacaacatagaaagaccttgtctctacaaaaaaattttagattagccaggtgtggtgacatatgcttgtagtcccagctacctgggaagctgaggtgggaggatcacttgagcccaggagttagaggttgcagtgagccatgattgcagcactgcagtacagtctgggcaacagcttgatagcttgagaccctgactcttaaaaaaaaaaatcatttatcaaaagatgacatacaaatgatcaacaggttcataaaaatgctcaatattggctgggcacagtggctcacacctgtaatcccagcactttgggaggctgaggtgagcagatcacctgaggttgggagttcgagaccagcctgaccaacatggagaaaccctgtctctactaaaaattccccagaggctggggaataaggggctgggggagagaatggggagatgaagatgttggtctcagggtacaaagttaacagttaaacaggaggaatacaattttgagatttattgcacagcatagtgactatagttaataataatttattgtatatttcaaaatttctaagagagtaagttgaaaatatctcgccacaaaaagaatgataagtgggctaggtgcagtggctcatacctgtaatcctagcactttgggaggctgaggcaagaggatcacttgaggcgaggagttcaagaccagcctgggcaacatagcaagaccctgtcgctacaaaaacttttttttttttttttttgagacgtagcctcgctctgtcgcccaggctggagtgcagtggggcgatctcggctcactgcaggctccgtcccccggggttcacgccattctcctacctcagcctcccgagtagctgggactacaggcgcccgccaccacgcccggctaattttttgtatttttagtagagacagggtttccccatgttgcccaggctggtctcgaactcctgacctcgtgatcagcccgcctcggcgtcccaaagtggtgggattacaggcctgagccaccacgcccggccccaggggacattctagaggggacttcaccccccaagccgcacttctccatttccctgcggtcgtcgctaaccgaaggcgccatccggtgacgactggatgtgcgcggcggtggtgagaggccgcgagaaccaccaggtccaccgctgcctcggcccgggcggaatctgggaaggtctctgacaaccattcatcctcagattttcccaattgtgcatgggtgggcgggccccgcatcctaatgggcactgggcatgtgaagtgtgaaccacccgggcctaactagcccctgaaggcctgacgaaaccgccaggcccaccagggggcagcagagatccgacggccgcggaccgagggaagctggcgggaagtaggaggcagagggcgcgcagggaagcggcagggcgagcggctcagaacgtaaaagccagcaccgcgcctccaggttgctttacggctgccgcagaaggctttgcggctcttttcccctccgacttgatttacggttccttctctggtctgtgtttttttttttcccctccggcgctgggcgtgggttcggaccttcttcccagagacgctcgcgcacccttcccattctcctctgcgcggcctccatctaagatctcttccccttgtccatagcctagatcgagctccctgtgtgcaccgcgcgctgcccgaggcgcgtaagtgggggaggagagcggcttcccccsgggtggttctagccgtgggtgtggagcgtgggaaggctcagcttccgggtcgagaacctggggctgcggtggacctgatcctgaggtctcagcgtagagatgctgagtccagaggcctgttctagttcaccagtgcagtgaggggctcagtatccgggcctcccgagaggtgggtaggaaggcggggtacaggaaacttggcaccaacgcgccgggaccccaccgcggtgcggacagccaggtgtccgtggtggcgcttccttggagatgctgcctgcagacaggcgtggggaatctgaagtttgtgttaatagctaaacgaagttgagttgcagggagcgggggacgctgggaagaaatgattgatttaaaaggaatttgacgccgggcatggtggcggcatgcccccatgttccctggaggtcaagcctgcagtgagccgagatcgcacccgtaccacgacactccgtcccgggcgacagagcgagaccctgtcacgggggaaaaaataaaaataaaaatttgacgctcactttagctgagtattgagccttgttataacattgagatagaggtctggcgcggcgtctcacacctgtaatcccagaactttggaaggccgatgcgggaggatcgcttgaggccaggagttctacgccagcctggctaacatagcgaaaccccatctctactaaaaatacaaaactaggcaggcctggtggcgggcgcctgtaatccccgctactcgggaggcggaggcatgagaatcgcttgaacccagtaggcaggtgtgccggtaagccgacatcgcaccactgcactccagcctgggggacagagcgagaatccatccaaaaaaaaaaaagttataattcacgtacaattaaattcactccctttttttaaaaaaagtggagacatagtctcgctctgttgcccaggctggagtacagtggcgccgtctcggctcactgcaacgtccgcctcctgggttcaagcgattctttgcttcagcctctcaagtagctggaattacaggcgcataccaccacacccagctactttgtatttttcaccatgttggttaggctggtctcgaactcctcgcccttccaaagttcagggattacaggtgtgaaccaccacacccagtctaaattcacccttttaaagtgtgcaattcagtggttttaatatattcacaaggttgtgcaatcaccactattatctaattccagaacatttttatcatccctaaaagaaaccttaaaaccattagcagacacccattatttcctcctactcccagcagcactaatctatgaatttacccattctcagtactgtattatacaatagttgttcttttgtgtttggtttatttcacttcatgattcaaagtccatctatgttgtatgtagcatgtatcaacttcattttttaaataactgaattatttattgtgtggatataccacattttgtttctccatttttgatggatactggtgattttctaggctttctaggtctagtcctccacagaactcgcagtctgaggcacagacatttaaaacttaagtttttggaaactagcatttaactcttgggttgggtcaggtaattcagtggcctcaggtctggtatcgtttagggcagttttttttttgttttttttttttttgagatgaagtttcactcttgttgcccagggtggagtgcaatggcgtatctgggctcactgcaacctcacctcctgggttcaagcgcttctcctatctcagcctcctcggtaactgggcttacaggcgcatgccactatgcccggctaatttttggtatttttagtagagacagggtttcaccatgttggccatgctggtctcgaactcctgacctcaggtgatccacccacctcggcctcccaaagtgctgggattacaggtgtgagccaccgcgcctgggtgggagttttgtttttttgtttgtctgttgttttttggggggacagagtttctctcagcctcctcggtaactgggcttacaggcgcatgccactatgccgggctaatttttggtatttttagtagagacagggtttcaccgtgttggcaatgctggtctcaaactcctgacctcaggtgatccacccgcctcggcctcccaaagtgctgggattacaggtgtgagccaccacacctgggcgggagttttgtttttttgtttgtctgttgttttttggggggacagagtttcgctcttgttgcccaggctggactgcagtggcgagatcttgactcactgccacttctgcctcctggattcaagcgattctcctgcctcagcctcccgagtagctgggattacaggtgtgcaccaccacacccggctaattttgtatttttagtagagaaggggtttctccatgttggttacgctggtctcgaactccctacctcaggtgatcctcccgccttggcctcccaaagtgttgggattacaggcgtgagccactgcgcccctctgggagtgttttttaaagtgttctattctcagttcaccacttaccaggccgttaattatcgtggtatcaagcagagaaatgtttgtgtgctggtcttctcagggaggcagaaaccgtcagagattgctgttgtgtaatgtacaccaaaacgtgttatcttgtagtataaacggtgtagttgsagatgagtgtatgaaaaatgtaactgagctagctgtgggagagactagttgtgaaaaattttgagtcacccactgtatgctttcccagctatgttcaaataaggtgacactctgccttcctgtttcagctctaaaactgttcrtaagtgttattttggctgtatacgtagtgccatgtttttttgtatttttgtgcttttggtgattttgctgtttatagtggcctccaagaatagaagtgctgtctagcatttccaagttgaaggctgtgatatatcttatagagaaaagataagcttttagattagctttgttcaggcatcacttttgttgttggctgtgagttcatgttactgcatcaacaatatatattaaataagatatctttaaacagaagcacacataaaacaaggttatgtattggcctgttgagtaaccctgtatttcccctgggagcagtggctcagtatttgctagttcagtgttcatgatggctttacaggacataactaccctgaataatgagaactgactgtctcagtagtgcttcaagggcagaaagcctagtggatatttttccatctctgcagcttttagcatttcttcactcaaggcactcatttttaatattgaactggcagttttgatgtggagagaagctaaaataaggctaaaatgctcttcatactatgtgctgagtggggactgtgctgagtgttggggattcagtgattagtgtatggccccgcagttctctaatggctgagtgtgggagtgcagagaaatgatcagtgtgagggaattaatcctatgttcccaccgtgtttttttgttttttttgagacggagtttcactcttgtcgcccaggctggagtgcggtggcgtgatctcggctcactgcaacctccgtctcccaggttcaagcgattctcctgcctcaacctcccgagtagctgggattacaggtacctgccaccatgcccagctaatttttgtatctttagtagagaagaggtttcatcatgttagccgggctggtcttgaactcctgacctcaggtgatctgtctgcattggccttccaaagtgctgagattacagatgtgagccaccgtgcctggccactttttttctacttttgctaatttttttaaagtttcatgaacattatagtactgtgttcatcatgatagaactacnnnnnnnnnnnnnnnnnnnnaggaacgaatggcaagtccagcatcatgatggcttacagaatacccccctgataagagacgacaaagctcacaccagtagtgcttcaggggcagacagcctagtggatattcaaccatatcagcagctagtagcatttcatcactgaagccacttatttttatgattgaactggcagttatgatgtggagagatgctaaaatgtggctaaaatgctcatcatactatgtgctgagtggggactgtgctgagtgttggggattcagtgattagtgtatgcccccgcagttctctaatggctgagtgtgggactgcagagaaatgatcagtgtgagggaattcatcctatgctcccaccgtgttttgtttttttttttgagacagagtctcactcttgctcaggctagagtgcagtggtgcgatcttggctcactgcaaccttcgcctcctggattcaagcgattcttgtgccttagcctcctgaggagctgagattacaggcacctgccaccatgcccagctaatttttgtatctttagtagagaagaggtttcatcatgttagccgggctggtcttgaactcctgacctcaggtgatctgtctgcattggccttccaaagtgctgagattacagatgtgagccaccgtgcctggccactttttttctacttttgctaatttttttaaagtttcatgaacattatagtactgtgttcataaatgaaaataaaagaaacttgctccagtcttgttcatcaagccgttcttgaccttcacagtcagaatctcacccatcaccttgtcacatctccctcttgatctgtatatccagagtccacctgacatgcttcttcagccctccacatataataagaaatggttttgtgagccgagattgtgccattgcactgcagcttgggcaacagtgtgagactcctcaaaaaaaaaaaaaaagaaagaaagaaaaatgcttttaggtgataaggaaatggagaagaataaaacatctttgccagtctttacctttttaatatcttgaattcatgatttcttgccatagccactatcctagtccaggctctctcccttctacccctgagttttttttttttttttttttaccatgtttttatttcctctgggaaaacacctatcagaattttgggatcatatgacagatacatatttaatttctttctttcttttttgagacagggtcttcctctgttgcccaggctggagtgtagtggtatgatcatggctcactgcagccttgaccccttcctcgcccccgctcaagtgatcctcccaccacagcttcctgagtagctgggactgccggcatgctccaccatgcccgactaacgttttgctgcttgtagagacagccatgttccctaggcttgtcttgaactcctgagcctcaagcgatccttccacttcagcctcaagtgctgggattacaggcgtgagccaccactcctggctacttaatttctttctttctttttttttgagacagtctcgttctgtcacccaggctggagtgcagtggggtgatctcttctcactgcagcctctaccttccaggctgaagcaagccttccacctcagccccctgagtagctaggactacgggaacattccaccaggcccagctaatttttgtattttttgtagagatggagtttcatgatgttggccaggctggtcttgaactcctcacctcatgcaatccgcctgcctcagcctcccaaagtgctgggattacaggtgtgagcaactgcacccagcgggccccgcccagacctattttcaaaattagaaaaccgtgaggcttctggaagaagatgagaagaatatcttcatgacctgagtgtgtgcaaaggtttcttagggctcaggatgccatagagtcacttaaaaaagcaaaaaaaacccaaaaaaaaaaccacacacacaaagataaatatgattgattacatcaaaatgtaatcacagactactctaagaaaatgaatggggaaacacagggacctatttgacaaaagactgatattcaagataaataaagaactaataggccaggcgcggtggctcacgtctgtaatcctggcactttgggaggccgaggcggggggatcacttgagctcaggagttcgagaccagcctgagcaatatagtgaaaccccatctctactaaaaatacaagaattagaattagctgggcgtgatggcacgtgcctgtagtcccagttactcgggaggctgaggctggagaattgcttcagtcaggaagatggaggttgcagtgagccgagattgtgccactgcactccagcctgggcgactgaacaagacttcgtctcaaaaaaccagtagggctccaggcctgggattgggcctcygctgctctactccctggacgtgtggctccgtccttggagtcggcctttggttttcatgaagagtagtgtgcattaacagctgagtggttttatcagcctgtttcctgccaacagtgtatgagagttccagttgctttacatccttgccagcatttggtgttgtcagtcttttgagttattctgatgggtgtggtgtgtcatggtcttaattttagtcctcagtcactaatggtgtttagcactttttcctgtgcccatgacaatgtgcatcttcctttgtgaagtgcctgctcaaatcttttgcccattttacattgggttgtgtgtctttttattattgagttgtagcagttatttatataacctttatatcctggttacctgtcctctgtctggttgcctattcattttcttagagttgtctgatgaacagaagttttacattttgatgtaatcagttttctcttatattttcttttatagttactgctttctgagtcctaggaaatcttggctaccttcaggctgtgaagataatctttcatgttttcttctgtaagttttttttttttttgagacagagtcttgctctgtcgtccaggctggagtgcggtgatggcratctccgctcactgcaacctctgcctcccaggttcaagcgattctcctgccccagcctcccgagtagctgggattacagacatgcgccaccatgcccaactaatttttgtatttttattagagacagggtttcaccaggttggccaggttggtcttgaactcttgaccttgtgatccacccgcctcggtctcccaacatgctgggattataggcgtgagccaccgtgcccggcctataaattttatagttttagttttatgtttaagcctatcacccatttctagtttaggtgaatggtgtgagatataattaaatattaatttcttttccatatagatatccagtcattccagcaccatttgttgaaaatrctattgtattgcgttttggaaattaagatgactgtacaaatggtaattgatgtctgcactcccttttctgttccattgttcaatccttgtgttagtaccacacttttaattactgtagctttttagtaagtcttgaagtcatgtagttgtaggtcttccaattttgttgttttcaagcttgatgtgaatattctaaatcctctgcatttccatataaatatcagaattatctttaccagttttacagaaaagtctggtaaagttgtgattgggattgcattgaatctatggatcaatttggaaagaaatgacacctaaacagtattgagtcttcaaatatatgaacttggtgcattttccttcttatttaagccttttaaaatttctttttaggccgggtgcagtggcttatgcctgtaatcccagcactttgggagtctgcagcgggcagatcagctgaggtcaggagttcgagaccagcctggccaacatggtgaaaccccgtctctactaaaaatacaaaaattagccaggtgtggtggcaggtgcctgtagtctcagctacttgggaggctgaggcaggagaactgcttgaacttgctcaggaggtggaggttgcagtgagctgagatagtgccattgcactccagcctgggcaacaagagcaaaactctgtctcaaaaaataataataataaaaataaaaattttgggccaggtgtggcggctcacacctgtaatcccagcaatttgggaggctgagccgggtggatcacctgaggtcaggagtttgagaccagcctgaccaacatggagaaaccctgtctctacgaaaaatacaaaatttgccaggcatggtggcgcatgcctgtaatcccagctactctggaggctgaggcaggagaatcacttgaacctgggaggcagaggttgcagtgagccgagatggtgccattgcactccagcctgggcaacaagagtgaaactctgtctcaaaaaaaaaaaattcttttagttctgttttatggttttcagttcagaagtcttatacatattttgttaaattgatttctagatatgtttcttacctttattgtaaaatggagccatcatttgcatcattcattactctgtatgtaatgtgttatcattctctacctgctttcaagattttctctttatttttgttttttagcagtttgtctgtggtgtatctaggtgtcattttatttgtatttatcyggagatttattcttgagatttgcagagcttcttaaatctgtaaatttatgtctgtcggccaatttgggaaatttggagctattagttttaaaaatatttcttctgttccattctctttcacttcttctgtatgtgagttcaatttcacttcaattgtatgtgagttagacattttgatattagcccacaggatcctgaggttctttcattcttttcaatcttttttttttctcgaagtttgcatttcgtgagcaggagtgacagtcattcaggatgatttttgagattcctagttcaagagtagttcctattcttttctaggtgtagtcaagtatggcttctaattctactagaaggcttttttgtcggggaggtggttctatgtcctttggctcttacattttctttgtgtctttcacagcacagttttcagagggtaccctttctctttggttttgttttgttttgttttgttttagacggagtcttgctctgtctccaggctggagtgcagtggcgcaatcttggctcactgcaacctctgctcactgctacctctgcctcccgggttcaagcaattctcctgcctcagcttcctgagtagctgggactacaggcacgcgccaccacacccaactaatttttgtatttttagtagagactgggtttcatcatgttggcaaggctgttctccatctcttgacctcgtgatccgcccgccttggcctcccaaagtgctaggattacaggcgtgagccaccgcgcccggccaacagagggtaccctttcattctttttctccttcttcccagaaggcttgcgttttcaagactacctcatcaagttctgcatgtgtttaaaagtgtctctacccgaccttcccttcctccctcccgatttaacggaattctttgttggtgttttcatacttaccgtgagttttctttttcagggtgatattttagttccatcttaggctctccattgtcctcttctctcttctttttttttttgagacagagtctcattctgtcacccaggctggagtgcagtggtgtgatctctgctcactgcaacctctgcctcccaggttcaagtgattctcctgcctcagcctcccgaatagctgggattacaggcgcacacaaccacgcccacctaatttttgtattttcagtagagacggggtttcaccatcttggccaggctggtctcaaactcctgacctcgtgatccgcctgcctcagcttcccagagtgctgggattacaggcatgagccaccgcgcccggtgcgcccagccctcttctctcttctttgcatctctcttcctatctggatccctctttgctgtccttaaagagctgagatgagagattgagaaacatctctacaagaaattgatgtttttctacttatgggtaattagaagcttgtagtattttcagtcttctaagtatgttgaagatatgagacgttggtgattttctttgtttctccggttggttggtctgtgtagtttttggacatgtgtttggatatttggatttatatagctgccataatcttggctatgcaggtagtctttcctgacacttcatcctgaaagatttgaagcctttggacaaattttacagtgggctgggtgcagtggctcacgtctgtaatcccagtgctttgggaggctgggcaggaagattgcttgagcccaggagtttgagaccagcctggacaacatagtgagacccgtgtctctacaaaaaataaaaaatatgccgtgtgtggcgttatacaactgtagtcccagctacttaggaggctgaggtgggaagatcacgagccaaggagtttgagggtacggtgagccatgatcgcctcactgcactgggtggcacagcgagactgtctcaaaaaaaaaatttacaattaatgtctgcatatccttcacctaggttcataaatttgtacttttgctttatctacttgcctttttytctctctctacacacacacacacacacacacacacacacacaattagttgaatgaattgagagtaagttgcagaaaacatgacactttactccaatattgcatcatacaaaatcatacatctagtgataggccattgtcctacagaatcacgatataattatcacactaaccagctgtggtggtgcacacctgtagtctaagctactcgggaggctgaggcagaaggatcacctgagcccaggaggttgtggctgcagtctcatattcatcccatcatcagatttctcccattgtcctaataatattctttatagcttttctttatccctgatccgaaatttcattgaagatcacacagtgcatttagttgtcatgcctcttaagtctttatttatttattatttattttttgagatggagtcttgctctgttacccaaactggagtgcagtggcatgatcttggctcatgcaacctccacccgctgggttcaagtgattatcctgcttcagcctcccgtgttgctgggactacaggtgtgtgccaccatgcccagctactttttatatttttagtagagacgggaattgtaccatgttggccaggctggtcttgaactcctgagctcagatgatccacccgccttggcctcccaaagtgctgggattacaggcgtgggccaccacacccagccttaagcctcttttaacataaaagagttcaccagccattctattttgttttgctttttgagacactgatgctttggagagtccaggccagttgctttgtagwtttcaacttgtttgattgtttcctgatgattaggttggtagaaatactacctcaatgatgggaccttcttagtgcgtccatcaggaagcacatgatgtgactgtaattggtgacattaagtttgattccttaataattaaggtggtaactcccaggtttctacattgtaaaggcatcttttgccgccctcctttttattcccaagtagtttatttggagattagtcctttacacagtagaggagcggggaagggagacaggaaaggaaagtttgacaacaaagggtgagttttcaagcctgttgccacgggggaacctaattccactggagaagctcatggcttggtgatgttccacagaggggtcagaaatttagcgtatttcaacaccagctcctgtcaggcaccatttgagggctgctgccagggtggttcaattttctggtgcttacagcttgccataaacaggtgcaaagtagtctggataccaaagaaagctctcaggtaacaagatgcagatgttggcatttggaagtcagaatagggtgcactattgtggtaagagctgaagggatggctgggcgcggtggctcacacctgtagtcccagcactttgggaggatgaggcaggcggatcacctgaggtcagaagttcgagagcagcctggccaacatgacgaaaccccgtctctactaaaaatacaaaaattagccaggcgtggtggtggatgcctgtaatcccagctattcagtaggctgaggcaggagaattgcttgaatctgggaggtgtaggttgcagtgagctgagatcacaccactctgcactccagcctgggtgacagagcgagactccgtctcagaaaaaaaaaaaagctgaagggatgctgagtagagcatccgtagtgtctgctatacctgggtaccctagaacctggagaacctacagcttgaggcaagagcgtatgtgctattattttttcaagaagtgtgctctcaggaagcagaggtaggggaaaggtgagtgaagggagaaggaagattaagtcagttcaagggtgcattttgaagttggttgcccttggtgcaagtacagttggttgcttgttctcctaaagctgtctcccaggaggatgtatacataactgcattccagggcaatccatctaaaggaagggtggacggacccctcagcttctgtatctcactggaaaaaggtttgcttcatggcacattaattcccatagacttctaggttgtncatgtgtgggtaccaggtgggtcccacagacccttacacctccaaggcaagcngcaagccacgggtgggaagtgataggtacccagtatgagcaggaggtaagggaccgtggggttgtgcctgtgggcagttggttataacccagacgtgtttgatcagcccagtgacagctggagtggacaaagtgaccaagggcctcaaggacacacaaggccaagaagatttgaagtgctgtgtaagatatgcctaatgcatttggattctacctttgtttaacgaatatgcacacataaaaaacacttgaactccttgagcccaggagttcaagaccaacctgggcaacatagtgagacactcatctctaaaaaaatttaaaaaaaaattaacctggcatgatagcactcacctgtagtcctgtctactctggaggccgcagtgggaggatcacctgagccctggaggtcaaggttacagtatgctatgattgcaccactgcattccagcctgggtaacagagcaagacgctgtctcttaaatttttttttttttttttttttacttttataatggaaaaaccattgtagacagttttaggaaggaaagcagaatagtaagacatctttttcaaagtaaaagagcaaaaaaggcaaaaaatatttcacatttactttatggacaaagataagattgtccttcaataaaagactgaattttttttgtttgttttgttttgttttttgagaaagagtcttgctccattgcccaggctggaatgcagtggtgtggtctcggctcactgcaacctccgcctcccgggtacaagcaattctccagcctcagccccccgagtagctgggactacaggcacgcgccactgcatctggctaagttttgtatttttagtagagayggggtttcaccatgttgaccaggctcgtcttgaactcctgacctcaggttatccacctgcctgggcctcccaaagtgctgggattacaagtgtgagccaccgtgcccggccacaagttgctctttaaatgtgagaagtgttctggcatggtggctcacacctgaggcgggtggatcacttgaggtcaggagttcgagatcaggctggccaacatggtgaaaccccgtctctagttatttatttatttatttatttatttatttatttatttttttgagacggagtttcactcttgtttcccaggcgggagtgcaatggcgcaatctcggctcactgcaacctccgccttccgggttcaagcgattctcttgcctcagcctcctgagtagctgggattacaggcatgcaccaccacacccggctaattttgtatttttagtagagacggggtttttccatgttggtcaggctggtctcgaattcctgacctcaggtgatctgccctcctcagcctcccgaagtgctgggattacaggygtgagccaccacgcccggccctgtctctactaaaaatgcaaaatttagccgggcatggtggcgcacacctgtaatctcagctactcaggagactgaagcagcagattcgcttgaacccaggaggtgaaggttgcagtgagctgagaccacaccactgcagggcagcctaggcgacaagagcgaaacgcttacaaaaaaaaaaaaaaaaaaagattcacaggtgatggtgatgctgctggttaaggaagtgaagtggctttttgctctgtagccttcctgaatgttggggcctcctgctcttcatttgtttcatttctattaagtctcctccctccagctatcttgttagctcctggaaagcatttcagtgattgtggcttctatttctttttgaccccacagtgtccagggtcatgctgcctatatagtagtgagcagtaagttgaggtttttaaaaactttattattattatttttgagatggagtcttgttctgtcacccaggctggagtgcagtggcacaatctcagttcactgcaacctctgcctcccaagttcaagtgattctcctgcctcagcctcccgagtagctgggactacaggcgcctgccaccacatccggctaatttttttgtatttttagtacagatggggtttcactatgttggtcaggctgatctcgaactcctgacctcaggtgatccgcctgctttggcctcccaaagtgttagggttataggtgtgagccaccacacctggccggtttttttaaactttaaaacagattcacttgatttttcttccctaccccccagcttttttgaggtatgactgacaaaaattgtatatatttagggtgtacaatgtgatgatttgatatgtgaatgcactgtgaaatgattaccacagtcaaggtaattcacgtatccaccacctcccagttaccctcttagctagtacaggttgggtattgcttctctgaaatgctttgggaccagaagtgttttggacttcagattttggaatatttgaatatatataatcagatatcttgggaaggggacccaagtctaaacatgaaattcatttgttttcagagcctaaagatgattttttttttttttttgagatggagtctcactctgtcgcccaggctggagtgccgtggcacaatctcagctcactgcaacctctgcctcccaggttcaagcgattctcctacctcagcctcccgagtagctggaattacaggctcgcactaccacacccggctaatttttgtatttttataaagacatttcaccatgttggccaggctggtctcgaactcctgacctcaggtgatccgcccgcctcagcctcccaaagtgctgggattataggtgtcagtgactgcgtctggctgataattgaatttttctcttggagaagctgaataaactgtgtgttgtgtgcctgcctttttttttgtttttttttttttttgagacagagtcagacactctgtcacccaggctggagtgcgatggggtggtcatagctcactgcagcctcaaactcctgagctcaagcgatcctcccacatcrgcctcctaagtagcatagcaccacgcctggctaatttttaaattttttgtagtgatggggttttgttgtctaggctagtctcaaactcctgggctcaagcagtccttctgccttggcctcccaaggtggtaggattataggtttgagccaccatgcctggccattacctgtgttttgactataacacatcatgttggcactcaaaacgttttggattttggagcattttgaattttggatttttggattagcaatgttccacctatagtacattttttgtttgctttcccataaagaattttttgtaattttgattttatagttctaaatgtaatatattcttattgtaaaaatcacctttaatagcaccgccagaatagcaaacatgttaacagaaaggtagaagtagaccttaaagaatcttcagcagcttgagagaccacagctaaccactgaggaactctgttctggattggagcagtgcttagaagcttataaataactcttagggtattgcatagggattcttttttttttttttttcctgaaatggagtctcgctctgtcgcccaggctggagtgcagggtgtgatctcagatcactgcaacctccgcctcctgggttcaagcaattctttgcctcagcctcccgagtagctgggattacaggcgcctgccaccatgcccagctaatttttttggatttttagtagagagggggtttcaccatgttagccaggatggtctccatctcctgaccttgtgatccacccacctcggcctcccaaagtgctgggattacaggcatgagccactgtgcctggccgcataaggattctttatgtgatttttcagtagaggctcttgccttttactttaaacattctttgagggttgttttttttttccgctttttatttatatagaggtcaaccagaatcaagatgtctgggactgaggaagcaattcttggaggacgtgacagccatcctgctgctggcggcggctcagtgttatgctttggacaggtaactgtggttccttcatgccgggaaagaatgaggtgaagtgagtaaagttagggcaaggcagtttgtagagcatcgtagtacatgtgtgagcagtacctagtacgtttacctagtacgtgtgtgagcagtacctagtacgttgacgcggtgcgtgcgggggcagtacctagtacgtttacatagtacatgtgtgagctatttgttattggtttttcctttagatgcattttttgggagtcttgtgaactctggagggcattttggaatgttagctatcaaaagactgatagtactggggattagatttagattttaaattttttgtggggggggatagataacatatttgtatgacatcaaattcaaaatgaaactgtgaaaatctccctatttcctattgcccctgtgtgcatgccacccagttctatttcttttttttttcgagactgagtcttgctttgtcacccaggctgcagtgcagtggtgcgatctcagctcactgcaacttccaccctctggattcaagcaattctcctgcctcagcctcccaagtagctgggataacaggcatgcaccaccatggccagctaatttttatatttttagtagagatggggtttaaccatgttggccaggctggtctcgaactcctgacctcaggtgatccgcctgcctcggcctcccaaagtgtttggattacaggcgtgagccaccacgcccgggcttaatttttttgtatttttagtagagatgtggtttcaccatgttggccagggtagtcttgaactcctgacctcgtgatctgcctgcctcggcctcctaaatgctggaattacaggcatgagccaccgcgcctggctccagttgtctttcttggaggcatggaaagttactgggggtcctattccttgtagggacattgtgtgcacagaaaagagtttcttgctttgtccacccaaactccatctttgtctttagcagagagttgtgagtattcatctcatcngagcagggcaagggggacaaaacccaaatcagcaagcagtagtgtgtttctgtttgtgcaggatgggaaattgttgtattggagaaggcgtcaatctctggaaaggacaaatggaagcaaggcttcctacccccgtgctctttccgtacttgcttcctgtgctgacgtcatttacagatctggaggcagaacattttagcttcctaagcttcagaaacatttataaggatggtagcagcagctaaggcagcagttctcaaaatgcagttctcaaaaaccctggggtttctgaagatctttcagagtccagaaggtcaaaattatcttcataataatactatttgcctctttcacactcattgtctcatgagtgaatggtagagttttcagagagtgcatgatatgtggtgatgtcactgctatgatgcctaatggcatgcatgccttaaaagtttctcagttttgattcctaataggatacatagaacccacataaacaaaggttctggggggtctttttaagagtataaagtctccataaaggatggagactcaatgatgtgaggaatggtggaagtgtgaatttaattttcttttttggggttgcagtgccagtacacagcagaagagtaccaggccatccagaaggccctgaggcagaggctgggcccagaatacataagtagccgcatggctggcrgaggccagaaggtaggagaattcntgtgcctggaaagcaggcatccataccgcagactccgatggtcttgccagttccctctctgggtcctcagggattcggaagtctgctgttaactgttcctggaggtctcccagtgcccctgggaggggatgggttccagacttcattctcatcygaaggggcctgggcatggtcttgacactcgcataaccgccgtcttaagatttttacatcatctttttttttttttatttttaaagacagggtcttgctctgtcacctaggctggagtccgaccagtggtgtcatctcagctcactgcagcctccacctcccaggctcaagcgatcctcctgcctcagcttcctgactagctgggactacaggcacacgccaccacacctggttaattttttaatgttctgtagagacgacatctcgccatgttgcccaggctgatctcgaactgctgggctcaagtgatcctcccacctcggcctcccaaagtgctgggattacaggtgtgggccaccatgcccagcctttacaccattaaaaaaaaaatgttccttttgccatttgctttttttttttaattaaacactttttaaagaacttatgattgacacataataattgcatatcatttgcttctaattttaacttctgtgtatatttttggtcttccataaaatatgtcaaacagatttgtactttttgcaaactgaattttagcaactgctgggtgagttcctcctcccaacagaccattcgttctcgcgggctccatctagaagatttttgaaataaattcattgagaattttcttgaaaaaaaaattttktttaacagactggnyctcactctgtcacttaggctggagtgcagtggcacgatcctagcttactgcagccttgagctcctgggctcaagtgatcctcccacctcagcctcccgagaagaatgtttaaggacagtttatcgaaaaaagtagatgaggaataaattatgtcaattttgattcacatttaagtgtggtaaggaattaacacagcttttccttaaaaacatttgtttttctaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttgtggcccagcggtcagtgtcctcttcaacttgctctctttcccactcctagattttgttgacctcaacaatggcaagttctacgtgggagtctgtgcatttgtgagggtccagctgaaggtgaggggatggagtagacctgctgcccggaaggatcagtgggtggtaggagaaggtgagcaggtagggaagtaggtagctggacggggacccaggctccagagttgtgtctcagccagcgttccctagartggtggaattcaaatactcttgctcatgtgctccctaaaagaatggaaaaactgttctcttgcacatgttcaagctgacacctaaaasttttcaccatatataaaaattgttgcaaaggatgtattttttggcatatggtaaaatctgacattttaaaatacaataattttaccatcactgataagtgtttggaaactcaactttaggcaaagcaggtccttttgttataacattgatgaaaacaaaaatwkgttttgttaataagttgtttcacttcaagtcacagttatttaaggtgttaagtgagcacttaccgtaaatctgttgaatcttgttaaatattccagtggactctaaatactatagaggataagatctatcatttatttgaagaaatacaatgaacaagcttttttttaatcattagaaattttacattgttctttctttatctgaactcatatttctattctatttccccactggttttaatcctaatacatatttatggttgaaagtttggctaggcggggtggctcattcgtgtaaccccagcactttgggaggcccaggtggaaggactgcttgagcccagggatttgagaccagcctgggcaacatagcgaaagcccgtctctactaaaaatacaaaaaattagctgggcatggtggtgtatgcttgtagtcctagctactcaagaggctgaggtgggaggatcacctgagcccaggaagtcgaggctgtggtgagctgtgattgcgccactgaactcctgggtggaaaaaaagaaaagttttatcggtagccttactgtgcttctctgcctttgcctgtgtataaaaataaaaatttttggtaaattttcagtgcacttaaggctctaaatattaaaatatttcttttggatttagttatattatagctactgttaacacacaattgaccagacaattgtgtttatggtgaagagaaaacataaatacagcaaaattttgatacttagaaaaattaaagatatgaaatcttgccacaaaaataaaaaatttaaaatataaaatttatggaaaatgtatatcttaatgagatggatggtgctgttttttcttttcagttagtttatatatccatatatccataactgaatattacttacttcttttttttttttgagatggagttttgctcttgttgcccaggctggagggcaatggttcaatctcagctcaccgcaacctccacctcctgggttcaagcgattctcctgcctcagcctcccaagtagctgggattacaggcatgcgccaccccgcccgcctaattttttgtgtgtgttttcagtagagacgcggtttctccatgttggtcaggctggtctggaactcacaacctcaggtgatccacccgccttggcctccaaaagtgctgggattacaggcgtgagccaccgcacccggcctacttatttcttgaatgaacaattcagcattaattctattctgacttatttttctaaatagtactaaaaaatcttgtatctatgagtgagtagctgagaatggaaagaattgtgttatagtgtcactcatttatttgagtgctttctgagttattttttaaaaatcacagagcgctgtcatcaaacattgtatttaattctcaatcagcgaatgatgtgctcaggtccaccttctcttttggtgagaggcaggagctggacgccacctgatttacaaagggtttgctctcccgtccttacagaccattagatccagtgttcaaatcatccctttgtttcatatcccagaggtttttttttttccaagacgtagtctcactctatcacccaggctggagtgcagtggtgcaatctcggctcactgcaacctctgcctcccaggttcaagtgattctcctgcctcagtctcctgagtagctgggattacaggtgcccaccaccacacccggctaatttttgtatttttagtagagatagggtttcaccatgttgaccaggctggtcttgaactcctgacctcaagtgatccacctcccttgacctcccaaagggctgggattacagcgtgagccaccacgcccggcccggccatcccagaggttttttttaccttagggtgatgcacactgataggatttggggtgagtttctaatgtgccctttgtgtgttgggaagttgggaagggaggatcgtcttgacaccttgaccacaggcacatgtccaggcagcccaggtctaggaagcagcactcgcgatggattctcacccagccttctgcccgtgcccctgtagcaaggccgccaggtgggagagtccggctttgaaccctgctgcttgaggaacaggggagttgtggcacgcctgccgctctcgtgtttgagttcaaactccttttctgcccccaggatggttcatatcatgaagatgttggttatggtgttagtgagggcctcaagtccaaggctttatctttggagaaggcaaggaaggaggcrgtgacagacgggctgaagcgagccctcaggtgagcgcggggctgggagtctaacctgcgtcatttcagctcttgcttcagagcagatttcgattttttttggaagaggtaacacatccacatggttcaaaaatccaagcagcgtggaaggtaattctcacccctgccctggttcytgtctgccgttttcccactttcgttagtattttttcaatgtttctgtttcaggcttcccttgctgggagtaagtggtagaatcctgtactctctcttctccgtgcactcagtcatgtgtgccrgaggccttcccactcctactgcgagtgcacagacagcaccctcctctccgtgctcctcagcagtcctccgctacgcacaggtagcatagttaacttagttacacagtcacgcagatgtccgtgttagtccatttatgttgctatacaggaataccagaggctgggtaatttataaataaaggaggtttgattggcttatgattctgtggactgtactggaagcctggtgccagcatccacttctgctgaggcctcaggaagcttctaatcatggcagaaggtgaagagggaacgtggagagagaggragcaagagagagaaggaaggagtcccaggcttatttatttattttattgttgtttttcattttttgagacagggtcttgctctgttgcacaggctggggtgcagtggtgccgtcatcgctcagtgcagccttgaactcctgggctgaagtgatcttcccgcctcagcctcccgagtagctgggatcacaggcacatgacaccacccccagttaattaaaaaaaaatttttttttttttggagagacagggtctccctttgttgcctaggctggtctcaaactcctgggctcaagtcatcctcctgccttgtgcctcccaaagtgccgggatcacaggcatgagccatcatgcccagcccccacactcaaaaccaccagatctctcatgagctgagtgagaactcactcaacaccaaggggatggcactaagctgtttatgaggaatccagccccaggatccagtacctcccaccaggccgcaccccccggcattggaggtcacgtttcaacatgaaatttggaggggataaacatccaaaccatatccgtgtctttgagaattgaagtgaattgaaccagaaaaacctatgagttctgtgggggagtccgtagatcccaagttaagaactctggtcatgggaggttgtgcccttgagcccccggtccccaagtgtgtgttgcctactcctgctgggaaattggagcagcctttggggggaaaaaaaagaaaaactctctgcagtttgttctccatgtcaggaggtggctggtgggttttgtgaatggcgccntaatcttttcatactcatcttctctgtgagggcagggayttgtgtcttgtcctcactgcagtattctcagaaactaacacagtgcaggaacatgctagatgcttaccagacatcaatggggaatgcatgttagggtccacttcctctgctgctcctgagaagcaacctgtacaaaagttgtaattctattctctgatattcatgtgtaacaattcttaaccctgtttcacctttttttctcttgcccttaggagttttgggaatgcacttggaaactgtattctggacaaagactacctgagatcactaaataagcttccacgccaggtatatcagacatggatgagtggagtgaagataatgcggcaaactcttgtgtgtcatgggttgagtatttggaggatgcaaggagaaaaagtgaggactcagctctttagagggtcgggaatgttgatttcagatttcgaatgttagagacagcaggaactaatcccaacattttccttttttctaaagtacatcatgtgggccggggaccgtggctcacgcctggaatcccagcactttgggaggtggaggcaggtggatcacaaggtcaggagatcgagaccatcctggctaacacggtgaaaccccgtctctactaaaaatacaaaaaattagccgggcgaggtggtgggcgcctgtagtcccagctactcgggaggctgaggcaggagaatggcgtgaacccgggaggcagagcttgcagtgagccgagatggcaccactgcactccaacctgggcgacagagccagactccgtctccaaaaaaaaaaaaaaaaaaatcacaccatttgacaagaatgtgaggtctagagaatttgtgtacgtgtaggtagtgaactgtggttgggggtagtctgtgaagcctcaaagcaagcacacagccctctgcagcaccactgtccttcccagacactcccagcctcgctgttgagccttctttcttttccttagttctggtgtcattacatgtctgatgtcattacaatgtcatttacatgtccattatttctgtcaatacctataacgtgatctgagcctttgcctttggagaatggggtctgtggtggggcagccctggagtcacactgccttgccatgagtggcttctggagtgttcctcctgcctcatctgctctccgaggtccctgccatgtcgctccccagggcagcattcccatcctgtgcctgagggattcttgtcctcatggagccccacaaggtgtgtgtcactgggcatctgtaaaaactcctttaaaaaaatcatttttaaacattattggattcagtttgctaatattttgttagacttttttttttgagacggagtctcgctctgtcgcccaggctgaagtgcagtggtgtgatcttggctcactgcaacctctgcctcctgggttccagcgatgctcctgcctcagcctcctgagtagctgggattacaggtgtgtaccaccacgcctggctaatttttgtatttttttagtagagacggggtttcaccatcttggtcaggctggtctcgaattcctgacctcatgattcgcctgcctcggcctcccaaagtgctgagattacaggcgtgagcccccgcgcccggcctttgttaggcatttttgcatctatgtttatgagagatattagtcaagttttctttttctttttttttttttgagatagtctcactctgtcgcccaggctggagtgcagtagtgtgatctcagctcactgcaacctctgcctcccgggttcatgccattctcctgcctcagcctcccaagtcgctgggactacaggtgccagccaccaccatgcccagctaatttttttatttttagtagatggggtttcgtcctgttggccaggctggtcttgaactcctgacctcaagtaatccgcctgcctcggcctccgaaagttttgggatgacaggcgtgagccaccgcacccggccttttctttttttaaattgtagtaaaacacatcacattttaactatttttagtgtgtggtcgagtagtgttaagtgtattcccattgttgtgaaattgatctgcagaactaagaccctgcacccgtaaaacaagaactcyscatttccccctttcccagacccttgtaactacttccactttctttcctttttttttttttttaatttattttatgaaagatgaggtcttgctctgtcagccaggctggaatgcaggagtgccatcataattcactgcatccttgcactcctgggcccaagggatcctcctggatcctcctgcctcagcctctcargtggctgggactacaggtatgtgccagtgcacctagctaatttattttttaaacaaktattactattttttttgtagagacagaatttctcagggctggtcatgaactgctgggctcatgtgatcctcctgcctyggcctcccaaagcgctgggattgcagcgtgggccactgtacctggagccagctaattaactttttttgggggcttttttttttaagagrtgagttcttgctatgttgctgaggctggtcttgatctttttttcttttttaaaaaattaggttaggcgctgtggctcctgcctrtaatcctagcactttgggaggccgaggtggttagatcacttgagcctaggagtttgagaccaccctggccaacatggtgaaaccctgtctctactaaaaaatacaaaaatcagctgggcatggtggtcagcctgcctgtaatcccggtggtcagcctgcctgtaatcccagctcttctggaggctgaggcatgagaatcgcttgaacctgggaggtggaggctgcagtgagccaagattgcactactgcactccagcctgggagacagagtgagattctgtctcaaaataataataataaaatataaaaataaaatacttttttgtgtgtggtcatggagttttgctattgcccaggctagtctcaaactcctggctacaagcgatcctcccactcagcctccttaagtgctgagattataggtatatgtgtctactttctgtttctgtgaatttgtctactctggatacctcatataaatggaatcacataatttttgctttttgtgactggcttatttcacttagctagcattaatgcctttaagattcatccatgtagtagtgtgtatcagaattcccttctttttgtggctgaatattctgttgtatatatagaccacattttgtttatgcattcatttggtgatggggatttgggttgctttcaacctcttggctattgtgaataatgctgctatgaacgagggtgtgtaactctctttgagatcttgctttcaattcttttagacatattctgaaggggattgctgggtcatggtaatcctatttttaatttttcgaggagctgccacactgattttcatacagttgccccattttacyattccaccaacagggcacatgagttcagatttttctaaatcctaaccagcacttgttattttctgagtttttggttttttttttttttttttttttttaagccaacctaatgggcgtgatattttattggggttatgatttgcataccccctgatgattagtgatgttgaccatattttcttttttgagacagaatctcactctgttacccaggctggagtgcagtggcacaatcttggttcactgcaacctctgcctctgggttcaaacaattctcctgtctcagcctcccaagtagctgggactataggcgcctgccaccatgccgggctaatttttgtatttttagtagagatggggtttcaccatgttggtcaggctggtctcgaactcctgacctcaggtgatccgcccgccttggcctcccaaagtgatgggattacaggtgtgagcccccgcacccagccaaccatattttcatatgcttgttggccatctgtttatcgtctttggagagatgtctattcaagtcctttgtcattttattttgttttattattttaatttaatttcttttattcatctcatctcatctcatctcatgacaagatctcgccctgtcacccaggctggaatgcagtggtctgatcatggcttggctccctggagcctcgacatcctgggcttgagtgatcctcccacgcaggctggagggcagtcgtgtgatctcggctcactgcagcctctatatcccagactcaaatgatcctcctgccttagcctcccaagtagctgggactacaggcatttgccaccatgccaggctaatttttttattttttgtacagaatacaaaaaattttaccgtgttgcccaggctggtctcaaactcctggcctcaagtgatccacctgccttggcctcccaaaatgctgggataacaggcgtgagaaacccatatggcccaactcctacttttattgagctttttcgtattgtttttgtattctctctttcacttatgtttgctgtcatctttttagaatttcctttcttctagctttgggtgtaactttttttttctagttctttgaggtatagcgtagatttgagatcttttttttttaactatgtgtgtaacttccctcttacgacttctttccctgcaccccagaagtttggtaggttgtgttgtagtatcatttgtctctgggaattcttctaagttggcttgttacatttcctttgactttaagagtgtggtgtttaatttctactgatttgtggattttccagttttctttttgctgttgatttctagtttcattccattgtgattgaaaagatactttatatgatttcaatcttgaatttgttaggacttgttttgtggcctaacatgtagtctgtcttggagaatgttccatgtgtacttgagaagaatgtattttctgctattggtgggtggaatgttatgtatatgactgttaggtccagttggcctatagtattgttcaaatactctrtcgccttattcatcttttgtttggttgttttatctattattgaaagttgagtagtgaagtctcctactattattgtgttgcttttatttcaccttacaatcctctcaaagtttgcttcatatatttaggacctctggtgtttggtgcataaatatttataattgttatatcttcttggtgaattgacattcttttttttttttttgagacggagtctcactctgtcgcccaggctggagtgcagtggcggtgcgatctcagctcactgcaggctctgcctcctgggttcacaccattctcctgcctcagcctcctgagtagctgggactacaggcgcccrccacctacgcccggctaattttttgtatttttagtagagacggggtttcaccatgttagccaggatggtctcgatatcctgacctcgtgatctgcccacctcggcctcccaaaatgctgggattataggtgtgagccactgcacctggctgacattcttatcattatataatactctcgtctcctataacaattttttttttttttttgagacggagtcttgctctgcygcccaggctagagtgcagtggtgcgatcttggctcactgcatcctttgcctcctgggttcaagcagttctcctgcctcagcctcctgagtagctggaactacaggtgcgtgctaccatgcccggctaattttttttttttttgagacagagtttttgctcttgttgcccaggctggggtgcaattgtgtgatctcggctcactgccatctctgcctcccaggttcaggcaattcttctacctcagcctcccaactagctaggactacaggtgtgtgccaccacacccagctaattttttgtattttgtagagagggggtttcaccatgttggtcaggctgatcttggactcttaacctcagatgatccgcccacctcggcctcccaaggtgttgggattacaggcgtgagccaccacgctgagcccagatttttttttttttttttagacagagtcttgctctgtcgcccaggctggagtgcagtggcgctatcttggctcactgcaacctccgcctcccgggttcaagcgattctcgtgcctcagcctcctgagtagctgggactacaggcgcccaccaccacacccaactaatgtttcgtattttttagtagagcggggttttgctgtgttggccaggctggtctcaaactcctgggctcaagtgatcaatccacctgccttggcctcccaaagttctgggattacaggtgtgagccactgagcctggccccaaatttctctttttttgttgttgagacggaatttcactcttgtcaccgaggctggagtgcaatgttgtgatcactgcaacctctgcctcgtgggttcaagcaattctccagcctcagcctcccaagtaactgggattacaggcgcccgccaccatgcccggctaatttttatacttttagtagaaatggggtttcgccatgttggccagggtgatctcaaactcctgacctcaagtgatccacctgcctcagcctcccaamgtgttgggattacaggcatgagccaccatttcctaagtgagcacagctgttyacctcccagatagagaatcagacctttaccagcagcccagaagccccattttgccctcttccagtcactgccttgctttccttttttcaaaagtaactactatcctgtcttctattctgacttccatggattattttttcctgtttttgaactttatatatgtaaagttcacaaatggaattgtactgtaagtggaattgtacagttcatattttaagaaaattgaccgaagtatgaaaaagaacatatagacaggttagacgagtgcacgtatcatccatgctcagcttgatgaattttccaaccaaacacatccacacagccaacatctgaatcaagacactgccagtaccgagaaggcccagctgtgttccttgcagtcactgccatcccctgccctccttcccactctgagcaaaccgcttttaacaacacagattggccgggtgtggtggctcactcctgtaatcccaccacttgagaggccaaggaagaaggattgcttgagcccaagagttggagaccagccaggacaacatagtgggaccctgtctgtacgaaataaaaataaaaataaaaataaaaattagctgggcctggtggtggcgcctgtagtcccagctgcttgggaggctgggctgggagaatcatttgagcctaggaggcccaggctgcagtgagctgtgattacgccactgcactccagcctgggccacagagcgagaccctctctcaaaaaacaaaacaaaaaacaaagaaagccaccaatttgtttttattgttatgtacttttttggaatcctacagtttgaactctttgtatcttacttgaattcagcatggttgtgagattcattcatggtacgagcagcagtttcattgctgtataattttcttttgcatgagtatgtggcaatttatttttctagtcttttcttagtagacattttggwttttgtagcttgtggctgtttcgattagagatgctgttagcattcttttgctgtacagttgcactcatttttgttgggaattattgggggagaagataggtacgtgtttagttttagtaggttcttcccgttttcctgtatggttgtattaattcacaccccacgtggcattgcgtaagttccaattgttctgtatctttgacagcacttggtatcgccagtctttcatatttttcaaagctcgtttcttttttttgagacacagtcttgctctgtcgcccaggctggagtgcggtggtgcgatctccgcccactgcaacctctgcctcccaggtttaagtgattctcctgcctcagcctcccgagtagctgggattgttggtgtgtgccaccatgcccagctaattttttttttttttttttgtatttttagtagagacaggctgttactcaggagttccttcgattttttttttttgtatttttgtatttttgccattttggccaggctggtcttgaacccctggactcaagtgatctgcttcggcttgccaaagtgctgggattacaggcatgagccaacgtgcctggccaaagctcatttctttttaaactactcatttatctttcaatgtagacatgaaatctgcactataattttcattttcaggtcaaaatgtaatcatcttaatccctcatattcaaacaattattccatcagcatcagttttatgaattgagagatgttttcccaagtaaaaatgttctggatttctgtaggaatccgtgtggaaatgaaaccatttgccctgtgccacgcagcacaggactgtcccttctcatgttgatgagatgcagagcagccccgttctggaagattccttgcagccttggctggcagccggcgtccgtgcctcccaagggttcttccctctgtcgtttgaagggttcttcgtgatgccacagcgtgcccgaggctccctcagtgacgagcgcgatttgcaggggtggccctggcagaaagggttgggaaggtacagacctccacagagactgtgtgtgctcatttccgtggaaaaaggacaaggaggcagcaaagacagacccagcagcccaggaaagattcaaatgcgattttacagaacatctgccctaagtcaaaaccaaagaaggattcctttttatcaaaacttcactaacacagaacatgaaattgtttggctcctcctgctcatggagttacaggacctagaaggcgtgatggatggaggatgtcaaatgcgattttccaggaatcgcaatctgtgagtcagggagaagcagcggagggcaagagccagttgaaggaatttgtttttcttctttccttctagttgcctcttgaagtggatttaactaaagcgaagagacaagatcttgaaccgtctgtggaggaggcaagatacaacagctgccgaccgaacatggccctgggacacccacagctgcagsaggtgacctccccttccagacccagccatgctgtgataccggcggaccaggactgcagctcccggtatgcggcctaagtcccctcctttcctctgcggcccctcctgtgtcacggggctgcctccactcaggcctccagagccagccagccgtgcgtgtcctcccagcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgagggtgagcgaggggtgggagcagggccctgggaggcgtctgcaggaggaagtgtagccgcagggtcttctgattctctgcggtaaccctgggccggctccaaaccaggcctcgctgggacttctctcaagctacacgcaggagagatgagcccaggaaattcagatatttaaatctgctatacattttcccgtttctaaagacaatgatttcttttttcccccgtggaactaagtgggccttgataaaatcttctagaattagaaatttcagggtaaagaacttttttttgcttcgaatgctttggccatctctacattagaaagccttggccgggcacrgtggctcatgtccgtaatcccagcactttgggaggccaaggtgggcggatcacgtgaggtcaggagtttgagaccagcctggccatcatggcgaaaccccgtctctattaaaaatacataaaaattagccaggtgtggtggtgcatgcctgtggtcccccctactcgggaggctgaggcagaattgcttgaatccagaaggcagaggttgcagtgaaccaagatcgtgccactgcactccagcctgggcaacagagtgagaccctgtctcaaaacaaaaacaaaacaaaaaaaaaacaagccttgkgtttctgagatatcttcgaatacaaggcaaaattgggattgagaataacgggaacttttggcagattatttatcaactttagtttatttcagagtccagattgagtgggaatagtgatacagatgccttctttctttcttctctgtctccccacctgttctctcctgcccatccagcggtaggtagtccttactcagagagtggaaacagagaaagggcttgtctcagacccatcgagcttttgcccagtttttccctacaaattgtgaagmagattcacagaggacttgcttcatggttggttcattcatatgcccctcagcaccgacaggctgaaattaacataaaaaccaaaacagaaccacttcctgtcctgtggatatccttactgttgagttattgcaggtgtttagcttcttaaccattgcagaagctcccgggtagattgtggaggaagctgccctccaggcctttcctgccccttggcagacaacccgagccattgttattttaatccatttcacacatcagattttggctgaagattttgtttgttggtttgttttcagacagggtcttgctctgtcacccagcctggagtgcagtggcgggatcagggttcactgcagctttgaccttcctgagctcaagtgatcctccttcctcagcctcctgagtggctgggactacaagtgcatgctaccacacccgctgatattttattttttgtagaggtggcgtctcgaattcctggtttcaagcgatcctcccaccttggcctcccaaagtgctggggttacaggtgtgagccactgtgcctggtcagattttagtttaagattttgtttgagcaagggttatggctgtaacaagcgagccagacactggattagatggcctgtgagaaaccttttacttttgctgtgaaaggagaaagaaacttgtttttcccactggtgagaagaattcaaaccacagacagatctgtaggtaggactgggactcgggaagctgaagttctttttactggcagaagcagcgcagccctaagcggtgttgtgcttcggagagtgttccctctaacaagaggggagtggacccacgctctgaaatcccatgcagtgatgtgatgatgacttgtcctttctctcctctgtgaaccgtagcagcgcctccggcccctcctgtgacgcacagcactcctgtaactgtctcagaaccactcctggagaaagacttccttgcaggagtgactcaagaattaatcagtaaataccttgaaatgcttgtaagctactgtgctgtatgtttctagtagccacagaataccttttaggcgacataaaaatcctcattttcgtgtggttttgttgagggggttctggctgatagcatatgtccakttcctctttggtcctaaccaaagggaagtgtacttttagggggaggggagagaaattccaaaaactttcagaaggtactgaagacatggaatttctgagggccagtttttccagtgctttctgtgagaatacttcattatttgctgatgacgcacttttccttgacctctgtagagactcttgaagacaactctgaaaagtgggctgtgactcccgatgcaggggatggtgtggtcaagccctmgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggtagcagagaggtgtttaggcacaaaaattaaggggagatcctagctttaattctgggaatttttgaggaaggatgacatttcatttaaagtttgatagaatcgggaacttctattagggaatggtactgcaagtagaacagaattgatttaagagccagaacgtttcctttgggctcctgacttcaggtgcagcccttttcagctcctgataatagcaggaagcggaaacgactgcatggagagctgtccctcccagcagcaggtctgtcatgagcacgaggccacttggtctaggagaatcatctgccttcctcctaacagtaattctcattcttgggcttagtctaaattaggatcattaatataatccagaaatcantagctgtcagtttattttaaaattatggcagctacatttaagccattttgtcttccataggaaactgggaatctcataggaagagccaggacatgaagaaaaggaaatakgatccatcttaactgaggctcaggccacataattggactctgtcacaaagggactttggaaaactactttttggtcatgaaattgttcatcgctgctggagaatgaacgtcattgyratttatcttgcttcattctgaaccttatcaagaggatctgactgagagcccactgcagttagagctgagcacttttgaaaagcttgtccatcactctagyagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgttttttttttttttttttttttgagacggggtctggctgtgttgccctgactggagttcagtggtgcaaacacagctctctccacaacctcttgggcycaagtgatactcccacctctgccttacaaaatacagggattactggtgtgagccactgtgtctggccagaaaaggcatttttgagaaagcaaatcgtataccttattaacaaaatagaatatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccacctcggcctcccaaagtaaaaagtactagaattataggcatgagccattgcgcccagccaatttaataatttttttagacgtattattttgggctgggctgtggctaatcttgaagcagtgacttcctattttttggctcagacccatttgggaagctgtgaacctgagataaggaagtctgaaagtactagccggcagccgaccgtttctattcctttcgaagttaaggagacagcaaaggagctcccaggaattagggatccagttataaattgcacttaactcaaaatagtgccaatgagaatgtgaaggaatcttctggaaatgaaaccccacagctcaacaaaagcaagtttggtttatttgaatggtttcattaaataagtctacaaaggtaacaaactgaagcacaaagcgcaatcttacaagaagcgcaacacccagagttagtgcaaaatgtacaattaacggctgctgagaaacccccaaagtttgaatttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccctttctcagctactcagccccttgttggttctatccttactctctccacaagaaatacaagcagagaataaataaatcattttaaagcaggggtggaagcccttgcccttttcctttctaccttttaaaaaccttcagctctcatttgcatatttagggccgtagaccaacttacttacttattaagggaagcagggcccttaaggaatgaacagggtacaggagcctccagcctctttctgtggtagtggtggtggtggtggtgattcccagaatatgccattgacgtgggtaaaaggttggaaatattttcagtttcccaactaagagtcaagaagcaccccaaaattaagagtcctagcttctttctttgtcttcagagataacaaagatcctaaacatagccagttaggacagtatttccggaaagctctgaaaataattaataactacccattacaaggaggcatagcactgaataacactgattggttgcagttattacttacggggagtattatttatttgaaaatgtgaacatattagttgtacttctagaaataaaggtggcacaatagattatgatcctgcaaccatttggacatcataaaggaaatgagtaggaataagtattctttcctagaatgattaattcagatgtggaaagatagatagattaactttccacaaaatgtagtaccccaagctgagaaatgcatggtacatgtgcaacaagaggaaagcaatccaaacagtttttctgagagcaattttctccatctgtgacttttcactatcaggttccccaacttgaaaactagccccccacccccttctctttatgttcagtttcttctaggtcacgtctgttcaagcctagctcaaataagaaaggtttatatgacagtcactggccaggcatcacgtttgtttcctcattctttagtctttgtctttcacccagcacacaccattcttttaagttgtccaattttgttacaacaccccctcctcactattcccgaaacagaactttctgtttttaaccactgatgccaacctaacttcccaccctactcatcttacacctgctctagacaaagttgttgaatgacttaaaaaaatactttttcaatttccctttggcataaccactgctggactgctggggtcacatggacctacgatttccttccacatgccctttattgatctggggtctggtaagttgatgctaatggcagaagcaatagaagtccaaggcactaaaatgtccagcaagcaacactgggaaacagaagtattcaagtacagtaatttatacaattttacattcacatttatttatctaatacaatggaaatacaaaggaaaaagttaaagtgtctcaataagtaaaggacagagctagctttttttggaactttttaaacgtttcatattttactcttaaaactactgttgtccaacaacattttatatatcacagtgtttccacatcaaaactgatggcaaagttacatgtccgcagggaacttaattttttttttttcctaattgctaatgctgcagtcaaagctgctaatatcttttgcttaaagcactaatgacctatcataagaaagagttgcaccccagtaccctggtatttttcactgggttctaaagagcaaagaaaaaataaaaaagagaggggtaaaaaaaagggaggagggcagggtaggagagagcccagtaggtggtttttgtcctgtggttcggattcttgagggagtgagggattcagggcatgtaccaaaagcaagagctccacccactcgaaattacagatgggtttgattttacattgagttctccagcttccttatgaacaagactttcctagccctcatcctcattactgagtatagataaacaggaaagcatggtctgaagctgccccttgacaaaaaagctgttctttccttcctctcccattccaataactggagcgggggagactctccattctgagggctcaatgcagtattaaaaacattcccctctggcaagaaataaccagttaaatgcagcactagtagttagtatataggctacttcccacccccacccaccccctcagcattccatctcctgcccccagatctattcagttaatgtctctaggtctaagtggtccgcaggttggagcctggggggttgctgatggatttctgcaaattgctgatgttgaaattctgcaaggaggcagttcccacaggttggaactggccaagtggctgtggtgctgggccacccgtcccactccattgagcgccaaatggggtagctggaaagccatactgctgtggggggcacatagacttggtgaagtgacctagagaggtagctgatgctgcagagatgggggcagagccacccaggttcgaggtcatggagatgcacagttgcccaggtgcagagaacttccttgccattccagggccctgaaaacaaaaccaccacgtgtcaagtctggtgtgggccatggtataaaatgtgtggcgctaacatatacttctagtataatcctgtaagatacagcagaacagtcttctgtagtatttattggctctttatatttaccaagtaagggtgaaaataatcctcatgagagggagggatgtcatgtgcgtgtgtgtctgtgtgtgtgtagttgaggatgacgaaggaaaaacgaagaagaaaaagttgagctgaccaacaagaggttaggaattcagggaaggaaaaataaaagggtacctgggggatttttgccttgtttttctaaagtattaaaattgaagaaggtcgtggcgtaagacgttaagcagcagcttagttgtttctatcaccttgactcagatgtgtgttacggattctctgcggcaaaagagagacttacctcataattcatgtgccctttgcttcctctcctgcctgagagattcatggcatctcgggcccaattgtctaccaacttgtgcaagtcatctgtgaatgtgcccttcctgctggacgtcatggcaggaggctgagcttgggcggcttggctgttcactgttgccccaacagtgtttgtgctgctggttcctattataagcaacagaatacgagcattaaaagaagcctaggttacaatttcaggaagagggaaaacttcacgggatgatgaatggcaagccacagaatgagaagaggatgaactgggaagccatgcaagaagggaagattccaaggttttgtttagccatttgttttggtataatagggtgatgaaaacagtttctcttcagtagctgctgctaaggctgaacaactcaggatgacggtaggtacacaggcaggggcctctttcagtccattcacaaagcacctaagagtattggaactgctcgccagtacgctattcccagcatcacgttgctgatggaggtgtgatacaatcagcaaggctagttgctctggaattttgcagaatgcagggaaaaagaggttttcttgtgcattgggcacggttaaagtaggagtaggaaaagatgcttggctaaggataaggagaaggtgggtttccaaaccattggacactgccacattctttagcctttttttttttttttgagatggagtctcactctattactcaggctggagtgcagtggtacgatcctacctaactgcaacccctgcctcctgggttcaagcgattctcctgtctcagcctccagagtagctgggattgtaggtgtgcaccaccatgcccagttaatttttgtattttagtagagacagggttttgccgtgttggccaggctggtctcaagaactcctgacctcaggtgatccgcccgccttggcctcccaaagtgctgggattacagacgtgagccaccacgcccggcttttttttttttttttttttttttttaaaggaagggtctcttctttttctgtcacccaggctggatacagcggcacaatcacgtctcactgcagcctccaactcctcctgcctcagcctcccaagtagcttgggactagacgtatgcacttccacacccagttaattttttacttttttatatagacagaatctccatatgttgcttagtcatgaactgctgggctcaggcaatcctgccatgtcagcctcccaaagtgctgggattacaggtgtgagccaccatgctcagcctagccattctttaaatagagagaggtaataagagaagtagcatgctgtgttcagaaaagtttttcacctggacccataaacatgaatttgcaaacataaacttgggaggggttaacctctcccaatttcccatgagtaaagaacaagattattcatgaggaaaggactgtatggtgtgcctgaatctttcaacttcaggaagacatggttttcctgaagatgacctcagtttcaattggctcaaggattcccaccgcttctccccactcttcccagaacagcaagcactcccatgtagaagcgacaagaaaatgcagctgaggcagggtgcaaaggggaggaggaagctttgcggttatgatgaaggaactctatttctgcggtttgatgagagaggagggagtctatgcctgcctgatttcggctctgctggagggcacactgaagattattccaagaggcacgttttggggaagagggaaagaagagtcatggtcttgtctgttttccttaccccccactgtcttaccagatctcacgtgttacagaataaataaaagctcctaaagtaagttgtgaaccactagtccttaaggtacccaagtaatgcgggggtaagtaagtgcatgcgttatcctgctttcaaggtcaaagcagcaccagatcacagcagcacacctaacgcaatcctgccacttcaaagcctgttactgaccatcgctggtctcaagtcaagcttatatcctaccacctggggaatggcacacacaagcaggtctgtgctgcagtaacagctaattctgaggtgaagctgcagtgaggaaggtcacatgcttcttaccgctatggcaagacacggaactactgcagtgtgagtgtcagctcatttcttggtgtctgctggagccacaaggggattgctattgcacatacagtgtgaagggaagagtaagctccctacagtacaggaaacgcgaggggagaagcatgagagcacagaaaacagcctt

SEQ ID NO: 10875 - DNA, 48594 bp, Homo sapiens
  misc_feature (1)...(48594): n = A,T,C or G, or insertion/deletion polymorphism (see Tables 1-2)
atatttaaaatgataggttattatgaattgaggagtatatgaaagttaaaagtgagtgtattagccaggttctccagagagcagaactaataggaggggggggggggcagatttattatgaggaactggctcatgcaattaggagactgggaaatcctatgagctggcatctgcaagctggaaacccaggaaagctggtaggtagttcagtctcaacctgaagggctgaaaaccaggggagacaacggtgtaaatcttatctgaaggcatacgatgagacaagatgtcccagttcaggcagtaaggcagggaaaagagggcaaactcctctttcctctgtcttttgttccattcaggcccttaactgactggatggtgcccacccacactgggcaggccaatctattatacagattctgtctattcaaatgctaatctcctccagaaacccctcaaagacacaagcagaaataatatttaatctgggcagcccatgacccactcaagttggcacataaaattaactctgtgtgtgtgtgtgtgtgtgtgtgtgtgtgtgtgtgtgtgtgtgtatggaattctggtgttcagcttttggaaaaactaagaatcatataaaaataactaaaaattgccattatttgaacttattttgttagacatcatagttgaacttattttgttagatatcaagatcaaactttgcttatttaagtaattaggaagaaagtcatactgctaaaaactggttagcagctagcatacatttgttgttgttgttgttaataagaagtagaacgggctgggcacaatggctcatgcctataatcccagcactttgggaggctgaggcaagagtatagcttgagcccaggagtttgagaccagtctgggcaacatggtgaaaccccatctctgcaaaaaatacaaaaattagctgagtatggtggtgcacacctgtagtcccagctacttgtgaggctgaggtgggaggatcacctgagcccaggaggttaaggctgcagtgagctgtgattgtgccactgcactccagcctgggtgacagagtgagatgctgtctcaaaaaattaaataaataaataaaaaagaagtaaaatataccaaatattttataagatgagggttgactgcattgaaagaaaatatttcataatatgagaaatatcttattgaatattgcacaccacccacaacaaatcatgtaactttttaatctgctggttttatttagtgtaagttgaagtgtcagtgattctggaaaatattacagttatatttaaaataataagcatcactaacctgcactgctacagctgtttgaaggatgtttccttcccagctaaaaacatgtctcaggaaaaagaacccttatgttttagaaaatcattctgaaatatctacaaatgaaaagatacaatgttttgcttcaaaatcataaggtaatggtaagaaaccgtatactttacctctgtgatcatccttccctaacccataatcactgtctaatcatgagaaaaacgttagacaaatcccaactgagagacattggcattaaaactatggaaagtctgagaagctgttacaaaccagaagagtctaagaagacatgaccactaagtgtaatgtggcatcaggatgagatctgggaagagaaaaagaacagtagggaaaaactggtgaaatctgaataaattgtgcaatattagttaatactaacatactaaagttggttcctgagttgtaataaatgtattataagagtgtaagatattcacagtaaaggaaaataggcaaggtgtatttgaaaattctgtactatcttttgcaacttttggtaaatccaaagctattctaaaataattttttaaaaagaatcatggatggctgggcatggtgtctcacacctgtaatcccagtactttgggaggattgcccaaacccaggagttcaagactgacctgggtgacatgaggaaatcttgtctcttcaaaaaatataaaaattagccaggcatggtggtgcacatcgtgggaggctgacgtgggaggatcacttgagcccaggaggtcatggctgcagtgagccatgattgtgtcactgcactccagcctgggtgacacagcaagaccctgtctcaaaaaaaaaaaaaaaaaaggccccagtgtggtggctcacacctgtgatcccagcactttgggaggccaaggcaagaggatcgcttgagcccaggagttcgaggccagcctgggcaacacagccaaacctcgtctctacaaaaaatacaaaaattagccaggcgtggtggcatgtacctacttggaaggctgaggcaggaggatcgcttgatcccaagaagtcgaggctgcaatgagccgtgattgtgtcactgcactcccgcctgagtgacacagcaagaccctgtctttaaaaaaaaaaaaaaaaaaattttagacttccaggtattcagcataaatcacattgtacagtttaggtacaatgagccatcattatcaagggatagtgttatatcgatgtagagaattatttaccagtcaagttcccaatgccagccaaaggccaatcttgtgaacaggactttctaaggatagcaagcaggcctgggcaccagtgcacacacatagcatacaactttctggggtgtgacagagatatttcataattcataccctcctcctgttgtggaagttatccctacaaacctcacttacagacatcatctactattctgattcagagatacatgtctgaaggaggaagggaacacctgtgagatatggagagctgagaagaggaagccttgagtttctcaatgagcatagctgaaaatcagcccggagctctgcactatcatttttgtttttttccttctgtacatgggactttagttctgagaaatctatcctgaggatagaagaggaagagaagggagaagaagaaaaatgagaaagaaaagagtgaggccttttgagaggatggaatagaatcaggttagctcaatcgggttgtgaatatccaggaagcactgttgagttcaagcttcctaaaatatgtacaagtggtgatgtccggtaggcaggcagactctagagctggtaaagggctgtaggacacagagcctcaagtgttcattttcttttcttttctactttttttgagacagagtcttgctctgtcgccaaggttggagtgcagtggtgcgatctcggctcactgcaacctctgcctcctgggttcaagcaattctctgcctcagcctcctgagtagctgggactacaggcaccgaccaccacgcccggctaatttctgtatttttagtagagatggggtttcaccatattggccaggctggtctggagctcctgacctcaagtgatccacccaccttggcctcccaaagttctaggattacaggcatgagccaccgcgcccggctgagtgttcattttcgggttttttttttttttttttttttttttttgagaaggagtctcactctgtcgcccaggctggagtgcagtggcacgatctcggctcactacaagctccgcctcccaagttcaggccattctcctgcctcagctttccgagtagctgggactacaggcgccccccaccatgcctggctaatttttttgtatttttagtagagatggggtttcgccgtgttaaccaggatggtcttgatctcctgacctcgtgatccgctcatctcggcctcccaaggtgctgggattacaggcgtgagccaccgtgcccggccgagtgttcattttcaaatgaggtaatacatacgattacagatacactgcaacacgccagcattgagcttttttgttaaactctgtaaatatcttgtgaatagtgtatttgtacgtatgttaaaataattacttgagcttctgtccactctgtttggcattttaaaatcttttcaggccgggcgcggtagctcacgcctgtaatcctagcactttgggaggccgaggtgggcgaattgcctgagctcaggagtttgagaccagcctgggcaacatggtgaaaccccgtctatactaacatacaaaaacaaaaaaacaaaaacaaaaaaaatcagccgggcgtggcggtgtgcgcctgtagtcccagctactcaggaggctgaggcagaagaattgcttgaacctgggaggcagaggctgcagtgatccgagatcctgccactgcactccagcctaatgacagagcgagactctgtctccaaaaaaaaaagaaagaaagaaagaaagaaaagaaagaaaaaaaagaaaaagaaaaaatttttcaataagttggatttggtggtggcaggaaatcccagctactcgggaggcggatgcaggcagattgctggagaccaggtgttcaaggtcagcctgcacaacatagtaagacctcgtctcaaaaaaagaaaagaaagaaaaaatatttttaatatgcaacaagcctcaaaaaatggaagtggtccccgtttctcttaatgtcttggaggccaaaaaaaggtactggttggtgaaatacacatatagatatcatcagtacccagatgttaattaacgccaagggagtgtaaagggtcgcccaagagagcgactttacgggaaaagaaggctctggaaccagaacatttaaaagactcactgaaggagaggcgcctacaaaggatgctaatcaggaatggccaaagagatggcagaaaaaccaagtgaaatggttagggaaagatgggggaaaaaaacataaggataactcaagccaatagtgcattttaagaagggtattaaggccgggcgctgtggctcacggccgtaatcccagcgctttgggaggtcgaggcagacggatcacctgaggtcaggagtttgagagcagcctggccaacatggcgaaaaccctgtctctactaaaaatacaaaaattggctgggcatggtagcgggcgcctacaatcccagctattcaggaggctgaggcaggagaatcccctggacccgggagctggaggttgcagtgacccgagatcgcgccactgctctcgagcctgagcgactgggtgagacttcatctgaaaaaaaaaagaaaagaaaaagaaaaaaagattaatcaaagtgtcaaatatttctttctttttctttttctttcttttttttttttttttttttgagacggagtcacactgtgttgcccaggctggagtgcagtgacacgatctcggcccactgcaacctcctcctcccaggttcaagcgattctcctgcctcggccacccgagtagctgggattacaggcgtgcaccaccacgcccgactaatttttgtatttttaggggagatggggtttctgcatgttggccagggtggtctcgaactcctgacctcaggtgatccacacgcctcggcctcccaaagtgctaggattacaggttgtgagccaccgcgcccggccaatgtcaaatatttcgctgattttcctcggtcagcaccaccacaataattgtgccaccttacccatgcaaggtttagacatctctttgactcttttacagggttttatactgtggtttccattatttcctctaactagacagcagaagcggcttactcatttttctcttccatagagtcttactccgatcgttcaattaatatcagtggaatgatttaaagaacatttgaaaaaccactcggacaaaaccctcagattcgaacttgttccagcagccaaaaatacccgcgggccacggctacactgcgcaggcgcaaaggcagatgggctttctccagaagggctttgcatttggcgcgaaatccctttccgtgggctggggctcttggagaggcgccgttcattggtcaggtttggcgcgaaatctccagctcctgtgtcacgattggttccggccgtgcaggtcggaagagggggcggggcggaagcggcggcggcgcgcgcaaagctgcagcgtctggaaaaaagcgacttgtggcggtcgagcgtggcgyaggcgaatcctcggcactaagcaaatatggacctcgcggcggcagcggagccgggcgccggcagccagcacctggaggtccgcgacgaggtggccgagaagtgccagaaactgttcctggacttcttggwggagtaagtcggcgagcgccccgggcctcgcccgcctccggagcctgcggcgtctgggccrggcggtgccgtgtgggcggcgggtgttccggaacctgggggtcgcgcgtccgggaagcgcctccccgcccgccccccaactttaggctccgagcccggcggccgcgaggagcctgggacaggctgggtttttctggagtaaaacccatctcgagccctaagacgctcgtgcccagtgctcagcgctttgcttctgtcacttgatgctcaccaccccgcgagcctggtatttgcacagccctcggtgaccggcgcggaaacctgggctcgctgagtatagtaactgggccgctgggtgcggccaggtcgagtgggaggccgaagtgccattgaatctcgtcggtgccctgctgggccacgcagccgggagcatggtgctgggggttcgcagggcacgggccaccctcgcctcttgtgctgatgaaagtttctgcgtcaactgtggtttgaaagctgctggggggcggagccctgccctgcagagagtagctcaccatatcccttcttctgggtcccttgctcccctttccctctggccttcctttcctttctctactcttctttttttctgtgcctctgggctcctagcttcataaccccaacctcctccctggcttgcctcacccaccggttatttttcctggagcagatacaccacggcctccaggatgaagggtcagcagtttggaatggcttttgaagttcttttttagtaaaatatacataacaaagttgaccattttagccatttttaagtgtasagtccagtggcactaagtgcattcacctcgttgtgcagccgtcaccactctcccatctccaaacttttttttttttgaggcgtaatttagcccttgttgcccaggccggagtgcagtgtcaccatctcagctcaccgcaacctccgtctcccgggttcaagctattctcctgcctcagcctccctactagctggaattacaggcatgcgccaccacgcccggctaatttggtattttagtagagatggggtttctccatgttggtcaggctggtcttgaactcccgacctcaggtgatccccccgcctgggcttcccaaagtgattacaggcgtgagccaccgtgtccggctccaaactcttttcatcttccaaactgacattctgtgcccattaaacacgaactctcctccgttaccctctccctcagccaccgtcacccaccactctgcttcctttcattatgagtttgaccactctaggtacctcatataagtggaagcgtgtagtatttgtccttttgtgtctggcttgtgtaacataatgtctacaaggttcctctgcgaggtagcatgtgtcagaatttccttactttttaaggctaaataacattgtctgtacacattgagtatcccttttctgaaacgcttgggaccagaagagtttgggatcttggatttttttttcagatttggaatgtttacattatacttaaccaattgcatccctaatttgaaatgctccagtgaaaatcatgtcagcactcaaaaagtttcagattttggaccatttcatattttaaattttcagatgagggctgctcaacctgtatatatactgcattttgcttatccattcagtggacacaggttcattccaccttttgtctattgtgaataatgaggttcattccaccttttggctattgtgaataatgctgccttcttaggaaattttggtatacttaaaaccataatttaatttccatttcactacctatggcaatgttattgtctgcctgatagttcctccttcaaagcccagctaaaaactcacacctttgtgaaaccttgtacacctttttgagaggcactaatcctttcttccttaggctcccagggtgctgtttgtttttcattatctctggcagtgtaacacatttacctcctagctacttagtctggaattcaaattccatcctcaaccccacctacccaccacatcacattacaaaggtttttcaataaacgtttcatttcaacaaataatctaagtgccttgactttgcagctagatgataatgatgagacaaataatctctgtgctttgtttaaagaaatgccaactccctgtcacaaaataaactttaattcaccattgcttgtggaataaagttcaaattcttcatcactcctctttcctgtttgtcttacaaaaacaccccagtcatcatccacacttctcccctaccttctctgacttaatcacattcttggaatcatctagtcagtcacttcaccacctgtttttatttgaaatttttaactctttcagaagctgaattccaacgccaccttttatatgtatracttgtagttgtttttttaggcagaattagtttctattcccctagcacatttcttgttcttctcattaacaggaacatctttcttgtctgtcttcattgcttacatgtctaactccctagacgcagacaaagtgttagttaaccctagggcaggaacaacactgccattttcagcctcagttatagggctttgcacgtagttgtttaacaaatattttaaggagtcagaacatgctgtatatggaggagaaattgattttttcttaaggcgaatctgcatattatgtttgaaagaacagaaataaatttgtatgatatcctgcttgggctttagaagcaaaaataccagcagctttatttagtgtgcctgtttcaattttccckaagtcttgggctgtgaaacacctcatttccatgtattcttayttctgttctgcttcttaaatccctgactaatttgttagtttgcaaattccctacagaaatggaatcattgggtttgagactgaatttcttgatttaacattttccaatcttaattatacatgacagtagtaaaagaagagttagttgttgggtttttttgttagttagcagttaaacctcacaatcatggtggaaggcaaggaggagcaagtcactgatgtcttacgtggayggcatcaggcaaagagagcttgtgcagaggaactcctctttttaaaaccatcagatctcgtgagacttactatcagagaacagcaggggaaagacttgtccccatgcttcaattaactcccaccaggtgcctcccacaacatgtggaaattcaagtcgagatttgggtggggacacagccaaaccatatcagaagggaggagtaacttgccccaagttacagaactgccaaacatgggcctgtctgagcctagttgttggactttaaccaatgttctgaattatcattcaggttctttgtactgcctgtgtccttaatctagttgactcgaatgtacctgcaggtttcagagcagcgatggagaaattaaatacttgcaattagcagaggaactgattcgtcctgagagaaacacattggttgtgagttttgtggacctggaacaatttaaccagcaactttccaccaccattcaagaggagttctataggtatgggcatattaatcttctttactttgaataggggttgaaatccgggaagccagctcttcttggactgtaagtgttcacttgtgtagcagaaggkcagctttcacagttatttcccactgagaagaggcgctttgatactgccagtggtcgttttagtactgctctgaacttcatgtaggcctttgtagagccgaacgtttttttgttgttgtgttttgtttgtttgtttgtttgtttgttttttgagacggagtcttgctctgtcacaccyaggccgaaatgcagtggcgcgatcttggctcactgcaacctctgcctcccgggttcaagcgattcttctgcgtcagcctccygaatagctgggattacaggcgcccaccatcacgcccggctaattatttacattttttaatagagacggggtgtcaccatgttggtcaggctggtctcgaactcctgatctcaggtgatccgcccgcctcggcctcccaaaatgctgggattacaggcgtgagccaccgtgcccggccagagctgaactttttttttcaaatacaaatgttgaaaatctttgctttctatatagttttcccaagaggaaaactgtacttacttacttttgtgtcattccattgatcctttttccccacaggaataggtgtttgtgtgggtccttttcttgtactggggatatctttacagcattgacgttgttgtacttcttgttcccttaaagtttaattttgttttcgcttataaaagtaataggtatatattgtagaaaatggagaagagtaaggagaattaaattgcttatacacttgtaatccaccaccgtcattagcagatctgctacaacagagttccaggagccttccaagtctgcaagtgcagagttttgtaaggatcttctgtcacattttgatgtctttgtgtgtntgctgtgtatgaaattactcaaattcatataaaatttcttaaactcatactaatagctccaattgtggttttttggtagaaatactatggttagacattatatttaatagaaggcttttattttgttttgacttgttatatatagcaagaaacatctttgcacacaagactttgtattaggattaaataaatgtgacagtctatagaaatagaatcaggttaaaataaattgtggacagttgtgaaagataaatgaaaacccagggataaggaggcacagtctcgttcatttcttagtagattaggagatggaggatttgtctgtgtttctggtcatagctgatgatcaagaataattggagggggtaagtaagcaacaggatttattgtgaaagcatgcagcagtagaagttatagcactgacaaataagggagaggtagacaatcaagcctggtggtagaagcagctgtgccatgcctcatgcacaagccaggcagcagttctctttcctgagagtagcgccttttttagagggtttcagaccccacttcttaaacaaactaagctggagtaggtattagaaacatatcaaaaggacatgcatacttcactctcaccagtcaaatggagcatttttgccaatttgttctcacattagtgcacaaatacttctcctgtcctcatccatttcttatcaaaccagccagatgtggtggctcacacctgtaatcctaacactttgggaggctgaggtggatagatcacttgagcccaggagtttgagaccagcctggacaacatggtgaaatcccatttctacaaaaaaaaccccacaaaaattagctgggcatggtggtgcatgcctgtagtgccagctactcagcaagctgagatgggaggatcacctgagcctaggtagattgaggctgcagtgagctgtgatcgtgccactgcactccagtctgggtgacagagtgagaccttgtctcagaatgaaaccaaagaaattgactgacttgacacatgacttactaagtcataaacagcccacagaaaattcacagtattgagcataatattgacaagatgattgttcagctagtcatcttggacagaggaatggccaacagtgtgggtgctvtatgattatttatgtgctatatgataatcaggtatggtatgacattttatatttagtgttcmggtgggataggagagaactgaaagagggtcctaaacctagagtagataatagaagtgtcctacacagttaagttctaaggtttagttgtaaccagatgaaattccttaatctcggctgttggtaggtatgtaaagggaaggaggccttggtaaacctctaaggtatcagctgacttttttgtttttyagagtttacccttacctgtgtcgggccttgaaaacattcgtcaaagaccgtaaagagatccctcttgccaaggatttttatgttgcattccaagacctgcctaccagacacaagtaagaaacccttctctggaaaaaaaggaattcaccaaatggtataagtaccacttagctgacagtcagaaaacttgagaggttgccttgatctgctattagctggctatttaacattatacaaatcacttttacctccctgagcctcagtttccttgtctgtgaagtcttttggcttaggttttctacctaaatcatgcaaaaaataggtttgttgctgtaaaattactttttcataattgataatcacaataattataaaacaagtacttataaaattgatgctgtaaaataccaggaggaaaaaatagtggtttgcattcagattttgtagaaggttgacttttgtaggagttatacccacttatccagaaagtttagtgttggagaaatgtattttcctatggagatgggattagatgtaaagggagtgaagcaaatttttaggattatcacattttagggcgccttttagggaaatttgggagaaaattgatcaagggagaaaatatgaaattctagaaattcctgaatctctggaaatttttgttggtttaaatgcataattttcaaacacccctttggcagttattttaagaataaatttactggataaaattgaagtgatattttgaaaagttaaactactgaaattataaaattaccaaattacttcacataaaatgggtttgtaaaggaagtgtttctgaactttgagtacaaaattttttctcatgataggattattatgtaacacatgcttttttttttagaaattgcgggtaagcaaaaaagtatttgcatataaaacaaaaacaggatcattctgtttttktttttttttttttctgagacagagtcttgctctgtcacccaggccagagtgcagtggcacgatcttggctcactgcaccctccacctcccgggttcaaacaattctcctgcctcggctccccgagtagctgggattacaggcgcccgccaccacgactggctagtttttgtatttttagtagaggtggggtttcgccatgttggccaggatggtcttgatctcttgacctcatgatccgcccaccttggtctcccaaagtgctgggattacaggtgtgagtcactgcgcccagcccgttctgttttataattttaattttcatttttttggcatcctttagttcatttatatattttgttctggatacatatacgtcatataatttaggattgggcacgttgactaaattattcttataggagagtccaaagaataccttgtctcttgaattttttttttaaacataaattatctttgaataccctctcactaaaatggaaagattcttagttaagagatgaatgtttactaatgggacatttgtctttaaacaggattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggtatttatttaacatctgtttagatcagagtccatctatgataataattcacttctaggcccttgcaatagcttatttagataatgttcaactcaatttttatgtaagttaagcatcatcaaaatgactacaaagttaagcccaaaactgttcatgtaaattataattgttagtatytacatttgttttaactttcagtaacttggaagttccttaagactgacaagatgtatttgtcaaagaataaatggtaactaggtggtggtggttgtcattatgaactggagttaagaaaacttaaagaaatagcaacttgttagtgtaagatttccatttgctgcatagaaaggaaagcatgaataggacaggctagcttggaagcaatgaggattatcatgattgaagtaaaggagccaaattggagatcatctgagagatgatttgatgtgagacctggaggtacttggatccctaaatcttaggctgaggagtttgagcctatcttaataagcagtgggaatatagtgggaaggtagtttgtgtgtgtgggtgtgtgtttgttttgttttgttttttgtytttttttgagacagtctctctctgtcacccaggctggagtgcagtggcgcgatctcggctcactgcaagctccgcctcctgggttcacgccattctcctgcctcagcctcccgagtagctgggactacaggtgcccaccaccacacccggctaattttttgtatttttagtagagacagggtttcatcgtgttaaaccaggatggtctcgatctcctgacttcgtgatccgcctgcctctgcctcccaaagtgctgggatacaggcgtgagccactgcacccagcctgtgtgtttttttttaaaagcaaactgaataagtccgtgatgggtttaacagagggtaataggcaatttcagttacctgggcaagaggtgatggatggcagtagtaagaatgaaggggaccctcagatttcagcaggacttaattttatgggacatacaaaatggaaagaaaagctgaagcagctcaagtatggaataattattatcagatgaatttaatattatttatattgctctgataatcattctccttatttggctttcttacattaacctggtagcttataagatgcacatattttaccaacagctttgggtaggagatgtcttatcttataaagtatgaatctagattgggtcttagtttgsgggggggaacacaactgtataaaggacactcttgacaagacatttgaagatggactagataatagaagatatgtaattttatgaaattaaatattgtttaattatcttggttgtgataatgatattgtaacaggattgtctttattcttagagatgaatgctaaaatatttaggtatgaagtttcttgatgttcacaactgtgttcaaatacatagtaaaaaaacatgtatctgtaaataatgttagcagttgtgttgaagtggagggtataaaaggtgtatttgaaattttctgtaaaattatcttaaagcttaggagaagatggagcatggaacagatatttggagtcattttgaacaaagaaaaaaattattttttaatgagtaaaagtgaagttttttttttctctgctgcttgaatcatcatggagtttttaaatagatgtaatctcttgccaaattgaactatttgactaaaaggagttttagagtagataatttttaggataaatgttggtacatgtgaaaagtctgctaatgggtcagatagtttagaatacgtccrtatttgtggtatttaatttagattatatggcatctgaaaggtattgcttctcattcttggttggttgtttgtctgtattacaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgaygtctccaagcttagcacaccaggtcagtaatytgtggctcaaatttaacaaattctcagttacctaaactgcacagtatctagcttcccacatcttcattgtcttctttttggctaccaatcagaagctgaggaacgaagtgtgatgagaataaaaacaaattggttttgccacaaatggtgctattctgaaagtattcaaggcttaagtgaagtctttggatttatagctttcatttatttgagcaattttgaygttcagcacctttaatatttaagttgtgaaacaacctatcattctgtttcaggagcacgtgcagaaactaattcccgtgtcagtggtgttgatggatatgagacagaaggcattcgaggactccgggcccttggtgttagggacctttcttataggctggtctttcttgcctgctgtgttgcrccaaccaacccaagggtcagtcgttttgggggtttttgtttgtttttgaracagtctctctctgtcacccaggctggagtgcaatggcaaagtcatggctcactgtagcctccactttctgggctcaagtgatcctaccatctcaacctcctgagtagctgggattataggtgtgaatcactgcacccagctaattaaaaaaacttttttagagatgaggtcttgctctgttggccaggcaggccaacagtgagtcttagtagagtgacagcttaagaaacacctaccctgagctgccacgaaatgataggattctgaaacatctgggctgtctcatcaatgttgagagcacgggatggggttaagatttgatgagttttaaaaccaaatcttttgacgtatgcctttctgatcttgaaaaaaagtcttatttgatgtcttacataaaagctcaatgcttttaagtgcagtggtacaaattatccacgctgttttttgttttaaagtttcatagttcctctgttattcttctggaggaaatacaaataaaaagatttagtaatctgggaagtaaacttctgagaatgatgaacccctggcagtatcattcagttaacttgattctgtgtcataaatgggagtttggaaaatagttcagtattggaaaaagggagtgaacataatattctcttattttatttgcatctttatgtcagtgattaacattctgctatcgcttatctcttgagcattcaggtagctttttttctatttaactcactggacaaatgacatacccttaagtgtctttgttaactgagggcttactagtttggggagttgtttttttttaaacctttacagtcaataaattgtgaggttgacttcccangctatgttgtgtttgtaatgaagtttcttctcctttatgctcttttgactgcttctatactaatgattcttcctttgttctctaccattagtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggtaagaattccatccatttgtaccataaacttgaaatcamaataatgattataaacagccacaggtgatttctgaaagcacataaatcagactgtgaaagtttttagtgggtctgaaagaggtcatttacaaaaggacaggtacatgatttcacttatacgaggtacctgtaatgtgcaaattcatagagacacggtaggatagaggttatcagtggctgggggaatgggagaaatgagttatttaatggataaagttgctatttgggatgatgacaaagttctggaaagggatagtggtgacagttatacaacataatgtacttactgccactgaacttatacactgaaaaatggttaaaatgatragttttattatgtatttttatcacaattttatttttttaaggaaaagttattttgtcatcttatttcctggccttatgacagagctgcacttaagtgtgtttccatatgckagactagtctcctggcctttttgtggttgtagtctcctggccttgttggtgtgtgtgtatgtgttttagagagacggggttttgctatgttgtctaggctgaagcactccctcctgggctaaagcaaccctacctccagcctccccagtagctgggattacagrtgtaggtcaccacattggctcttgtttctctttttatttaccaaaatggagtgtttatgattggttacttgttctgtctatacctttggcagtttcacattttcctgactcttggttgcaagctgtgttttgaaggctatgactaaaattttaggcctgatgctttatctttgaactcttccatccttgtcttccatactcaattaggattatggtaagaactcaacctttttttatctttttttattctattttattttgagacagagtctcactctgtcgcccaggctggagtgcagtggcgtgatctcagctcactgcaacctctgcctcccgggttcaagcgattctcctgcctcagcctcacgagtagctgggattgcaggattgccccacaacactcagctaatttttgtatttttagtagagatggtgtttcgccatgttggccaggctggtcttgaactcctgacctcaagtgatccatccgccttggcctcccaaagtgctgagattacaggcatgagccactgcatccggccctttttttctatctaaatataagtcagagaagttttgtttgtggaagggatttttagttttctacctgttttgttttgttttgttttgttttgttttgttttgttagggtcttactcttgcccaggctggagtgcagtgacagcatacattgcctactacagcctcaacctcctgggcttaaacgattccccaccacagccccgaaattagctgggactacaggcgcctgccaccatgcccagctaattaaaaaaaatttttttttttagagatggggttttaccgtgttgcctgggctggtctcaaacctctgggctcaagcaatcctcccgccttggccttccaaagtgctcggatcttccagagtgatcagattacaggcataagccaccacacccagcctaattttctgctttaaggaatgccttgtgtaactttgcatagcactttgttgatggagttcagagagtcgacagttccacagaaaaatgtttcttttaatagcacagtgttcttttttaagaaaattgtttttccttcttattggatttatgaactaagcagctgtaaattgcattcagcatcttatttaatccacatgaattcagttaacatatatttattcagtgctggtcactgtaggtgatagaaaagtgttatgaaccatttcctcaaactcttcacagaactataagaactggcattaaaaaggactagcaaatgtggtaggccttggtggacatagttcatttatcaggagagatctttgagggctaaggcattgggtaaggttttgtgtaggaagtaggactcatggacaagtaaaggctcttaggatggtgagcactggcacggtgacatctgtggtgtaggagaaaacattggaacagtggtttaggtgactaagtccacagaacaagaaccaagatcggaagccaggtgttattactccagttttatgctttgctttagctgactctgcctttcggttggtaaacatgcctttactgtttcttctgaaagtgtttaacttcatgttgaaaaattagtttttcatctgtagcttcttttcatttcaggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagtaagcgtttgcctgatacagtgttgcaggaaaaagtgtacatagttcccaggctggctgtgctaccaagaatgcagtcagtatggccttactaggagtgtaaattatgactatgttgaatatataattctcatagattaaagttatggcaacattgtacaattttttagaatagggaaaaattgcctgtaataccaatctcacattgaactgtttagtctttgtataatatctttgtaaaatatatttgtataaaattttatacaaattttattatttgtataaaattttatacaaattttattatttgtataaaaatatgaattatgtattttcattattgtaaatcatattatacatacttgtaatttcaattttctataaacattttttccatgtttcttttcgcatggaaaaatctcatgagtttgtcattttcacaattgtctttttttgttggtatactatagcttacaaaatcattttcttagccctgttaaatttaacaggatagtttattataataattaccgatatagatgcagtgaacatcataatgttatatacattttttgtttgtttcctctgggtaaattgctagatacaggattgttgagactaagaatacaaacatttgtaaggttttaaaataggatgtactggccgggtgccatggctcacgcctgtaatcccagcactttgggaaatcaaggcgggcggatcatgaggtcaggagatggagaccatcctggctaacacggtgaaaccccgtctctactaaaaatacaaaaaattagccaggtgtggtggcgggcgcctgtatacagtcccagctacttgggaggctgaggcaggagaatggcgtgaacccaggaggcggagcttgcagtgagccgagattgcgccactgcactccatcctgggcaacagagcragactccgtctcaaaaaaaataaaaataaaataggatgtactttccaaagggaatgctgctatgagatattttatgttaactttgtcagtgtgaacacaatttttgactgtttttagaagctataataaatatttgattactttcaaacttttaagaaacttagggcccaaaataaaagcaacaagtttctgagcacctgccatgttctcagtgctgtatatgtgttatgtcttactctagcagcacccagacaggcatgtgtattattccctttttttttcagagagtcacaacctctccaagcctacaagaaatttgcccactttcttgtaggtgaaaggtgacaccgagccatgaatattaaaattcagatacagttgcctgcaaaacatgtgtacttcatactacatcaagctgccttttctttgttttggaaatttgtagcatagtaccattttagaatattgaacatttttagttggtttggagttttatgattaaatatttcttttgaacatatcacagactgagttttagattttaagatagtagtcctgtgttacaaaggattcttttttttttcttgtcattctttctcccccctcaaaaagaaagatgtactacaatgttgcctctggtaacagtgtcatgtggtatgtgacagtcttagtggattccatagcattttctatgtataaaatctgtatataatgatagtcggagtatccmatctggctgcctttttttcttgcctaattgtccttgattagagccatcagtataatgttgaatagaagtggcaagagcagacatccatgtcttattcctgatcttaggggcaaaacattcagcctttcacctttaagtttgatgttatctgtgggttttcatagatgccctttgtcaggttaaagaaaaaaccctttattagacttaggaaaacctcctctattcctggtttgtttggtttttgtaatgaaaaggtgttggattttgtcaaatgctttttctacatctgtttaggtggtcatgtagttcttttattaatttagcatattgattgattttcagatgttaaaccaatcttgcatttctggaataagccccatatctagttytgttttgttttatttttaattgcaagaccttctgatagatgattgttgctgtttattactattaaagacttcttttaaaattgatgttttagctgggcgcggtggctcacgcctgtaatcccagcactttgggaggctgaggtgggtggatcatgaggtcaggagatcgagaccgtcctggctaacacagtgaaaccccatctctactaaaaatacaaaaaaaattagccgggtgtggtggcgagcgcctgtagtcccagctactcgagaggctgaagcaggagaatgrcatgaacccagtaggcagagcttggagtgagccaagatcaagccactgcactccagcctgggtgacagagcaagactctgtctaaataaataaattaattaaattaaaaaataaataaaattgatgttttaggctaggtgtggtggctcacgcctgtaatcccagcactttgggaggccaaagtaggtggatcacctgaggtcaggagttcgagaccagcctggccaacatggtgaaaccccatctctactaaaaatacaaaaattagccgggcatagtgrcgcacacctgtaatcccagcaactcgggaggctgaggcaggagaatcgcttgaacccatgtggcaaaggttgctgtgagctgagatcacaccactgtactccagcctgggcgacagagcaagactgtgtctcaattaaaaaaaattgatatttttatcaggtattaactctgaaaatacaaaaattagccaggcgtgatggcccacacctgtaatcctagctactcgggaggctgaggcacgagaatcgcctgaacctaggaggtggaggttgcagtgagctgagattgtgacactgcactccagtctggtgacagagcgagaccctctcaaaaaaaaaaaagaaaagccgagggagagaaaccttcccatttagtctgtggcatgtgtcttcatgaattgcttaagctctcaaatgttctttcagtaatttaaactcttctgctggttttcctgggaagggtgctgtataatcacatattaatgagtctttatgtgataaccttgaacaggcacgtggaggagttcagccccagagctgtctacaccagtggtaaagcgtccagtgctgctggcttaacagcagctgttgtgagagatgaagaatctcatgagtttgtcattgaggctggagctttgatgttggctgataatgtaagaacattttacactcttcagtataaagaagtcagaatacccctaccctatcagtaaaggcctataagttaccattaaaaagatgtccttaaaaacagcattctcagctgggcrcggtggctcacacctttgtcccagtactttgggaagccgaggtgggtggatcacctgaggtcaggagttcgagaccagcctggccaacatggcgaaaacccattttctctactaaaaatacaaaaattagccgggcatggtggcgggtgcttgtggtcccagctactcaagaggctgaggtgggaggatcactgagcccaggaggtggaggctgcattgagccaagattgtgccactgcactccagcctgggtgacagagcgagactctgtctcaaaaaaaccaaaacaaaaaaaaacccagcattctttagtaaataattcatagttttcttcatctagaatttaaaattgtgatagttgatcagcatgtcctgagcacgtgtgtttgctgttactagtttagatcggtagatgtgtatataagttataggtataaaatcaatcctgagttgacacaaggttttgatgttgagtacaagtacagtaagtgtatatttttagttatgctcttagttttaagtcaattgtgtggttctttctagctttaggatctgttgaattatcttccttagaaaagggagttaagaatcttcacttacctatcttctacttgtttggagaatagaagagtccctgtggtagcagactttgtgagtttacttgtaattttccatctgaaagactgttcttgtttttcgtgatgaagtcttgctctgtcgcccaggctggagtgcagtggtgcaaccttggctcactgcaacctctgcctcccgggttcaagcaattctcctgcctcagcctcccgagtatctgggattacaggtgcacaccaccacacctggctaatttttgtattttcagtagagacggggtttcaccatgttggccaggctggtctcgaactcttgacctcatgatcagcccacctcagccttccaaagtgctgggattacaggtgtgagcccccacactcggccgttgttgttttttaagagacagggtctcactctgtcacctaacctggagtacagtggcaatcatggctcactgtaacctcaaatgcccggccttagtgaagcgttcttcctgccttggcctcccaaagtgctgggattacaagtgtgagccatgcatccagcttgaaagacagcttcttaggcttgatttgtttggttacagggtgtgtgttgtattgatgaatttgataagatggacgtgcgggatcaagttgctattcatgaagctatggaacagcagaccatatccatcactaaagcaggagtgaaggtatgtgttatctacttctgttctgctgcatcgtccatagccttgttgattaatgtagtactagagaagttcacctggataaaattcattacttcagtgtgtaatgctgttcattaaaatggaaaatacagccctgagaattatttattgaaactataaatgttgtttagagtactgtgtaaatgtattgccatgataatagaggaaaatgtccatgaacaaagcttttattttctttgataaagcatgctccaattataacaaaaataaccaaagatcaacagattgattatatatgtatatatttatttatattaacagagtatttaaatgaaaataagtatgacagtataaccaacactagggagaatctaaactttaaaagctacagattcaagtagcttttaagcagtacacaattgtaaattgaaaagacaactctttccctgcaactcccagcaacagtagatacttagaggtatctaatggataaaaaggaattttaggaggargaaaataaggcatctattgagtttgtgccccttttaggaatattttgtacataagcataatactgacaatttcattcctgctggtttaacttcataattttattttggcaatcttttaccagcacatattagatcaactttsgttttttattaatttcccatattcaattgtgtataccacagcttgattctttagactcytgttgagtgacatttggttcattttcagtgttttgtattacaaacaaaattgtagtaagcatccttgaacgcaacatccttttatatttggctataagagaaatttctaacaaattgatgtcttcaatggtgtgcacatcataccaccaaaatcacataggagttcctgtttatgtgaaaaagggtatgtcattattttggtttgtgtttagttaattatgggtgagattgaacatgttgttatatatttattggctgatgtctatttaaatctgttaagattctttcttttgtggtcaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggtaaccccatgagcttccttttttatttccagttggagtaatngagtgagacaaggctggaagatacactgctcaacagctggtgcatgtatgtgcaccagcctttgatttccctcagggtggcacaggatcggacaaagggtttagtaagcaactcaaaataaagtcatttgaattgcctcttccacttaattgtgttcaagaattaagttttcaggttttgttactatttatttctcaaaaggaaacaagttacagttaacttccaaccacactttttatttttttaaacagcctctcactggagactgggctggagtgcagtggcacagtcttggcctactgcaacctccacttccaaggttcaagcgattcttgagtctgagcctcccaagtagctgggattacaggcatgtaacaccatgcgtggctaatttttatatttttagtacagacagggtctcaccatgttggtcaggctggtcttgaactcctggcctccagtgatgcacacccayctcagcctcccaaaatgttgggactataggtgtgagccactgtacctggccccaaccacactcttaagatttttatacaattttttgttttgttgattgggcttttattttatttttcagtcaccttgaaaaaaactgggatgccaaagaaatttcttttcttcttcttttttttaatcatgagtcatttatctttgtattttttcctatcaagttgctgaatgtattttacctttttttctcacttttaagattgagtgaaaaaatgtagatttacttggattctgatatgttagtttaattattagagttatgtgtacttaaatatttaataatgcacttcagatgcccacagaactataaaatgacagtttgtaggaactaatattttaggctgtactttttaaatcattcagcattgaggttctacattttattgggtacagtgcacagctctttgttacagtggaactttaaatattatctaaataaaagtagccttccattttgtgagtgtttggagggcttggatttttatttatttattttttaaagacaaagtcttactctgtcacccaggcagtgccacagtcatagctcactgcagcctcaatctcctgggttccagtgatcctcctgcctcagcctcccaagtagctgagactacagctctgtaccaccatgcctggttaattttttcatccttttgtagcaacggcaacaagttcaagacccgtgttggtcttgaactcttggcctcaaaccaccttaccacctcagcctcctgaatagctaagattgtaggcctgcaccatcacacctggtttggtttggtttggtttggtttggttcactttttttcccttcacaagagagacatatttaattaccagataattgagttgtctgattttcatacatttatgtttgttcatgattcattaaagtagctttagtagcagatcaagttataaacctttaaaagatcaatttataaacctttaaaacattcaagatttttttaaaactgttttctttagttttgttttgttttgtgacggagtctcactctgttgcccagactggactgcagtggcacaatcttggctcactgcaacctccgcctcctaggttcaagtgattcttctgcctcagcctcctgagtagctgggattataggcgtgtgccaccacgcctggctaattttgtgtatttttactagagacagggtttcaccatgttggccaggctggtctcaaacacctgacctcagttgatccaccgacctcagcctcccaaagtgttgggattacaggtgtgagccaccgcgcccggcttgttttgtttttgagacagggtcccactctttcctgcagtggcgtgatcatggctcactgcagcctcagcctcctgggctaacacaatcctcccacctcagcctcccgagtagctgggaccacacatgtacaccattgtgtctggctgacttttgagttttttgtagaaacaggattttgccatgttgcccaggctggctgcaaactcctgagctcaaccagtctgcccacctcagcttcccaaagtgttgggattataggcatgtgccaccatacctggccaaaaagccttttctttttctttttctttttctttttctcttttttttttttttttttttttgagatggagtctcgctctgttacccaggctggagtgcagtgctgccgtctcacctcactgcaacctccgcctctcaggttcaagtaattctcctgcctcagcctcctgagtagctgggatcacaggcgtgtgccaccatgcccggctaatttttgtatttttagtagagacggggtttcactttattggccaggctggtctcaaactcctgacctcaggtgatcccgtcttggcctcccaacgtgctgaggttacaggcgtgagccaccgggcccagcctgttttattttagttatttattttgagacagggtctggctgtattgcccaggctggagtgcagtggcatgatctcagttcactgcaacctctgcctcctgggctcaagccagcctcccacctcagcctcctgagcagctggaactacaggtgcaggcccccatgcccagctaacttttgtattttttgtagagaccragttttgccgtgttgcctggactggtcttgaactcctgagctcaagctatccaccagccttggcctctcaaagtgctaggattacaggcatgagccactgtgttccgcccagacaacttcttaattagaaataatttcaagcttacagaaaagttgcaagaaatggaatagtgcatagaacacccatataccctttacgtgattcacataataacattttaccctgtttgctttattgcttactgtctgtatatatctgcacacttttttcctgaaccatttgagagcaagttgcatattttggggtctttttttttttccagtattctgggatgaatatcttcaaaatttagtggctaagagcacagtctctgaagctagactattcaaatcctggctccactacttaactgtgaccttggataaattacttaaccttcctaggcctcaatttgcccatgtataaaatggggataatatcatttacctaataaaatttttgtgaggattgcataagttaattcttctaagacctgcctaagagaacagtgtctcatacactgagggccctataaatgttagttctgctatttttgttgttttgtttttgagataaggcttactctgttgcccaggctggagtgcagtggtgcaatcatggcttcactgccccttcaacctcctgggctcaagtgatcctcctgcctcagccacctgagtagctgggattacacatgtgcaccaccatgcccagctagtttttttgtagagacagggagggtctcagtttgtcgccctgactggtctcaaactcttgacctcaagctcttctctcacatcagtctcccaaagtgttgggattacaagtgtgagccactgcactttaccctactattgtttttaaagccaatcaattccttcaggtatagttttagagtggggcaatggtatacatttaaacgtttgattttaaatccacctgttcccaaactttcatcagaaacttggtacccattaatacttccttaagtggtatattagagcttgtttttggcgataaatcatttcttattgcctgggatagtctggagaagatattgctgtgactatcaaagtgatttttttgttttgaattaggttacagattatgccattgccaggcgcatagtagatttgcattcaagaattgaggaatcaattgatcgtgtctattccctcgatgatatcagaagatatcttctctttgcaagacagtttaaacccaaggtaacctacccttttgtactgggataaggtataatgggtatattaaagtggaatttaagtaagtgtgttatatggaaattaactgaacctgtcatctaccttagttcctaaattttacaactttttttttttttctggaacagcaatttgttttttcagagagggctgagaaagggaactgtaaaaaaaattctgaataattccattatttgtttggtggtaataaaaagatttgtatgggagaagagttttggataactggataatctagaacattcttttatttcaaacattactaagaacgttaaaattgtttatgcgcctaaatcaatagttgaatctttctttgaaggaaacattggattcatctaggccattatgataaatataaattactgttttacagtgattgatgcattgtattggactaactctgttctggacccaggattcttacctggacataaacccccaaatgcttggcattttcccaaaatagggtatgaaaaggaaaaaaaatactcattctggttgagattttcacactgttggctaacttgacttctggaaggtgttactaggtattgatcatttatcatcttcacttgattattcatgagattgcagttggctctcactgtcccaaagaaatttaatcatttaaaactaaggattatgggtgattcttgtgtaaaaaagagcatctgttctccattactgcatactgatatactgatccctctgtaaccttggcatgcttccttaatatggtgaattccttgctctgaaaagctgaggatcctttagatataaagtttattgaaacagcttttttttccctgcaaagagtgtgagttaattaattgagcctcaaatactgagcattaatttatttaatgagcactgacatcctgaggtgtaaaagacattacatcttgttccattgcttcagcttgttaagcagcttttagaaatggtcatttgcttaaatactaagccttttttcaggttcataaaattagtaacatggaattcayaagcctccttaatattagtttcttttgaaagacattacaatagtaatttattgtcactggcttctcaaagtttcaaccctctcaggttccctaaatgtttccacctggaaggctcttaaacttaggtttaccgtagctctcatcaaatagaaatgtttctctaacttgagtgatgatctgaaacagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtatcagagtcactttgatatgatgagagcagagataaacagatttgttgcatgtttttaatctttggtatgggacatamtagaattcactgcaaatacatttttatgtaactgttgaatgctcatacgaccatggaattcttccctttaaagagcttggtaagcatttgagtgtagttgttagacggagacgatcacgtcatagtttatagagtgcataaagacgtaagttaccatttaatacctttcattcaggaaaaatgtacttagaccctacaatgtactagtaggcctctgcgctggcaatacagataagataatgtagyccctggcctcaaaggaactctcctccttaggttgcatttgtataatgtttgatttttagattgttctttgagccctgcattccacgaggataggtcagtgggtattaacgaggtaaaaggggagtagtacgaaagggcattcaagcgtcccatcttcgcttcaaccaaagcagccctgctttttcctagttttattaataggtttgatgtaaggtcgtctttgaaaagggggtttggcttttttttacagtgtgactgaggtataatttataaaaagggaaatgtatggcatggtgagttttttcacatacatccttgtgaatacccagctcaagatccaaaacatttccataatttcagaaagttccaaacccctgcctcttttcagtcttagccctcttcccctgaagtaactactgttccgacttcaatcactacttttatcccacaggttaattttttggcttttttccactaaattttcaaattctttgatatggtactttactattgacgaagtactttcacactaggttatttaatattctttgattcacccaatatttagggaacacctgtaggggacaaaaaatgaatgagagcccctgccttccattgctgctaatctggtgggaacgagacatgtatttaattaagcatgtaaaaaatgagaagagtgggtgatgaaataatctatatactaaatccccatgacacacagtttacctatgtaacaaacctgcatgtgtacccccgaacctaaaatataagttggaaattaaaaaaaaacgagagggagaatagagcatcacaaccagagtgctgagatgaattactttattaccaaagaaggaggaggactcagggaggtgccgacgtttaaacccagtcactgaagggtgtgcagaatttggataggcaagataccctgggacaaggtcattctaaaaccatgctaacatttgtactttttttttcattgtgatagttcctgaaatgagttgcataaaactggtacatgtcttagggcagtctctaattgatttttattttgttctatttttaaaaattagtcttcaaatagcagattcacatgatattaaaatatatgcacataaattatatacacaaatatattttctgaatgaaatttagtatctgcatatatttaagagctatttctgtctcatatgttcataatcttcatccattaaaaaaacttttgttaggcctttctcactctaagattataaaaaattctcccattatttacctagctagttttctagttgttccaaaaccatttattgaacaatccatctttttgacactggtttggcatgccttaattatatattcttgtgtgtgttaggatctccttttggactttccattctgttcattgagtcttatcagctcctcttacattggtaccatgatgttttaatctatggggctttgtagtttaaatgtagggctagttccagcgcattgttctctatcagctgttaggaacttagaaatcagcttgctctgttttaaagaaaaacctggtatttttttatcagtataacattctatttatattaacttgaagaattgaaaacatctatgatttttcctattcagtaacgtatcacttagaataggttaggttgtactactataaaatctcagctgcataaaacaatttttttttgcttgtgctacacatccattaggtcatcaagggactcaccttgtcaagttactcagagattcaggctgatataaaggtttgatcttgacatacgctttcatgatgacagaaagcagggaagagaaggtggtgagccatgtgctttctcccccttctatccagaaatgacacatactcacatttcattcgccagagaaattaacatggccmctcctaagttcaaatggatagagaaatgccttcctaccaggtgcccagaattagaagagcaaacatttgtgaacagttctgagtaccacaaataccgttatctttccacttaagtcttctgtttcactcagtagtgctttaaacttttcttcatatgtttttcagtgtttcttgttgaatttcttgatattttatcatgtttgttcgtactgggagtagcctttttttccatttcattttctggctggtttcattgctggttgtttttttgttttgttttgtttttgagatggagtctcactctgtcgcccaggctggagtgcagtggcacaatctcggctcactgcaacctctgcctcccaggttcaagcgattcttctgtctcagcctcctgagtagctgggattacaggcatgtgccaccatgcccagctaattttttatatttttagtagagatggggtttctccatgttggtcaggctggtctcaaactcccaatctcaggtgatccgcctgcctctgccttccaaagtgctgggattatagacatgagccaccgtgcctggcctagttcttatgggatgtatatgtctttggattcatatgatatgtatatatgtttatatttctacaagtacatacctaggagtggaattgttgggtcataggttaatgcatgtttttctgccaaacagttgtgtcaatttctgttttcaccgctgtgaatgagagttgttctaccttcttgacaacacttgatattgtcagtcattttagccattctggtgaatttatagtgctatttctgtgtgtgtaagagagagaatgagagagggtgtttgtgagaaaaccaaagcaacactgtgagagtgtgtgtgtttgtgagaaaaccaaaatacatactactgtgatttcattgggagaaaatctgtttggtatatcaaaaaaagtagcttaattacttcatcattattggtttaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtgagatacttgttcatgtgactgttttggagttagggaccaaaacattttctgagatgtcatgtggtagaagtacacctgctgttggctaatagtctatggtagcaaaacggaaaaagcagatactgaattctattcactgtttacaagttaaaatgaaattaaatagttgatataaaatatatatacttggctgggcacggtggctctcgcctataattccagcactttgggaggctgagataggtggatcacaaggtcaggagtttgagaccaccctggccaatatggtgaaaccccttctctactaaaaatgcaaaaattagccaggcgtggtggcggctgcctgtagccccagctacctgggaggctgaggcaggagaatcacttgaacccgggaggcggaggttgcagtgagctgagattgtgccactgcactccagcctgggtgacagagcgagactctgtctcaaaaaatacatagatatttgaaagactaaaagaaaaggcagcaaaatggtgataatagacataaatcccctgggttttacccttatttgtattgttgttttgcttctgaattgaaaacattttttcaagcacattagaacagaaaaatactagaaattttatttattttgagatggggtctcattctgtcacccaggcttgaatgccttggtacactcatggcactgcagccttaacttcctgggctcaagcagtccttctccctatcctctctaatagctgggacatatgcccacgccaccactcctggctaattttttgagaattttttctagagacaggatctcgccatattgcccagactggtagaattttttattttgtatataatactgcaagtggactttcagattgtgaaatctttatatctctgatccctcacgttcctcccaagttagtttttgtctttactagtagagtttatacatttgcttctaatttatttgaaaattcttatatgctatgtataactgtatgcatgtttttttttgtttgttttttgtttttttttatttttgagatggagttttgcttttgttgcccaggctggagtacaatggtgcaatctcatctcactgcaacctttgcctcccgggttcaagcaattctcctgcctcaggcttccgagtagctgggattacaggcacccaccaccacacccagctaatttttgtatttttagtatagacaggatttcaccatgttggccaggctggtctcaaactcctgacctcaggtgatgtgcttcccttggccttgcaaagtgctgggattacaggtgtgagccactgcacctagccggtttattttgtttttcatttttattttttggcagaggagatcatgtgggaatgtatgcttgttttaaaattagtgttaaggctggatgtggtggcccacacctgtaatcccagcacttgggagaycaagacaggaggatcagttgagtccggtagttcgagaccagcctgggcagcayagcaagaccctgtctctaaaacaaataataataataatttttaaaagtgaaaaaaatcagtattaaatgtaagtagtgtatttgtaaatgcttgacaaggggatgttaagggcacaaaaataagattcaggtggtcaatttttcacttaggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaaggtgaggcttacctggtactgcttacatgctcggtcacttctgtaagctctgttcacataggccacttgtgattgccaaacttcgtgttgttctgtcggaagagaggataagttgttagataaactcactttagcaaagtaaatttgtggagtatcagcatacctgccagcctgaacatttcttcacaagcttattgtcaggcaaagctttgtaggtycttctttttaacattctgggcctattttaataattttgggacctgataacatatgaagcagcacatacaaatgtttttacaaatgcaaaattactattcccttacaatggttctgtttaaaacagctggacccctagggtatattttaacagtaattaattgagcctagaaatctatactatcaaaaggccattgcagactagaaatggagtaaaatcctcatgtagttattggtaaagtgtggcgtctggacactagtacgcttcctacccttaactgctttamcatgctattcaaagttttatcaccctatagttaactacaaagcagaaggaaaaatgatgaattcaagatgttgaacctaaacttctacttgatagttaagcatcagataattcttgattaaaagccccaaggatggcttgtgctggctttctggaatattttgtcatcacagtatttgctctgctatgaaagaagagaacaagagattgtagtttctgcccttgttcccctgggaactttagaccagtaggagagaaggcaacaaagtggccactaggacgcctcagcttttgtcctcattcgcgtctcacacaaaatgatttgggaactcaaggtgttcttgattcatgttatatgtcattattctctttctccctcatacaagtaagttttaaacacagcagaagttgagttttatgatagttatgttatccaggtccaaacatttcctatgtgttgagggttcttaccaggactttctaaaagtctggtagaccttggacttgttaaaagcagcaggcagttcacttagtaagatgaaccttgctaaaataaacaggtaattttttattttgagtgaatactcatgaattttacttcttagtaaactccagttccataaagccttcccctttctacagaggaaaagttgttatatttcagaatttttgcttgctgttgcttcattcctaatttatgcttttagtttctgttggcaagcattctcagaggtggtgaagcataagaagatgaagaaaagaccttcatactttgaaatcttaatagctttaagaaacatatttcttataatctkttttattaggtttctctccttatggataaaataaggcatgctttaatacaagtgatatgacttgttatttcaggcttatgctagaacattgcggaccttacgtcaccagatgtactttcggacggcttgacatttatctaatctgtacattatctcgttgtatatgtggcagagatttacccaaggactgacagtacgarttgctaggataatttgaatgtgtttttttgttgcagaagaggacgagtcagcattaaagaggagcgagcttgttaactggtacttgaaggaaatcgaatcagagatagactctgaagaagaacttataaataaaaaaagaatcatagagaaagttattcatcgactcacacactatgtaggtgcagaagtgcgcgtgctctggtatcagggagggagggagttcatgccctgtatctgcaggttcactagtgaaattttttttgacctttgtttgttttgaatcattggagtgtagtcagaagtatgagttgtaaaataagagagaatgaacagcaggtaaatgacttatttcctctgctgaaacaagcagaatttaggttaaatctcagaaggtgggattgaagtcttactagttaggtgttttaagcttctgtttcccatcctcatatttgcccttggtcgtactgctgtcacctactttctatgtttcattttcctcacattcttagttcccaccttacccaacccaatagtcaatcttccatcttacttgcttggcgaaaccccaaacttggttaaatataacttttttttttttttgtatccttatctaagcagctgaaagtatctggagaaaagcatataattatgagcccagtcttatttaaatcgatgaccagaaatctcaagtggacagttcttactgtctcatcaacctcatgacagcactgcccagtgcaattccttttcccgggtcagttctttgcctcactctctcacaggcccatcacataccttctctccactcctgtcagctggccattctcagtactcagcctgtccacagctttgtcacagttgatcactcctacaaatagtgtcttcctcacttggttctgagtcactgtatcctcctggggcttctttctcactggttattccctcttagtctctttccctgaatggttttgttttttttttttttttttgagacagagtttcgctcttgttgcccatgctggagtgcagtggcatagctcactgcagcttccacctcctgggttcaagcgattctcctgtctcagcctcccaagtaggattacaggcgccggccaccacgcccggctaattttttaattttttttttttagtagagatggggttttgccatgttggccaggctgatctagaactcctaacctcaggcgatacgctcactttggcctcccaaactgctgggattacaggcgtgagccaccgtgcctggcctgaatctttctcttcttactttactctcagatagtttacattcattacctaagtgatctcatttggttttatgaatttatccatctactgatgacttccacatttatgtcaccagctctcaccactcctgtaaactccagatgtatagagctggttgcctactgatgagcgtttaacaggcatctcgtgcttaatgtgttcaaaaacagagttgttcttccctgtttgcagttgagttgttcttactcaattgctataggccaaatgccttggaattgtctttgactccttgattccactctcccctcacagctcctcttcagcagcaaatcctctgacccccagcttcagtgtgtgtatattttcttttctctttttaccgccttcaccagcccacccaagccaccaggcatggactgttgcagaagcctcataaaattgtcctttttttgtattggcttcttgctcagcagccagataagtctttttaaaatataaatcagattattttactaccctcccttccagtgcttctctcacattagaaggaaattcagcctccttgtcatggcctgcagaactattatacagtgtaacccctgtcccctcattcacctaatttcacagcagtcttccccatacccatttcaccccagtgacactggccttgatccctaggcacaccaaatatgagggcctttgcactcaccctttgtccatttccctagatatcctcctcctctccaatgtctgctcaaatgttacctcttcaaagaaacctttcttgctagcctgccaaaatagtagccttctgctcttgctgtcaccctgccttgtatttcttcgtaatgtttaacatggcccagcagtatattctttatttaagtggttagtttgtctctcttatggaatataagctctgtgagggtagagactttgccccggagctacagtggtacctggcacatagcaggatcaaatatatgttgaatggttaaattttcctattatgtggcagagatttaactgtcgtgccaattcacagggctcactatataaatattacagaggtcatgtattggggttgtgtcttctcaaaaaccgttttcctgtgaaggtagatcagtctgtgattattgaggggtagggaggtgtaagaacagctactcagatcagggtccagagttgcttttctagtggtgggacatgtctgtgtgctccttgggatcagtgtaaagtaaaacgacccaggcaaggaatctgcttcaggactttggaacacactgtgaagctaactgatctaaacttgaattacctatttatttatttatttatttatttatcttttgagagagtcttgctctgttgcccagactggagtgcagtagcatgatctcagctcgccgcaacttccgccttctgggtttaaatgattctcttatctcagcctccagagtagctgggattacaggtgcccgccaccactcccagctaatttttgtatttttagtagagatggtgtttcaccatgttggccaggctggtctcaaactcctgacctcaggtgatccacccacctcagcctcccaaagtgctgggattacaggcatgagctactgcgctcagcctggattaccttttaaaatttggcttaccacctgaactaatttgctacagaaaactagagagcttatactgtgctgatgagatatgatgcttcctatgaaggtatgttaacacatagagtgagtgcttgaaagtgtccaatctaacttcaggggtagatttgaaagggcaattttttaaaaagtgtccagtcccccttagtggcttcagtgtttatactgtggagccttgccagacttcttaggatcaaatcacagtttcctgagttcctttctatgggcttggctaggagctcttctcatttgtggacagttttgactaacctgtaattatatcgtgggcttaaaatctgtcatcaagattttaagccagatggcatgttctmcctttttttttattagctcagagtgaaaaatttttcagatgaattttcatagattcttctcctaactctatgaaatggtggtatatgaaaaagttcagtggtcagtaattaaaaattgctgaatgatattaagtatgaaacagacttccaattaattagaagattttgcagagttgtttaaccttaaaattcaagcattacttccttttttgaagttgtatttacaagcatttgatgtaatatatttaagtatttcttaattttccacaaggggtttatggtatgaaaaggtcagcatcctactaggaacagggtttagcagagcactgatagtgatttttaaagtgtggtccttttcctaggagtttctagttgggaaatgaaagaaaatgttgatagcaaacactcggaagaagggtcaagtcttgtatatctggacattggtataatactgcttgaaacctgaggacaaatatttgtgtttcacaggatcatgttctaattgagctcacccaggctggattgaaaggctccacagagggaagtgagagctatgaagaagatccctacttggtagttaacmctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctwctgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacasatggcattcattaaatcacaaagtatgttaaaggtcacaaaagcaaaataactgtctgaggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaacaagagtgaatactcaagtagatttgtcatgggatttttataagaagactggtatcaggtaatgtatctttaaagactaggctgctctgctgacgtagtaaccattttttattcctttactttcctaatagccttgctttcacttaagaaaaaaaaaggctaggcacggtggctcacgcctgtaatcccagcactttgggaggccaaggtgagtagatcacctgaggtcaggagttcgagacaagcctggccaacgtggagaaaacctgtctctactaaaagtacaaaaattagccaggcatggtggtgggcacctgtaatcccagctactcaggaggttgaggcaggagaattgcttgaacccaagaggtggaagttgcagtgagctgagatcatgccactgccctccagcttgggcggcaacaacaacaacaaaaaaagattcccaggcttcaccctctacagtctatggaaagtcatgggagtctattaaaaaaaaacagacactataaaccaaattaaaagatgggaaaatttttctatcacgttttaatatgtgatatccaaactcccattaagaatttttatatcagtaataagataaaactcagaagaaaaatgcccaattaacaagaagagcttcacctcttaaataatcagaaaaagaaaagcacataatatttacgtcaaagtatcaaaaatgtaaaagttttataataggcattagcaaggcagacggatacaggcacacatctaactctatgtaggatttaacttggaagacaatttgcatttcaatcaatcaaaaaccatttttttttttttgagatgatctccctgtgttgcccagactggcctcaagctcctgggcttgagcagtcctacagtctgagcctccaaaagtactggcaaaacaggcgtgattgaccatgcccagcctgtatataaggatattcatttgcagcattgtttgcaacacaaaaatgtaaaaccaaccggtgtttaatatgcaagatgttaatttatggtacattcttgctgtggaaagctatgcatctgttagaggtgggtctatatgttctgatacaggcagaactctaagagctattaagtgaagaaaaggctgaaaatacatatggcataattccatatatgttaaattgttctatattttaaatgttatacacgtttccatttgtatttacgtaataataatgatccctgagctgtactgttgtatacatgctacaagaaagacccatttaatccccacagcctatgatgaattatccacattctacaggtgacaaaatagaggcacaaagttaagtaatttttgtcaggtgagatttaaacccaggcattctgactcctgtataaccattaagatatgcagagaaagaaaactggaaagatacatattgctgaagatacttattataggaagaggaggggggagggtgaaggaatttgcaagtttttcatagatgtttccatattgtttgaatctcttacaaaatatgttcagcatatttttaaagagaaaatttggggcaaaatacttatttttgtattatgtaaacaaattttaaaataatgtgtggctgggtgcgctggctcacacctgtaatcccaacactttaggaggctgaggcaagaggattgcttgagcccaggagttcaagaccagcctgggtgacatggcaaaactccatctctactaaaaatacaaaaaattagccagtcgtggtggcgcacacctatggtcccacctacccaggatgctgagatgggaggatcacttgagcccaggaagtcaaggctgcaggaagctgtgatcgcaccactgcactcccacctgggcaacagagtgagacccggtcaccaaaaaacaaaaaaaaacaaaaaaaattggtaatcgttttcttcagacattttccgggttcctctgcttaacttgtataggaagtctgaggtttttgtgttggtctttaccttttttttttttttttttttttaagatggagtctcattctgttgcccaggctggagtgcagtggcatgatcttggctcctgcaacctccgcctcctgggttcaagtgattctcctgcctcagcctcctgagtagccgggactacaggcgcatgccacgatgcctggctaattttttgtatttttagtagagatggggtttcaccatgttagctaggacggtctcgatctcctgacctcgtgatccgcccacctcggcctcccaaagtgctggaattacaggtgtgagccaccacgcccggccctgatctttacatttttaaatattgcattagtgaaccgtgtactgattttgtgatcatagataacccagttaaatattaagtcttaattatcacttagtattttacaacctcagttgcagttataaagtaagggttccacatacctcctaacagttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggaagcacccagaatccagacgagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtcacaactccagaccctcagtgatgcccacagaaaagcctatgagatttaccacgaaagctatgcttttcagggtgagtacacattgacctgatggtgacccctcggcaaccttcatcacacaccttccccatcctccttagagcagattcgacatttctcccaactcaccttcagcagtcctcttatgtctgtgcatagggagaaattaatattgtaaattgatttcccactggcgataggaaggggtagctaacatggcaaaacactcagcatttcctttgaaaaatatctttgaggctcacgcctgtaatcctagcactttgggaggccgaggtgggcggatcacttgaagtcaggagttcgagaccagcctggccaatatggcaaaaccccgtctctactaaaaataccaaaattagccagggatggtagcaggcgcctgtgatcccagctactcgggaggcttaggcaggagaattgcttgaacccaggaggcagatgttgcagtgagccgaaatcatgccactgtactacagcctgtgcgacagagcaagacacaatctcaaaaaaaaaaaatatgtatatatatatatatatatatatatacacacatgtatctttgaaataccccttgcccagtcttgagttgtgcaagcactgattgtctttctgtcttcctttccgtctatgtcctgctaccctgacttggaggcaaagtttcgtggtttcctgtccttccccctcggctcccctatacttacatgtcttagttggagcttacattgcagcttgggagacagacaaatacaagatgaaacaattatatatcacaggatgaggagagcacaactgtaactgttcacattcctgcctcctaggggacttgaagttctgatctgtaggcctaggctgaaccaggacatttgtgattataatcaattccctaagtgtatgttaggtacaccaattttgagaatcaattttggattatatatgctttcttgtttttattatataccatatacatacatatttgtatatatagtacctgatatatatatatatatatatatatatatatatatatatatatatatacttctatgttctactttttcattttaacatagtttatgactatattctcattttattaaaaacttgagccaggcatggtggctcatgcctataatcccagcacgttaggaggccaaggcagggggattgcttgaggccaggagttggagaccagcctgggcaacatagagagccactatctctaaaataatataataatttactccagtgctggaatagtattgcttaaaacaaaagaaaaacttgaaagcataactttcaatggtcttttaggttcccattgtataaatggagcataaagtttaaggtattttccttatttttgtatgtttattctaattttcactagttacaagttatgttgcaatgacattcctatctataaactatttcccaccttctgataaattctttctgacagaatcttagaattgaaactactaggtgaaaagatctgcattctttaagattttaaagcatggtactaaattattttccagaaaagttgtaatcatttatacgaacagttataaaattactctctgaccccattctgtcagtttcaaatgctatattttattactaatttgacagctgaaaacagcttattttcatgtcttgttaatttgcatgtatttgattatagagacgttaaacatttttttcttcttctttttttttttttttttttttttttgagatggagtctcactcttttgtccaggctggagtgcagtggtgtgatctcggctcactgcaacctctgcctcccgagttcaagcaattctcctgcctcagccttcccagtagctgggattacaggcacgcaccaccacatctggctaatttttgtatttttagtagagatggggtttcaccgtgttggccaggctggactcaaacttctgatctcaggtgatccgcccgcctcggactcccaaaatgctgggattacaggcgtgagccaccacgcccggccttaaacaaaaaaataaaataaggccaggcgtggtggttcacgcttgtaatcccagcactttgggaggctgaggcaggcgggtcacaaggtcagaagatcgagaccatcctggctaacacggtgaaaccccatctctactaaaaatacaaaaaattagcgaggcgtggtagcacgtgtctgtagtcccagctactcaggaggctgaggcaggagaatcgcttgaacctgggaggcggaggttgcagtgagccgagactgcgccattgcactccagcctgggcgacagagcgagactctgtctcaaaaataaatgaaaaataaactaggacatcatagctgccttattcacaatagccaaaaggtggaagcaacccagatatccactgatggatgaatggataaacgagacgtggcatagacataaaatggaatattactccacatttattaaaaagggaagaaatcatcacatgctacaacatggatgaaccttgaggacattatgctatgtgaaataagccagacacaaaaagacaaacgctgtatgattccatgtataggaggaaactagagcagtcgaattcatggagagaggaaggagaatggcagaggccaggggctggggtaggggagaaatggagagctctttaatgggagtagaatttctgttcagaaaaatgaaaaagttctggagattggtt

SEQ ID NO: 10876 - DNA, 55403 bp, Homo sapiens
  misc_feature (1)...(55403): n = A,T,C or G, or insertion/deletion polymorphism (see Tables 1-2)
cctggctaatttttgtaattttagtagagatggggtttcacaatgttggccaggctgttctcgaactcctgacctcaagtgatctgccagcctcggcctcccaaagcgctgggattacagttgtgagccaccgtgtctggccacgttttatttatatttatttatttgtttatttattatttattttgagacggagtttcgctcttgtcacccaggctggagtgcaataatgcgatctcagctcactgcaacctcctcctcccgggttcaagtgattctcctgcctcagcctcctgagtagttggaactgtaggcgcccatcaacatgcctagctaatttttgtatttttagtagagacagggttttgccatgttggccaggctggtcttgaactcctacctcaggtgatccacctgcctcggcctcccaaagtgctgggattacaggcataagccaccacgcccagccagcattttaaaactccatattgctgacctgtttcctgcccactctgagccctccaggccattgcctcccctgtaccattttatttgtttgtttttttctcctttctgcatttctttccctccccaacttatttatttatttatttatttatttatttatttatttatttatttttgagaccaagtctcactctgttgcctaggctggagtgcggggtgtgatctcagctcactgtaacctccgcctcctggactcaagtgattctcatgcttcagcctcccgagtagctgggactataggcatgagccaccacgcctggctaatttctatattttttgtagaaacggggtttcatcatgtttgccaggctggccttcaactcctgacctcaggtgatccacctgtctcagcctcccaaagtgagccacggcgcccatcccccaaccaatttagattccatgttccatcacattgtttgttccattactaatctcctaaacttctttttcatttgttctttctcccactgcctagcacctaaaaccctggataaatccaagtctccactttctccacgcctgccctcagggattaagtgaccgctgaagaaaattacacaattgggcaaattcaagaccaccaatttcacagtcccttctgcactgtctggcacactgtgtttccctagtccacttgccctccaacactcaacactacttcaaaccttgtttccttgtactcaaggcgtcaatttccttacttccccccttactctcagcaaataacctctccttcaaggaaaaaaaagctaaagctttcacgtaaaatcttcctcaaattattgttttgaaatgtataaacatatttatgtctgtttttttaaataaacttatttatatctgaagttattttttcagccaggtgtggtgactcacgccagtaatcccagcactttgggaggctgaagtgggtggaatgcttgagctcaagagtttgagaccagcctgggcaacatggtgagaccctgtctctactaaaaatacaaaacaaaacaaaacaacaacaacaacaacaaaaatacataagttattttttctttcctctgtctgttaaaatgggaagggtatctcttctatctgcctgtattctagatcccaccccagattgtttagaatggtggtaattacaagaagcaagatccaacttccagtagcctaactagtgaggacagttactatctcacaaaacaagacatatggaggctgagtagtcccagggttggttcaggagctctgtgaggtcatcatagacacaagtgctttctagattccattctgccattcttagagcataagcaatgtctttcctcatggccacaagatggctgcagcagtacctggcatcatttgcatataaccacatccagcaaaggaagattgtgccttctttttttcctttttctttgagacggagtctcactctgtcgctcaggctggagtgccatggtgtgagcatggctcattgcaacttcaacctcctgggctcaagcaatccttccaccttagcctcctgaggactacaggcacacaccaccacacccggctaattttttctttttttatttttgtttttgttttttgttttttgtagaggcactcttactatgttgcccaggctggtctagaactcttggcctcaagcaatcctttcatctcagcctcccaacatgttgggattataggcatgagccactgcgcccaatctgtgctttcttctatgtgtcttttattaagaaagcttttcctggaagtagcccctcccacccccctacccttcctacaaggttttactggcttcaaggggaggttgaaaagcccagtatctggcaggttgctttgttgttgttgttgtttgagacagggcctcactctgtagcccaggctggagtgcagtgacgcaatctctgctcactgcaacctccgcctcccgggttcaagcgattctcatgcctcagcctcccaagtagctgggattacaggtgcatgccaccatggctggctaatttttgtatttttagtagagatggggtttcaccatgttggccaggctggtctcaaactcctgacctcaagtgatctgtctgcctcagtctcccaatgtgctgggattacaggagtgagctactgcacccagcagttttgcctctcagtagaaagtgaattctgtcaggaaggaataatagaaggcatggtagaagaatgactgctggatcggccatcaacagaatgtgctgtataccccattttccctcccatctccagaggggccttccattttcccatttgttcaatctaagaccagttcctttccactagcatttaattttatgcaaatctctcccatctttaaaaaggctgtcttttcaaatccaaattcctgtccagctaatgttcctttcttccttctcaccttcacactcactgactctttacctccccttacttttcaaccttttgccatctggcttctgtacacaagaaccatgagaattgctcttgctaagcttaaaatgacctctgtgttactaaaaacaatggacattttttagtctctcatcttaattgacccaacagcagcattccacaccactgcttctcctttcttaaaattctctctacccttggcttctttgatatcacacactctcccattttcttccaccaccccacactctgcctttcctgctgagtctcttttactggtttatactttttaatacaaccctataaacgttggaggccctaagacctcaatcatgctcgtgtctcacctcactttgcaccatctccctaagtgatggtatcgttatcttccagtgcctcattgatcccctgtatgtagataaatctcactttcctatctctagttaagaactgttatctgagctccaagactaatagctatctgcctacttaacactgcatgtgaatatctctctagtactccaaacacatgtttaatattgaactcacaccttcatgaacaacctccccaccatccttcacttctttcagtgttgcctatctcagtaccatcttctttacgattttgcaaggcagataccccaaatctctctctctctctttttttttagagacagggtcttgctctgtcgcccaagctggagtgcagtggtgcagtcatggctcggtgcagtcatggctcactgcagcctcaaactcctgggttcaagtgatcctcctgccttggcctcccaaagtgcttggattacaggcatgagctaacacacctggccacaaaatcccttcttgagtccttcttcctcaacctccacatgtaatcaacaaaatatattgggtctgtctccagaatatcaaaagcatccacttcactatctcccttatgttaatacatgaataagtacctcttacctggtctattcacattcagccattccacttcaaatccaatctattcaattgctatcatacaatttaaaaatggaagtcttatatgtatctgtttatttatttattttttgagatatagtcttgctctttcgcccaggctggtgggcagtggtgccatcttggctcactacaacctccacctcctaggttcaagcgattctcctgcctcagcctcctgagtagctgggattacaggcatgtgcaatcacgcccagctaatttttgtatttttagtagagatggggtttcaccacgttggtcaggctggtcttgaactgctgacctcatgatctgcccgcctcggcctcccaaagtgctgggattacaggcatgagccattgtgcctggccaactcttctgtttaaaatttttcaatggctccctgtaatccttagaaaaatgtcttaaaatttttaacatgattttcaagactctgtatcatctgatccttgcctagctttccagcctcacttgtaccacactcctctttctatgttatagccacactgggcattttttagttctgcaagtgcactgtgtttgcttgcttcagagcctcatgtggaatagccttctccttcacctacctagagttccccgacacgtcatttcctcatgaaggccctttctgactccactagcccatgttcggtcccatcctcatacacttctgtagcactctgaattacccttctgtgacatttatcatcactcataattacttattcaatgtctgtcttcctgactagactgtacagtcacaaagacagggccttcttctgactgcctcacctccttatcagtgccaggcacaatgcctagctcataaaagatgagtgataaacacttgacaaatgaatataaaactatgaaggattcttatttaattctaaaattagagataattaaagacatagctctattggaataatttctagattgatcaaatttccagaagtccattaaagttgatgttaaaggtcaattctaatttttctgtaggattgttgtcctatagaagcaactgtccctaatcagcattatgtctcagtttataataacactatatacgagaggcctgattgggaaaaaaagtacaaaaatcggagtgcaaataattagctatttttagggaaaatatctgtaggaaaggtggtatattcagatgtatcacttcctttatcttgcaaagattgtcagatagatgtactgctggaggataaatttaattgatgtagaatttaacataatagtatatgcaactttaaataaaccatgcaagcctttagctaatagttattacagaccatgtgatttcatgaaagtattaaatatggatcagttttcatttaatggcagccaatcacaaagcgccacatcttgattataggacattctcccagaaaattggaaaataaatcactatctagtctcttttgtattaccatggaaagtagctggaaaagaaataatctattctctgctttgtgttactttaaaaagtagctgtggcaatagcctaacgcgttttgaagttttgaaatgatctctatccagtgtctaggaaattgctgaaggcctgcgttctaccaattcctccgcttaggcacatggactacaggttattaaagaaggtgacttgcggtttttatcccgtttttctgcaaggttgggctacgttcagaagaaatcaaagcctcggagttaatcccgacaaagcccatttagttccatgcgaggactatttcctccacactgagagtctcaacgaggccgagaatagcatatgccagttggagtgacacttatttctccctctcccctttatagaatgtgtagtggccctcactactgccccctttagctgtgcctcagaacccacagttacatgctccacaatatggaggcgaataagcctaagtggactacaattcccatcatgcctcactgcaggcgccgccgacgtgtcttagcggttagtcatccctcttaccgccttcctccacttcctggactgcgcgaccggaggcctagcgggcgcgcgsccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgaaggaggcaggggttcgagaggcggccgggacacccctccggcctaccttcatcctcttgtatacctcagccgccggcccgccctccccgagacgcgggctcctgtcggctcgcacaattgccactactaccccgcgccccagggacggctgcgactccgccgccagatcccccagaggggccatgcagaccctcagcgccctgctccttcaggccccgggcgcccccagcctttcctcagtgtctgcgaggcccgggctgccggcccgtggctgttcagcgcctccccggttcgtttgagatacagtgggcctggccccaccgctgcgtctcccggcagccgggccggaggcaccgtctggccctggtctccaaagcgccccgaggcccgccgaaatctccccgctcggggcgacggacgcggccaacaggccccagccgcccagccccgctcgtcgccccgagcctctcccctgcgcagccagacccccgcgaccctctccctgacgtccctctctgtcaccaaggaccctctttgtgctgcttgaacgcccgtttcgttactgctgtttagatggaggtaggaacgggccattaggcaagcagttgggttgtaattagttgtggactgtcgggaagaaagctgtgtcatcgataagcaacaaagagaaaccacctgatgttcacggttactggtgttagtacgttcctgaaacgtaaacttttgagctgaatagaggtttaatttttcttaatggcagtcttggtaggggatctagtgtgaaataatgtaagtttaaaaaaaatccattagtttcaaagaaaatagacgttcagtccttggtttcttccctttgttgtcttcttaggctaaaatctacacgactttgagaacgtttattaactcatatattctctgttgctctaggctattttgctccatattctcctgttttattactgaaatcttgtagatttacagtgaactccctgcctctacggttctgctcattctcattacatggaccaaatcaatgtttgtggctgttgttaatttgaggtgtatttcttcaactatttgtgtttaataacggtttattcataattaactcgtcttttaatagctctataactttatgcactgcagtgaagaacgaattactgaaatgtgaatgtcatttagcattaaatttggaatttataattgttttgttacgccaagtttttagctcaatgctgtttattagaagagcttgaatagtttagattctgtgatgctgtctgggggttatattatactttacataaattaattctgtaatcccgtaaggaaaaaaatggattgaaaatgaaaggaaaagtaaatgacactatgcttattgtgtacattagtaggtttttgacattttaaattgtttttctcctaatatctcagttgatccttgcagtaaatagaacaggtttaattatccccattttatagatgaggcacttaggtcagcagtcataaagtgacttgcactagggccacaaaaaggatttacatgtcttaacagtcaaattttttagtagcttcaaaaaaactggcttttttgtttcttaaggaaaaaactgaacaatttgtaaattggtgatttaaattggtatagaaatcagaaatttggattatggtagtcatgtttttgaacaaatgtccaaacattcctagaaggcactcttgaggtaaatcagttaatttaaaaaaagaaacgagagatttttattaacaaatattaatatttggaaactctagtacaaattattggaatagttaaataaagttataggtcttgcctttcggggttttgtgtatatatatatatactttcttcaattaagtttttactgatgagcatgtattacatgtatttagaatataatgactcttgaatgtttgcaggaagactgttagcaatctcacaaaggagtctctgtctgtcccttgacctgttccaaaatccagctagcttttttagagctttagccagttaatccccaagactaagtaggattagtgtcactctaggagtatgtagatactggactcatgaaaccaaaacacttacagattgcttagagctttcttcataactctgaagtcagaacttgtgattttcttaggtctaagatctcagtaataatataccaacttaatggaaaatttgaaagatgtctttatagttggaagacgtgatctcaagagtacactttggttcatggaactgttcaagtgggaaacgttttaggcaagtggtctttagttagtgacattttcatggatgaattaaagaatattgtagagttgatgttaggagacgagagattactactacttcagctaacaaattaatatgattttcaaagtattgtggctgtgtaaagtaagtgaaacaaaacgatattcatttaatacttgggaaggtagaataatctgacgagactgaagtaaaggtatctgttcactggctaatgttgctaggtaggtaggccaaactttgttaatgatagacgccattttctgccttttttggtgaatgtagaccacagaagcctttaggttttgagcagttgagattttttttacatcggaaagactggctgtatgagggtctgcaactctttgcttctgagttcgtgttgctctctttaagtgccttcgcttaggatactgccgatacaaaggatatgctgttttctcctaaaatcttaggcccacctaactttatagttgataatttgattaaaaataagaaatgaaagataccagagttagcaatcagtcatcccactcagtagtattaggaaagttgtcattaagcattgagtaattccattcagctttccaccactgctgttcaagcagctgctgccaccactaggctgagtctaggacagacactgccagtagggttgagacatctgggaccctaatcacatggtacagtataggtgagggagtgatgcaccagcctcacaagaagcaagatttatactttcagctacttacgtgatatcactgtttagatcctcccaggattctcaagcctaaacgtgtaagtgctgcctaaacctgtgtttctcccagtgttctgcatctgattggcactaccatacatctggttggataaaccataaatatgagagtcatctttgactcttaactcttcagtstcttcttgagctccggattgttcacaacattccaaatcacataggcctttccctacacacgtattccttctgcgtggtgaactcttctggctgttggcatggctgagctctcttatcctttagattttagcttaactgtcacctcagagagggcttctctgaccattataaagagttctcttgttattttctctcatagatttctttttagtagcatttattactgtaattacgtatagtgtctatttgtttaaaaattttgtataccattagattttaagctctgttgaaggcagacaatgtctcatttggtttatatttagtatacagttcaatgcctagaacaaaataaatgcaataaaatrgtgaacatataaaagaatgaatggaaaggatttctcattcttcacagccttctctgagaagggttcgtagtaagaatattctcatatacttatttttctttggtaggtgagtcatttatttggaatcttaatctctcctcatcagatggtttctgaagatgcatttagagtgatctcacttgcaaatagtaacttctcgttattttgcatcttcaacatctaggagtctgctaatggagcattcttaatggagcatttggtctgtggatgcattctagtcccgtttactttttttttttttttttttttgagatggagtctcactctgccgccaggctggagtacagtggtgcaatctcggctcactacaacctccacttccctggttcaagcgattctcctgcctcagcctcctgagtagctgggactacaggtgtgtgtcaccacgcacagctaatttttgtatttttagtagagacggggtttcaccgtgttggccgggatgatctagatctcttgacctcgtgatccgtccgcctaagcctcacaaagtgagccaccgtgcccgaccccgtttacttttccatggtcaaatttctcaaactcctatttctggtattcctgaatctcatctcacaaaatatatgcaaataaacagcattagagtcaattattataggcatgccatcatacttactatattaggcatttagctattccacagagtacttattgggtgcctactatgttttgtagagattttagtcttgtcagtaaataaaatggaaccaatccttgccttcatggaaccttcattctagttaggggagacagatactagtaaacataattaaaaatgcatagtatattggaaggtgaaagtaatacagaaaaacaacaggagataagggagctttgggaatgtctcaagagtgtaattttaaagtaagtgagtaggagagttgtaatattaaagtgggtgattaagtatcagctttattgagctgatatttgagcaaagttttaagggagttggaagttaaccatgtagttatctgggggaagaacattccaggcagaggaaacaactagtacaaagaccttatggctgaagtgtctttcatatttgaggaatagaaggaaaaagaatagcaagaaaggaaaaaggaatgaggtcacagaggtagttggagtcctgatgtatggggccttcaagcgccctgtaaggactttggcttttactttgaggaaaatggggagccattgtgtgatctaagcagagggttgatgtgatctttttttttttagagaaagttgctgtgttaagaatagacttagcaggaagaccaatttggaggcttttactaggcttccaggtgagatgtgatagcttggatcagggtagttagtagtggaagtggtaagaaagttacattcttgatttattttggagctggagtcagttacaatcaaggaaaactagttttttggcctgagaactggaaggatggagttaccataaacgaataactgcaatgaggaaggccaaagtggattaaattgtcctggccaacatagtgaaaccccatctctactaaaaatacaaaaaaattagctgggcgtggtggcgggcacctgtaattccagctgctcaggaggctgaggcaggagaatcgcttgaacccgggaggcagagattgcaatgagccaagattgcaccattgcactacaacctgagcgacaagagtgaaactccatctcaaaaaaaaaaaaaaaaaaaagatacagaacgttttcagcattccagaaggctccttcatgctctatcaaggtagccactatactgaattctatcaccatagattagttataggttagcataccttttataattagcatacctacaataaaaggcaagtctaaaattgcaaacagaattgtacctgcctctgtctaccttggattaattttggagtataaatgctgtggagtggagatgttgaactcaacagaaaggtgccacataaaggacagatatcaaactttttatttttctctctctctagacggtctcactgtgtcacccaggctggagtgcagtggtgcaatctccgctcactgcaacttccaccttccgagtgcaagcaattctcctgcctcagcctcctatgtaggtgggattacaggcatgcgccaccacacctggctaagtagagatggggttttaccgtgttggccagtctggtctcgaattcctggcctcaggtgatctacccgcctcagcctcccaaagtgctgagattataggcgtgagccaccgagcccagcccacaacttttattttaataaaatcttatgtacaaaagcccaaataggcactgcactgatgactgcttattattgtggtactttgcgcatcataatttagatggcttcttttatgaaatattttgtatcatttaaatagtccagtgtagttkgttttcattgctcttcatgatgtgaactgtgtatgcagtcacacttttcatttagtggaaaattcagttttcaaatttggcagaaagtggtataggtgggattatattttatttgaggtttccgttttccaggggaaaagagtttgcaatcagcagatcccagcctggtataagaatttttgaaatgttttacaggtgatgatgaacagtctacacagatggctgcaagttgggaagatgataaagttacagaagcatcttcaaacagttttgttgctattaaaatcgataccaaaaggtttgtttatgttttaatattttattaattttaaaatttataagtattgtctttgatttatagtgatactcttggactagaagaatgttgatgttgggctgggcactcccagcactttgggagactgaggtgggaggatcgcttgagcccaggagttagaggctagcctgggcaacatagtgagaccctgtctctataaaaaataataataaaattaggagtgtggtgtgtgcctttggtcctgctacttgggaggctgaggggaggatcacttgatccctgaagactggggctacagtgagctgtgatcatgccactgcactccagcctgggtgacagagtcaaactctgtctcaaaaaaaaaaaaaaaagaatataggccaggcacagtggctcatgcctgtaatcccagaactttgggaggccaagacaggcagatcacttgaggtcaggagtttgagaccagtctgggcaacacagtgagaccttgtctctactaaaaaaaaaaatacaaaaattagccgggtgtggtggcacacgcctgtaatcccagctactcggggggctgaggtaagaggatcacttgagcccaggaggttgaagttgaggctgcagttagcagtgactgcaccactgcactatagcctgggcgagagagcaagactatctcaaaaaaaaaaaaagaatgtttatgctatgtttttgggtatctaaggcatattaggaacttaaattctgactgccgtttgctaaattcatcatgaatcctgctgaaaaaactttaagctttcctactctaccaagcagccatctaacatgtaccaggaatgcaaaaagaacagtcatctccagcttctaaaaacttggaagtaatggtaaatcatacattgaatatctctgagaggttgatcacttactgtcttgaatcctatttttgggaatggagtcatttaatcagtggaaataaggacatttataggttcctcacagtacctgatgtccacaagtctattttgtttctccgttcctcctccccatcttttaaaaaaatttttattataggaagtttcaaacatatatgaaagtaatgtaacagtgtgatgtaccccatgtacttgtctactagctttggtaattaactcatggtcagtcttgtttcatctatacctccacccatttccactcaatccaaataattttgaaacaaatcacagtcactgtatcacttcatctataaatattttagtatgtctctgaagtataagtattgttaattttttaagcataactataatattaatacttcacaaactaataataattctttaatatcaaataaccagccagtgttcgacttttcagttgtctcatcaaagtcatagttttattactttattgcagttttttagttcaaaattattcaagggccacacattaggaagcattgatttctctcagtatgtaggcttctcctccaactcccctgctccttggaatttatattttaaagacaccaggtcatttgttctatacatttgttctgtggtttcctacagtatggattttgttgactgcaatgtgttagtgtcaagttggttctttcctgttttctgtattgataggtagattcaggtttgtttcccctcccctcatcctgtcctaagactacttcataggtagtgatgtgtcttccatcagaagacagataataccctgttttctctctttatgatgttagcagctatcagtgatcattacctaaaaacattattatttatttttttctttgaagcaggatttcactatgttgcccaggctggtcttaaaatattggactgaagagatcctcccatgtcagcctcccaaatagctgtagttacaggcatgcttcactgtgcctggtgctgaaaacattaattcattagcacttacaaagtggtattcctgtctttttgatattgatactatcagaatgaataatgtgtttgaaaatcactgtcaagattaaagcattcagaaatttctactcgggaggctgaggcaggagaatgctgtgaacccgggaggcagagcttgcagtgagccgagattgcaccactgcactccagcctgggcaacagagcaagactccgtctcaaaaaaaataaaaataaaaataaaaaaataaattcagaaatttgcctataagtttgtaaactttatgtaaaaattttctgtgtttacaaaaacatcaagtcgtagtatagcctgtctcacaacagttactgaactatgtatttactgagtagtttttaaaaaacagaatctgtcaatttaagtatatctttttttttttattgttcatcaccttcctgaagcacctttgagagttggcagtggcaagaagaatatagggatttatagggaatgtgcaatacatgagaattccagaattcttgagattgtatacagactgatgtgtctggcttttttttttttttttttttttttttttttttttttttgagacggagtcttgctctgtcgcccaggctggagtgcagtggcgtgatctcggctcactgcaagctccgcctcccgggttcacgccattctcctgcctcagcctcccgagtagctgggactgcaggtgcccgccaccatgcccggctaatttttttttttttttttgtatttttagtagagacggggtttcaccatggtctcgatctcctgacctcgtgatccgcccgcctcagcctcccaaagtgctgggattacaggtatgagccactgtgcccggccgtgtctggcatttttaaaaataaattacttttttttattttttattttttttgagacggagtctcgctctgtagcccaggctggagtgcagtaacgtgatcttggctcactgcaagctccgcctcccgggctcacggcattctcctgcctcagcctcccaagtagctgggactataggcgcccaccaccatgcctggctaatttttaaaatagttttagtagagatggggtttcacagtgttagccaggatggtctcgatctcctgacctcgtgatccacctgccccggcctcccaaagtgctgggattacaggtgtgagccatcgtgcctggccttaaaaacaaatttctattagcagatgcagggatacctgcatatagtgatggttcatgtttgtttcactgtagactgcatgctgatagaatctagtgtgcctttaaattatggaaaataaattttctttatttcataataactaagtcacccaatgttttgggaacattttagtgtgtatgtatttttggagatagcgtgcattgaaaatagattagtaggaaatgcgtaaaaagtttacaattatttctgaaatggtaggattttgggtaattttttttcttgattttttactatgtttttaaatgtttttatgataataatgctttatatttgagggaaaaaagcaaattctagttcttagaagcatttgtttgattattggaagcatctacattgatgagtatctcttactaatcttataaattctctctcccatccctgaccactcagctcccttctctggagggaaccaaatcaagaaaatatatttatgtttgttttccttccatgttttacaaaaatagtattaatagcattttgacatacttttctatacctttttcttttctttttttttgagacagagtctcacattgtaccctgagctggagtgcaatggcatgatctcggctcactgcaacctccgcctcctgggttcatgcagttctcctgtgtcagcctcccgagtagctgggattacaggtgcacaccaccacacccagctaattttttgtattttcagtagagagggagtttcactatgttggccagactggactcgaactcctgacctcataatccacttgcctcggcctcccaaagtgctgggattacaggcgtgagccaccacgccaggccaatttttgtatttttagtagagacagggtttcgccatgttggccaggctggtcacgaactcctgacctcgtgtccacctgccttgacctcccaaagtgctgggattacagatgtgatccacagtgctggcctgcctttttttgtgattgcataattattcagtttttattggtagatagattgcttttaatcctttgttattatagagtattacattatcacatgcctaagtaagtcgtaggccttatgtcttcgtgttccaggttaagatattgtattcaggtatacttgtctgctgaggaagcagcatggcagataccaaattaattttttagctaccagatgcagccactagcttgtgggttgtaagagcaaatagttctttctcttttgagatgaagtctcactctgttgcccaggctggagtgcagtggcgcgatcttggctcactgcaacctctgcctaccaggttcaagcgattctcttgcctcagcctcctgagtagccgggattacaggtgtgtgccaccacgccgagctaatttttgcatttttagtagagaccagatttcaccatgttggccaggctggtctcaactactgactttgtgattcacccgccttggcctcccaaagtgcttggattatacctgtgagctaccacgcccggcctttttttttttttttttttttgagacagagttttgctcttgttgcccaggctggagtgcaatggtgcaatcttggctcactgaaacttccacctcctgggttcaagcgattctcctgcctcagcctcccaagtagctgggattacaggcacttgccacaatgcccagctaatttttgtatttttagtagagacggggtttcgccatgttggccaggctggtctcgaactcttgatctcaagtgatctgcctgcctcggcctcccaaaatgctgggattacaggcatgagccaccatgccaagccacaaataattctttcatttgaaaattataaaacaaaccagaaaaagtcttaatgaaataagaattatatttttctccttcaacctgattgctgtgaaagaaactggtagttgcaggaaaatacttgtgattggtacagtaaattttattaaaacaactcagtatttagaaaatacttgcattcatctagtgattttgtttgattttgttttacagtgaagcctgcctacagttttcacaaatctgtatcctttcagtaaagaatggcttatatatatacatttatttaccttccttttggttaatttatgaaatttagaaattattcatttttatttaggaaatcatacattcttttttatggaaactttattactaagtgtcctcatttaaaaaaaatgttattataggaaatttcaaacatatataaaagtaactcaatggtgtagtgcaccccatacattgagataatatattgcagctaaagataggatagggagtttttaaaatgtgaatatctgaaaaacaatatagatcagttgggttggaatgttacaagtagcttgcaagaggcagctggcagcaagatggatagaaaaggaagttatgatagaggagaatgtagtagattcttcactagaatatacctcataaattaacatgtcacatgtattaatactacrggtataatgatgcagtacttgaaattatttaataaatgttagattatattgtgaaaatcacaaagatcatttgttttcctttgttaccaatagtgtttcgtaaaactatcctttcgtttcacatgaattgttagacttcattaaactgtacagatcctgtagtgtgtgttccatccagtttctttattggagacagtggaattcccttggaagtaatagcaggaagtgtttctgcagatgarcttgttacaagaattcacaaggtccgacaggtaagaaggaacagaactgttgtttccgtaaatggtacgtcaggaattggatttttttttttgagatggagtctcgttctgtcgcccaggctggagtgcagtgstgtgatctcagctcaagtgcagcctccgcctcccaggttcaagtgattctcctgccccagcctcccaagtagctgggattacaggcacctgccaccacactgagctgatttttgtatttttagtagagacagggtttcmccatgttggccaggctggtctcaaactcctgacctcaggtgatctgcccgcctcrgcctcccaaagtgctgagattacaggtgtgagccaccgcacccttcctaacattggaatatttttggagcccctctgtatattcaggaaactgccatgccaaaaatcttaaaaggtagtaagtactgtctttgtcacctgtttttgtaaatagcatgaagttacaggtgccagtagccagtacctaatacttgactgacttctttacctttctttatttttttatttttttgagatggagtctctgttgcccaggctggagtgcagtggactgatctcagctcactgcaatctctacctcccgggttcgagcgatttttctgcctcagcctccccagtggtgggattacaggcgcatgccaccatgcccagctaatttttgcatttttagtagagacgggattttgccatgttggccaggctggtcttgaactcctgacctcaagtgatctgcccgccttgacctcccaaagtgctgggattacaggcatgagccaccacacctagccatcttttaccccagtctcaacacataatgaatatcaccataactttgttgaaagagaaagttgctgtcatattaaggctctaactatatattgcttaatatattttaaggacgttatactcaataattaatcatttctgtctactttggacaaatggctggtagaagtttgtaacttttttctttgaattctaatttgagggaaaatcaatagtgtgctttaacaaatgtttttatggtcttgccagcttgcaggtaaattccataatgtgattatatcatacttaggattatacattttggattcatctatttatgagcatttcgtatttctctttttatagagtataaatcaacctgtattttggtctctactgccatggtaagtttagattcttatctattaattaaaatccaatttattttctgcctagatrcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggtaacttttaatgtacctttttgagtgcartagaagctccttcactacattttaatatttaaatattaatattttaaaaatatattgtatgtatttttcttcacatttatttaacttaaaatttaagagtcatattaaatacacatgtgtcatttagtggcagaagacaataaagtcagtgaatgtcagctcaactcccaaatagtcaacaatccagagcaattgatttataatttctgctattgcgctgcatgcttcaaggaatgtcatgacactgagcagttttataaatctcttactagcctagagaatttggaaagtttcaaatgaactaaagtattatatttggaattgtttctataacatgtaaaaagctatataaatttaagagaatagtgttatatatattttttttgattagaggtaaaagataattatgaaatagagcttgtagaagtaagaggtgtgactgtaaactcattgatagaaaaggcaaaagagaaatttttgggattgtggttggagttgtttggtgtaatatagctttgtattaggcaaccgaggggtaaataaatcaagatgttaggatattagtgtcctaaaagatgaatctactccagcatcccacacaaataatcatcaagcttctatttgaatgcattcaatgatgggaagctcattaccttgctaggaagcctgttctgttgttgaacagctctagtttttagaaagagtcttccttatattgagctgaaatttgatgccccataacttcctgttaacattaatgctgccttgtggagttacacatgacaggttttgaatatttgaaatacagctatttgtctcattttgaggttttacatcggatggatcattcaacttctggatgtgtacggaacggggggactctattatggatgttcatttaggtctacgacagaataattactttaattgtatttacctggatatatatcatttccaaaattcttcattccattttgaagatagacacatgtttccctctggtataatattctttcagcctgaaaattttcctttagcattacttattgtacaggtctggagttttctttatgtgaaatgactttgttttatcttcattctggaaggatatttttgctggatataaaaatttttgtttacagttacaggtattgtccaccgtcttctggtcttcatagtgttctaatgagaagtctccacaaattctgattgttcccccctgtaaggagtatgttgcttttctctggctgctttcaggatttctttctttctttggtttttagcaatttgactgtgatatgcctaagtgtatttttctttgtatttatcctgtgtttggtttgcctagtttcttacatctgtaaatgtgtgactttcaccaagtttgggaattttggtccatatatcttgctggaatgaattacatgtatattaggcttcatggtattgtcccacaggtttattttttcacacttattttttcttctttggattggataattctgttgatctgcaagttcactgactctttatcatctccattctgatgttaagcccatccagtgaattttttattttagataaaattatgttatacattttttagttgtaggatttctatttctttctctcttattataactttttattttgaaatagtttgactcataagttacagaagttgtgcagaatgagtactcttcatctacgttttattcttttaattcatttcaagtgtatttcccttttcctcatttgagttataatggctgctttaaagtctttgtctgacagtttcaatatctagctcatctgaggattggcttgtgttgatcacctttaccctttagaatgggtcacattttcttgtttgttcatatgtcaaaaaatgctggattgtatcttgtacattgttgtagacactctggatttcattatattcctgcaaagagtgttgtttttgttttagtagacaattaacttggctagactaaaactgcaagctctggcttacctgaggtgagtagcagctctaatctcagtttttttttagcttaaaaaaaatttttttttttttttggtcaggtgtggttgttcacacctataatcccagcactttgagaggccaaggtgggcagattgcttaagcccaggagtttgagacccgcctggacaacacggcaaaactctgtctctacaaaaatgtgtctgcagggtctggctctgtcacccaggctggagtgcagtggcacaaacatagctcactataatctccaactcctggcccacgtgatctcctgcttcagccacctgagtagctaggactacaggtgtgcaccaccacacctggctaattttttttttttttttgagatggaattttggtcttgttgcccaagctggagtgcaatggcacaatcttggctcaccacaacctccatctcctaggttcaagcgattctcctgcctcagcctgctgagtagctgggattacaggcatgcgccaccatgcctggctaattttgtatttttagtagggacggggtttctccatgttgatcaggctggtctcaatctcctgacctcaggtgatctgcttgccttggcctcccaaagtgctgggattataggtatgagccaccacgcccagcctaattttttaattatattctttgcagagatggggtctcactatgttgcttaggctgtctcaaactcctgtcctccagtaatcctcctgccttgccctctgaaagtgctgggattacaggcatgagtcattggatccaggcctgtagctttttaaaactatttattatggaaaatttcaaacatacatagaagtagaaaaaaatagtataagaaaaccccattaatccattgcctagcttcatggccaatattctcatctgtgccctccactcctcttctttttcaacttatttagaacaaatctcaggtaaaatatttcaatatgtatctctaaaatataagaaaggaatataaatcttttaagattatatatagttgccttttaaaataattttttttttttgagacagagtctcactttgttggccaggctgcagtgcagtggcgtgatctcggctcactgcaacctccacttcccaggttcaagtgattctcctgtctcagcctcccgagtagctgggactacaggcgtgcaccaccatgcccggctaatttttgtatttttagtagagacggggtttcaccatgttggccaggctggcctcgaactcctgacctcaggtgatacgcctgcctcagctcccaaagtgctgggattgtaggcgtaagccactgcgcccagccaaaataaattttaattatggaaatttgcaagcatattctaaagtagagagaacagaataacgaactcgaggtactcatcatcctgcgtcagtgattcccattatttgctcggtttttgttwtctgtctccctatatgaccacccttccaggttattttgaagcaaatctcaggcatttgtatgatttcatcttttaaaatatcaatatctaaaagataagaaatttttaaaaataacaacaatactattatcaaagccagaaagcttaatagtaatcctttttgtcatcaattatctaggcaatatttatattatactttttttcagtttgagttacagttcgatatattgctattggttgatgtgtttttaaatttaatatatagatttctgctctccctggtagtttttcctatagttttccacagtctggattttactgcatccccatggaattgtgtaagatgttcctctatcccctttattcctctaaattggtaaagctacagacttgatcaagtcagcttcattattctttttgacaagactactttgtagatgatgatgtatatttctctcaggagatacattatgcctgttattccagttggctttttaagcctaaaggcggaacttctcaatacatttttattatatttggatttttatcagttgttttagcttattgaggtgttttttcaatccagaattttttttttttttttttttttgagacagtctcgctctgtctcccaggctggagtgcagtggcgctatcttggctcactgcagcctccacctcccaaattcaagtgattcttctacctcagccttccaagtagccgggattataggcacccgcaaccatgcccagctgattttgtatttttagtagtgatgaggtttcaccatgttggccagactggtctcaaactcctgacctcaaatgatccacctgcctcggcctcccaaagtgctgggactacaggtgtgagccaccatacccgacctagaatttttcatttaggaattagcagttaaatatgagtgttaataagctatttcacacaattttgggtcacccataaagttacacatgggccaggtacaatggctcatgcctgtgatcccagtactttaggaggccaagatcagttgagctcaggagttcgagaccagcctcggcagtgtgacaaaacccagtctccatacaaaatacaaaaattagccaggcatggtagcgtgcactggtggccccagctactagggagggtgaagtaggaagatggcttgatcccaggaggcggaggttgcagtgagccaagatcatgccactgctctccagcctgggcaacaaagctagaccatgtctcaaaaaaaaaaagttacaaatttatattttacatcttcaagtcatttatgaaataccaaaggcagagaactctgtgacatacaattggaaatcttcctctatatgacatctttccatttctctttaattatgagtcatagattcacctaactgtactcttattcaacacttttcccccagcttgtccacaggttatcttcataagatgttaaatttttgctgataataagacatgtcctcagcatttattttatttgctaaagaaaggtggttaatttcctattgagcctctactggctgctagtggttaccacttcttatccaagagttgcattcagtgatacactggtaaacatttatcagaaggatctgtggaagcaaaggcccatatttgtagtatttgctaatttcccaggtgtaaatactcccactttgttgatttcaagctacctaggttatgcccctgaatggggagggagaagagatatgcaccatcgtctctacttagtcatactaattatttttactactactgtagtaacgaaaatgcttaccatgtgccagtctcagttaagttctaagcattttacttgtattaacacgtatttcttataacaaccgtgtgaggttactatccccattttactgatgagatacagaggtattaaggaacttactgaaatgactgtgtggctccagagtccttgttcgccaaagactgtaaagaagaatcaggttggtggcaagttgtaaggaagggaatgacagaggtcttgtagaataggctaggacaaaagtctatctttcaggaaatccttcaaagaaaactagcataaagaggctctctaaggaaccactctggtcagcagaagcagattccttggaccagtgtaagtccagagccatacccaggatcaaacctggcctgtattgctcactgctcaatagccacagccacattttaattaaaattaattacaactaaaatttgtccctcacttggcagtaacctcattttagatgttcaacagccgcttgtctagtggctgctgtgttagacagtatagatattggagggcactgctctagagtgaaggctacccatagccaggcatgcctcctgccagattgttattcatgttttacatctgacctttaccttggtgattttaactcggtaactgctttatttctatttgtgaacaattttatccacgtctaaactttaggattagtaatagcatatttagctccttctccatttttagggaaaatatataatgcttaagatataaaattattaacagatgctataatctgaaagatttattcctttaaaaagttgcattaaatgcagtattcttatttctttttatttaataattaaggaggagaaagtgcaggccatgccacttcctctcaggagcctagtggatgctcagatcagagacctgcagaggacctcaacatccgagtggaaaggtttgctcttctttttgcaaatagcattttgtttaaaaagacagtggttttcagttatttcattaatttgaattaaagctaaagttatacaaatgaagttttagaattctgagttgaaatttttgatcacctaactaatttgtatccataaacattacactctaagtgtaaagttttcatgtatgtctgaagtcaccagtcagcttttggtctgatcattctaagaatcccctttttaatggtattttggtacatgggtgtttccatctgtcacttctgcttttatctctatgccataaggataataagctccagatgggcaagaacttcagcttatttcatgactatgtactgagcttaagttctgcataagtgggtgtctactaagtggcatttttcattagttggtctaataatcagatacaaatttctggctctttgtagtttctagtatttttaatgatacagtaattgtcaaatcatagtcttttatgctgtgattcctacatgagttaataattagtggttaagcgggaatattttaaaccctgatttaaacccctttagcgttagttatatggaagtttaaaaaaattccttagcatttaaaaatttttttaaaaaaaccttccttagagagacttgatattttcttgttcacatagatgcttcggggaaacagggttcaaagtgattgctgatattgtctttgagtttgcttgtgactcagtaaagatcagcttcttttcagcaaaacctagattctgattgttctttgtaggggaaggggcagtgcccagaccttgaggtgaaaagcaggctggacctcacagtggtgaggaaagtggtataagcctagaagaatagcagcaggaaacttaagttcccaagggttcatcctgttttgcttctttctgatttgctaacaccaggcccactactctgtacctttatttgcaccactctgggctgaagtgaaaataaaaaatctggaaaagggtttggagacttggggcaaaaacctgaattacatcaggtagccctttattttgaggtggggtcaggcgctatttagttatactggaaaaagtttttaatagcctccattcttatgtaggggaatgtcagctagtgtctgcctgtgtcatagtactaattaattcacaagctgagatcctgcattttattcatctgcgttcatgccaaattaggaatcttgttccttttgtggaatctgattcattgacaatgacaataactaataacaccagcgtatgtaatattcccattccaaatgtccacttagctcattatttataccctaagagttgccatcgttctcaccatcccctgccatagactgtgaagctcttgtgccctcaactaactcatcccctgccatcttttgcagggtattgaactgtgaaactactagtttccctgtctctctgaactgaagtgctttttctcagcctggttaagttggacccatcagtccctgttgtgtaatctgatattttagaattatatgaagttctataaagcaaaattcatgcatttttctctgaccttgatggtattttaaaatctatttcatacaaattaaaaattcagagttaaaatttggcaggggctgtgagtggtggctcacgcctgtaatcccagcactttgggaggctgagacaggtggtttgcttgagcccagaaaatagagaccagcctgggcaacatggcaaaaccccatctctacaaaaaaatacaaaaattaattgggtgaggtggtgcacacctgtagtcccagctactcaggaggctgaggtgggaggatcacctgagcccaggaggtcaaggctgcagtgagccatgatcacaccactgtactccagcctgagtgacagagcaagactctgtctcaaaaagtaaataaataagaccaggcatggtggatcacgcctgtagtcccagcactttgagaggctgagatgggtggatcatttgaggccgggagttcaagaccagcctggccaacgtggcgaaaccctgtctctactagaaaaatacaaaaattagctgggcatggcacgcatctgtagtcccagctactcaggaggttgaggcaggaaaattgcttgaacccgggatgcagaggttgcagtgagccaaggtcatgccactacactccagcctgggtgacagagtgctactccgtctcaaaataaataaaataaaataaaataaaaaataaagcaggatggattagcaaatgtaagattcttactttcctctcaggctacagttgaaactgagatctatttccaaagaccatgtttttggaaaactaattactgtagttgactttaagtcttaggcttttttctcatctagcttcaaagaaaactaattttgttaagggaaagggtgactaaatcaaattgacattagtgagaaattcatcctatcttgtacataagaacatagtccttcaatcttgagctgcattttgtcaagtaaacataattaaaaaaaaacggattggtgatttgaaattgtgagatctaagtttttatttttaatattaatggatatacaatggttatttatttatttatgaggcagagtcttgccctgttgcccaggctggagtgcagtggcatgatcttggctcactgtagcctctgactcccgggttccagcgattctcctgcctcagcctcccaagtagctgggattacaggcatgcaccaccacacccggctaatttttaaaatatttttagtagcaacagggtttcgccatgttggctgggctggtcttgaacttctgacttcaggtcatctgctcaccttggcctcccaaagtgctgggattacaggtgtgagccacagcacctcgcctgtgatggttttttgtttktttgtttttgagatgaagtctggctctgttgccaggctggagtgcagtgacatgatctcggctcactgcaacctcctccacccagttcaagtggtcctcgtacctcagcttcctgagtatctgggattacaggtatgcgccaccatgactggctaatttttgtatttttagtagagacaggggtttgccatgttggccaggctggtctcgaactcctggcctcaaataatccacccgccttggcttcttcaagtgctgagattacaggcttgagccaccacgtctggccaggatatacaatgtttcactaaagtarcagatgtgaaataggaatcttttagcgaatctttagttaaaatgcattattttgtttatttcattatgttttttttttttttccctgagatggagttttgctcttgtcgcccaagctggggtgcaatggcacaatctcggctcactgcaacctccacctcccagattcaagcgattctcctgcctcagcctcccgagtagctgggattacaggtgcccaccaccacacccrgctaatttttatatttttagtagaggcaggggtttcaccatgttggtcaagctggtctcgaactcctgacctcaggtgatctgcccgcctcggcctcccaaagtgctggaattacgggcatgagccaccacacccagccatgtcattatgtttaaaatgggcagaattatctggcaaagataatatatactaccatgaattctagtctttttatttgaataagtttcaaacctcaacgttgaaaaaatagtgtaatggccatcttttaatttttttctttttttttttcttctgattcatttgaaagttgcagacataatttcacttcatgcctagatacctcagcatgcagctcctaggaagacattggctgagggtctgtgggctttgagcagggactccatcctaggccaggatctggggatctgtgctcacagacccatgtcctgcccccttctggcacccaagcaggcatagtgaccattaagaagtagatgccagcccggcacagtggctcatgcctgtaatcccagcactttgggaggccgaggtaggtggatcaactgaggtcaggagttcgagaccagcctgagcaacatggtgaaaccctgtctctactaaaaatacaaaaattacccggacgtagtggtgggtacctgtaatctcagctatttgggaggctgaggcaggaaaattgcttgaacccaggacgtagagattgcagtgagctgagattatgccattgcactccagcctgggcaataagagagaaaagccatctcaaaaaaaaaaaaaagtcgaagcccaaatgtagaagttatggaacagtcaatttgttattaaattagatgcagtgtagcttttcacccaaattaaaacaaacttgcgtttgtatttctcagaagaaaattctacagatggtctataaatacatttatacaccattttcagatggtgtatattttcagayacaagcacgataccattatcatactcaagaaattctcaattgatacagtaagattatctaatttgtccgtattcagatttcccagttgctccaataatggcccttttaacttttcttcccttgattcaagatccagtcaaggattgttcattgcatttagtttaggctctgaatccaagacacttcttgtttgcatttttcatgatttagacattttgaagagtctaggttagttgtttctacaatgtcctttgatctgctccctgttctatcattagattcaggttaaactctgataagaacattaccaagataatgttttgtcctttccattactcatatcaggagacaagtaatatgagatgtatgcattattggagctgtaaagtttaattatttggttaggatgttgtctgttgggtacccttttcattttctaatatataagttgtctatggggtgattcaaatggtaaatatcctactgcttaaaaacttcacccggtggtttcagcattcattgatttttgctgtaatcacctatttcattgatgtttaaaaattgtggtatttttctcattctgtttttttctacatttatcagctagcattcttctgtagagaaatgctttgatctaccccctctactttccatctgcccacccccgccccctttttccagtaaactacttattggacaccagcacccagatgaaggaatagaaaattaccagtgctagtctggcatggtggctcacgcctgtaatcccagcactttgggaggccaaggtgggcgggtcacctgaggtcaggagttcaagaccagccttgccaacacagtgcaaccttgtctctattaaaaatacaaaaattagctgggcgtgggggtgtgcatctgtagtcccagccactgaggagcctgaggtagaagaatcacttgaacccgggaggcagaggttgcagtgagccgagatcgtgccactgcactccagcctgggcgacaaagtgagaccttgtctcggaaaaaaaaaatgaaagaaagaaaattaacagtgcctaataagctttcctaatgccccttcccaattatggattccctccataagatgatcactatcctgaatcgaacactgtaggttagttgtctgtttgtgaactttgtgatggaatcatgcaacgtgtatttttgtgtttgatctcctttgttcagctttgtattttgaggcttatccgtgttgcatgtcacagtaattggtgcactctcattgctttatagtattctgtttgactctaccttgatttattaatccattctactgttggtggacattaggattgttttcagtttggggctatttgaatagaactgctatgaggaatattcttgtatatgtcttggtgaacatgtgtacacatttcttttgggcatatatatgaagaagcgggaatttctgggttatacatagtgatcaaacagctttccaaagtggttaggccaatttacagttccccttagcagttaagacatgtcacagatgcttttttttctctcatgtgttactatccatttctctattctttttggtgcacaaattgccccaaatttgacttgttggaatccccttcatattgggtcttctggctttttgacagtactcactcccttgattgctggcacacattgttcagtttggtatacaccaaacacttttagagaaaataccattttcatttaaaaaaatgaaatataattcactaccatgaaattgaaagtgtacaattcagtgagttttagtatattcacaaggttgtgcatccactaccactgtctaatttcagaatcattattttattttttaaatttttttatttttttgagatggagtctcactttgtttcccaggctggagtgcagtttcaccatctcggctcactgcaacctccgccccccaggttcaagcgattctcctggctcagcctcctgagtagctgggattacaggcgcatgccaccacacctggctaatttttgtatttttagtggaaacagggtttcaccatgttggtcaggctggtctcaaactcctgacctcgtgatctgcccacctcggcctcccaaagtggtgggattacaggcatgagccaccgtgcctggccgattttattagtttttgagatggggtttcattacgttgcattacactaccatgctcagctgattttatattattatttttttttcctgaggcggagtctcactctcrcccaggctggagtacggtgacatgatctcggctcactgcaacttccgcctcccaggttcaagcgattctcctgtctcagcctcccgagtagctgggtttacaggcgctcaccaccacgcccagatgtttttctatttttagtagagacagggtttcgccgtgttggccaggctagtctcaaactcctgacctcaattgatccgcctgcctcggcctcccaaagtgctgggattgattacaggtttgagccaccgtgcccagcctgattttttattttttgtaaagatggggtctcaagttgttacccagactggtttcgaactccagggcttaggctatcctcctgcctcagcctcctgcagtgctgagattacacatgtgagccaccacacccagcctccatttgtttgtttatttcagacagggtctccctttgtcacccaggctggaatgcagtaacgcgaacgtgactcgctgcagcctcgacctcccggctcaagcaattctgttaccttagcccctaaagtagctggaactacaggcacacgccaccatgcctggctaatttttgtgttttctgtagagacagagttttgccatgttgctcaagctggtctttagctcaagagatccaccaacctcagccctcccaaagtgctgggattacaggcatgagccactgtgcccagcctccattcatttttaactgatgaacttcttacagttgagaatcaagttggtgttagtaatttggtattaataatttgctggccttaagtttttatttttacaggttttttttttttttaccatagtgctgtttagttttatataaggagtagagcatttataagtcactgatttatgtatttgtttgaaaatgtatttgtagattttaaagtcaatatcaggtaaatcagaaaaaaagggaaactaatcataagtgggaagtgaggcatttagaatgaagctaggcttctgatgggctctcgttgactccaggatttctgtaggggcctgaagccaggcagataaatagttgcttgctttttgtttgtttgtttctttatttctccaattgttttagctaaatccatctcctaaatgtgttttatattaatatgatgtgtctcaattagtggtggtttttttttttttaatacagactaacaaaaaaacttgaagaaaggagagaagagaaaagaaaagaggaagaacaggtaaagttcatgcagttagcattgttttgtcctctcattaactgaggttgtgattgattgattattctattcagtgtggcaggcctagggtgacttcatagttttagttcagtgttgcagcactatgaagataattcctgttttctctagtagagtcatagtatatacattttttgtgttcttttcgtaaattactatgaataaattagmccatgctttttccctctgcaatgatttttttttacactaagaataaagggacttgagctaaaatgtttggcttgaggttgaacaaagttttagttcatttttgtgaaaaaatgtatagacattttgctgaatttttcctctcctgttaagcattctagcacatggttcatttttctcaccatgtatacctaactgtgtagcatgtctttggagttctaatataggaaggttaccatttcattcaagccaaatacgtgactgccatgttgtccctgaagggtaatatatttaccctcatgactaaagacctgtaattatgcttgccttcaaattacactgactacattattatcttaacagaccattggcaatgatttatagattgatagacatttgaccattaascgtgccattaataaactcgtctagacttamattttatgaagttttattcttttaactgcagttttcgttgcattcaaaataatatctggggcagattatcaagtttttggatcataaaactttttctttaattcagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggtaagtcttaagtttccagacattcgtgaaactgtttttctgtgcacagtagctttagattactaccagactgtgcacacaaaaatagattttagtgactcatagactaccaatcctgagcttccttttattagaaattgtaaatgaattaaaatagttaagattaaaattgagttgatttttttgaagtgatttttattcatattttgttaatttatgacttttatcagcattcaaaaagcagcttttaaagattccctagaaaataagctaagtactagtacctactactagtactaagtacctactagtagtaactactagtactaagtacctagtagttcttctgtagtcacaggcacacttttttgcaacattgaaaggatttaggcacatcataaagcttagtttgcaacaattgcttttataattcatcagctgcaatacatattaaaaccatcccgccaggtgtggctcacgcctgtaatcccagcactttgggaggctaaggagggcggatcacctcaggtcgggagttcaagacttgcctggccgacatggtgaaacgccatctctactaaaaatacaaaaattaatcgggtgtggtggtgggcgcctataatcctgctacttgggaggctgaggcaggagaatcacttgaacctaggaggtggaagttgcagtaggctgacatcgtgccattgcactccagcctgggcgacaaaaagcgaaactccatctcaaaaaaaagaaagaaagaaaaaaagccatccctaccttaatatttttgttcatttggtcagtcaacaagtatttgttgagcatttattatttatttatttttgagatggagttttagtcttgttgctcaggctagagtgcagtggcgcaatcttggctcactgcaacttccacctcccgagttcaagcaattctcctgtcccaggctgccaagtagctgaggttacaggtgcatgccaacatgcccagctaatttttgtatttttagtagagacgggatttcatcacattggtcaggctggtctggaactcctgacctcaggtgatccacccacctcggcctcccaaagtgctgggactacaggcgtgagccaccacacccaggcttgttgagcatttattatgtaccagaccttgttccaggctttggagatacagtagtgagcaaattcatttccttgtttccttaataataattctggtctccgacagttgataaaactaaaaaataacagttccagaatgttaaagttcacatatggtgttagacaatttcaggcagcaaaggcacagtggctcacaactgtaatcccagaattttgggaggctgaggtgggaggattgcttgaagccaggagtataagatcagcctgggcaacaaagtgagaccccacctctacaagaaaagaaaaaaaattagctgggcatggtggcacacacctgtagtcccagctactctggaagctgaggtgggaggattgcttgagcccaggtgttcagaggctgcagtgagctatgattgtgccactgcactccagccttgatgacacagcaagaccctgtctcttaataaaaaaaaaaaattccatgcatatttgtttggaattgtgtgaattaaccattctggcagtaaaggtaattggtatttaatgatgttttaaaggaccgtgcagagagagctgctcgttttgcaaagacaaaggaagaagtagaggctgccaaagctgctgccttgctagcaaaacaggcagaaatggaagtcaagagggaatcttatgcaagagaaagaaggtactatatttcatgctgaaacatctctgtgcacataggggctgaggagaatgattataagctggtttttaacactgatgtatactgtggttataagcagtccattccagagggacatattaatttgacagctcccaatggtatctctcatttcgtgtgagtgtacactaaaaaagtactacataaataactttaaaagagggcccaatagccgggcgcggtggctcacgcctgtaatcccagcactttgggaggccgagacgggcggatcacgaggtcaggagatcgagaccatcctggctaacatggtgaaaccccgtctctactaaaaatacaaaaattagctgggcatggtggcgggcgcctgtagtcccagctacgcgggaggctgaggcaggagaatggcgtgaacccgggaggcggagcttgcagtgagccgagattgcgccactgcactccagcctgggcgacagagcgagactccgtccccaaaaaaaaaaaaaaaaaaaaagagggcccaataaatacctgttttccaaagacagaaatgatttgtaaccaaatgaatataatgtttatctcatacgtattaggattctttatttttcagaatcccctatccgataggattaagcaaaagaggaaatacattggctctgcagttcagaaatccaagggtgaatttggttaggcatagctgtgtccagcaatctaaaggataccattacaatttctctctctctttttaattcttggtttcttctgttttagcttcattcttagagaaactctccaaatggtgtcaggagagcccagcacctcctggcactttcaggaccttgaattcacgatcccagacagaagagattaaccttttctctctcatgcctgtatcagtcactgagaattctgactgcccctgtttggatcatgtggccaccttcagagtagtcagtgtccacatgtgtgggccctctggttggaggaggtgacatgcccaatcttgtggtgaaggaggtgggggaaatgttattgataattataccagaacgaatgacacatagcagggtaagaaggcagttcccaaaacaaaaatatgttgaaaagacaaaaaaagtttagatttctagtacaccttgctaattggattatggttaatacttattgtcttctctgtgccttttcatatttccatattggacagttaacaagtagtattttgtaatcagaaaaatttttaaaaataattttccaaaaataatgaagtaataaatttaacaaaaatgtaagatttgtgtgctaaaaatgacaaaacattgttgaaagatttaagacctaaatacctggaaagtatcctatgttcatggataagaatacttaacattgttaagatgataatcctccctaaactgatctaactgatctatagattcaacactcctatcaaaattccagctggcttttttccataaattataaacctaaaattcatatggaaatgcaagaaacacaatagttaaaacaaactggaaaatgaagatagatgactcatacttcctgattttcaaacttactgcaaagctatacagtgatgtaatggtataagatgaacatacaggtcattgtaatagaatggagtctctagaaataaacccttacatttatgaactgtttatttttgaaaagggtaccaagactattcagtgggaaagaagaatcttttcaacaaaaggtgcttggacaactgaatatctacatgcaaaataatgaatttggacctttacctcacaccatgtacaaaattaacttaatggatcatctaccaaaaagtaaaactataaaatatatattcttagaggaaaaaagaggaatatatttttgtgatctaggagtagccaatggattgttagacatggcactaaaagcacaggaacaaaatttaaaaataggtaaatcgcacttccaaaatttaaaactttcgtgctttgaaggatatcatcaagaaagtgcaaagaagctgggcatggtagctcacacctataatcccagcactttggaagactgaggcaggcggatcacttacggccaggagttcaaaaccagcctcgccaacgtggcaaaaaaccgtccctactaaaaatacaaaaattaactaggcatggtggtgcacaccagtaatcccagctactcaggaggctgaagcatgagaatcgcttgaaccagggaggcggaggttgtagtgaaccgagattgcgccactgcactccagcctgggcgacagagtgggactctgtctcaaaaaaaaaaaaaaatgcaaagaacaacccatagaattggagaaaatatttgcaaatcatatatttgatgagagacttgtgtctagaatataaaaagaacctgtgactcaattataaagacacccagttcaaatatgtggaaaggatttgaatagacatttctccaaagaagataaacaaatggccagtaagcacatgaaaagatgttcaacatcattagtcattagggaaatcaagtcagaaccacaatgagataccatttcacacccactaagtatgcctaaatgtaaagagaaagtaataagtgtttgtgaggatgtggagaatttggaacctttctgtgttactggtgggattgtaaaatgatgtagccaccttggaaaacagtttgccagtaacgcaaaatgttaaacatagtgttatcataggacccaggagttctacagcagcagtttatacagcagtttatatccaagagaattgaaaacgtcaacacaaaaacctgtacatgagtatagcagcattagtcaaaatagctaaaatgtggtaataacccaaatgtccagcaactgaagaatgtgtaaactgtatctcatacaacaatgtttttcagcaataggaataagaactgatacctgcaacaacatggatgaaccttgaaaatacaatttccatgaaaaaagcaagttacaaaggtcacatactgtatgattctattacacaacatgcccaaaatagacaaatccytagagatagtagattagtggttgccagggtctggaggagggagggatggggagtgactgctgatggggttggagttcctttttggcatgatgaaaatgttctggaattagataatgttgatagttgcacaattctgaatatatttaaaaatcactgaactgtacactttaaaaggcttaatttttgtttgtttgagatggagtctcgctctattgcctaggctggagtgcggtggcatgatctcggcttactgcaacctacacctcccgggttcaagccattctccctgccttagcttcctgagtagctgggattacaggcatacaccaccatgcccagctaatttttgtattttttagtagagacagggtttcaccacgttggcccggctggtcttgaactcctgacctcaggtgatccgcccgccttggcctcccaaagtgctgggattacaggcgtgagccaccacacccagcctaaaagagttaattttttatatgaatctcagtaaagcagttattaacaaacaaaaagatctgatatggtagaaaaaactattgtcattgcacatttccacttccattttctctaacttaatgatattgttagagaatatatagaggtgaagattgtgactttaattttcttttttcatagcactgttgcaagaattcaattccgtcttcctgatggttcttcctttacaaatcagttcccttctgatgctcctctagaagaggcaaggcagtttgctgcacaggtaaatttatgtcttgagttgtagtaaaaatagatgtgtaggttactaaattataggaagggaaaatttcaaagcagaagttgaatgtgagtgaattgtgacctctccaggagggaggcacaagacgcctctgagatattgtggaaattctgtcgggtgttagtgcatatgggagtaacatatctgctttgtgtgcagaagtaggaatttgctgatattgtataataggtcctgggaacttttcttttttaaaattttttgagacaggatctcactgtgtcgcctaggctggagtgcagtggtgcgatcacagctccctgcagcctcgacctcctgggctcaagcgaccctcccacctcagcctcctaagtagctggaacttacaggcatgtactgccatgcccggctaatttttgtactttttgtagagacagggtttcaccatgtagccgggctggtcttgaactcctgggctcaagcattcctcccacctcagcctcgcagtgcgttgggattacaggcgtgagccacccagcccagccactgggaacttttttcactgattagtagactcattgaaggagtgacaggcaagtgatttcccgaaggtctgatgtgagggaattgtcccactcccctgaaatggaagcagtttttctcactcctctctccatttcctacagattgcttaggggctggtcattttcctacgatttaccttttggctaaggaaaaagaggcagtaaactttatttgacaatagtatcttcttcaggaatttacttccaaaaggtggccttactcagaatctgaatggagtatatatcttgagatatgagtagttttcaatttatttttattccctgattgattccttattcaaaacggattctgagcatcagatgtcctttgggttctaggctcattatatgtatcagtatttttttcatatatataatttcaaggttaaaattagggatttgggttcagatctttccgccagaccttttctccacatttggtcgtcttcttgcactcgtgaactaggctggacaatgtaaacgtttattttaaaaactgtttccccctaagctttatagtagaaacagtcccaaataggtgctttcattcttcttttgtcttggagcctcccacaatgtgtcccctgtcctgagtttcactgcttttgccacaggtaaatggagaagggactacatctttgattgcatgtgtcctattaaaactccacctcaggccaggcatggtggctcacgcctgtaatcccagcattttgggaggccgaggtgggtggatcacaaggtcaggagtttgagaccaggctgaccaacatggtgaccccatctattctaaaaatacaaaaattagccgggcgtggtggtgggcgcctgtaatcccagcttctcgggaggctgaggcaggagaatcgcttgaacccaggaggcagaggttgcagtgagctgagattgcgccactgtactccagtctgtgcaacagagcaagactccatctcaaaaaaaacaacaggctgggcgcagtggctcacgcctgtaatcccagcactttgggaggctgaggtgggtggatcacgaggtcaggagattgagaccatcctggctaacacggtgaaaccccgtctctactaaaaatacaaaaaattagccaggcgtggtggcgggcgtctgtagtcccagctactcgagaggctgaggcaggagaatggtgtgaacccgggaggtggagcttgcagtgagccaagatcgcgccactgcactccagcctgggcgacagagcaagactgtctcaaaaaaaaaaaaaacaaaaaaaaacccaaaaaacaaaaattccacctcagtacagttatcaagttttgtattttgtgtatctttagaacagtgaggggtatgtgtgatctacagtaaaaaaaaaaaaatacgaaaaacaagttagtctccttctttggaatcttctagggaaagatacacagatgtctaagattttacaagtgatttttgtatatagaggacttaaaattgtgagggtgacttacagtgctgtccattgtacgttcctggatctggtattgtgtgtatcatgtaggttgattatggaccatttatgccttgagacaaggaggaggctacacttcctgaaggtatatatgagggaaatactggtctagtccaaattcttaatagggattacctgtaatccaaatgtgtgttcatgagacattaagtttgccaaaggatagtgaaaacctaatgatgaactgcaacagtacttaaaggagatacacaattgtccatttttactcaatttatttgtgtgtttttaggaactatattttgctattttgtggtcatctttgagttacagaagcttttaaaaactatttggatttgatagcttttcagctgcttaggggctggaagcacaattttatacctttttttgagtttacatgtaatgaacttttaaaattaaggcartgttaattaaagcatcattttggattcatctgagtaatatcttacttttaaaggcactctttaagtttttaaaacttattttacagactgttggcaacacttacggtaatttttcgttagcaaccatgtttcccaggagggaatttaccaaagaagattataaaaagaagttactggatttggaacttgccccaagcgcttcggtggtactgttgccagtatgtatatacagatgcatttttttctcttcttattgttttctgtttatcatactcttcatttcttataattaggggaaaggaagtgcacagatatactgaaggtaattaaaattcaagtgatccaataattagatgaatttataattccattatcctgtgctttatttgtattgctgatattacttgtgagacatgaaacagtttaatttttaacttttttcttcacatatttttgtgtacaaaaaaatgaccaataggagaagacagtaagaaatgcagattatctgtctaatccacacacttagtgtcttttatttatatatgctctactgtttgccaaaaataacatgaatattcaaacagattatcccatttgatctgcacaacaatattttaatctctggtgaagaaaagaagctcagacagcttaaatgactgctgccgtaactgggatgagagcctgggtcttctgtgtcctggttaacatagttttccttgctctatactagacgtgccctccaccccaaaacagttagctctccagtaatcaggatttcattgtttgaacctttttttttaaatcagcaagaaagactcttcttataaaagtttaatattcttaaaaaatagttggctcatttcactgagaactactttctagtttgtatattacaatttctcttaaacacagctccaaatattataacataaaattacaattgtatatataatatacaatattatacaattatatacaattattatataaaataattatataaaataattttataattataatatattatataaaatataatatatataatatataaaataattgtatactatacaattatacagttattatacaattatatacaattgtataatattgtatatttatctttaaaaacttctgggagtcttcagaagtttatatatacgtgaaaaacagcaaaagatatcattttaccctcttgaagtaaactaaaattggtaggacctccttttccagataaaagtttcatctggaaccttgggcgtgatgtgattgtgctaacgtagtctttatctaggtttgtttattaatttctaggcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaaggtatctgtgtgtgttttccccatttataaaatatgtaagtcatgcccagtatcttttttaagtaaaaagttgagtactttgcctttctgtatatgtcctctccagttcccacggtggaggagaaaaactccgatgctctgaaactttattacatcatctctactgcagagctcactacctgcgttttctcagccagctttataaaaccaattttttggaaagcagcttcacctctactggtttattgtttcattcattgaagtttctttaccccataactatcaaggcagatttttttttctagtaacctctttcttgctaaccatgtttgcttgacaagatagttcattgcattaatcgttcagggtcatcttgcataattactgtaggtgaactactctgttttgatcattttaaccctgttggttcttttatctaccggctgacagccttgtctggatcattcagagaaggaccaaattgtggaaacaggttattgctttgaaaattctctctcagagaattattttggactaatcccttaaccaagagaccagggcctgatgcagtggctcacgcctgtaatcccagcactttgggaggctgaggcgagagaattacttgagcttatgcattcaagactagcctgggcaatatagtgagaccttgtctgtacaaaaacaatttaaaaatttgccaggcacatgtctgtggtcccagctacttgggaggctgagatgggaagatcacttgagcccgggagattgaggctgcagtgagccaagattgtgccattgcactccagcctgggtgacagagtgagagtgagatcctgtctcaaaacaaaaacaaaacaacttttatagcagatagcatgcaatggttagcatagtaatacaacactgacaattttaactcctatctttgttaagattttatatacttgaaacaggttaatgggaagtattttcctagaaagtaagattatgcccctttctaataattacataataatgtaacttactgaaatggacaccgctgttaagcactctatgaggccttttataggcattataacaaatcttcatgccagtcctatgtgataagtaatagaaattcttttttctctgccctcagtatggagaagccctagtcatgtgtttatgkattccataggtaatgacatataagtattgtrattgggctgctttgtcctttatcttatttcataactgttaggcaggaagaccagttacctactaagtacgttactgtagtgaggacagagggaagctcaaacaaggctgaatcttaaaactcttactgagcaatgggtgggagcatttaatactgaattactgtaatataggagagytcgttgtatggatttttaaaacttttttcaggctgggtgtggtacctcatacttgtaatcccagctctttgggaagctgaggngcaaggatcacttgaggccagaagtttgagaccagcctgggcaacatagtgaggctccatctctacaaaaaaaacttttagtgagctgtgtgtgatagcatgtgcctatagtttcagctgcctgggaagctggggcaggaggattgtgtgagctccagagttttgaggctgtagtgaaccgtgatcgtgccactgcactctagcctgggcaacagaggggacaccctgtctcaaaaaagaacaaaaaacaacacttttttcaaataagagaaaggtcttagattagagcaaaggatggaataaaaggtgtgtcaaagagagggtgaagctttgtgttccaccattatttttccttttttctctcccctctagagttataaaagtctgttggcttaaattttatccttatacctttgtattttcagaataggaagtcctcttcattcttaattgtttataaataagtcattcttgaagattttgcgaaggatttaaaattgaccctttctgtcaagctgactggagctttggatagtctctagggtgctaagttacaaatgttttagtagataatgtcggcttgcataaataacaaaggaaagattagttggcaaatggtcacactcctctaatgcttattaagtcactaagaaacacaatggaaatggaatatatgatttggctggctggcttgacttagagatcagatgaagctaaactaccaaagactgctaaagtctagtactgtgttagtagatataatggtctcccatggactttccttactttagatggcattaaaagtaaaacttagttgcctgtactgatggaagttggaaacagcttgtattactattgtttttattttatgacatcttccccttgctccctctttttcgtatcagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgattttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcarraaatttgtatgcgtatataagcaaatatgtaatctttattttttaaataaatgggatcatattatatattctaccttgcatcttgcttttttgcttacatagtcttgagatcttttcctgtcgacactgagctacctcatttttaatggttgcatagcattctgcttgatgaatgtactgcattcagcttactgtccatgctctggtggcagtcagtggttattacacaattttgtttttctattacaaacattgccatcgtaagcaaccttcagtgggaggtatagtcttactgtgaaaatatacctgtagaatatgtttgtataacttgctaagtgaaagaagagtgtttgcagtttggattgtgaaagatgctgttgcattgcctcctctacaagctgtgtgaatttgaacccctaccaacagtcatgagaatgtccattttcccacacccttgccaacactgtattatcatactttcttagctttgtcaaaatgatggatgaaaaatgatacaatctcgtatgcattgtatttatcatgaatgaagtgagcatcttgatgttattgatcagtttggcttatcgtgagagctccgtgtattccttgccaatttttgttttcatatttttcttactgatttataagactactgtgtacattacagccatttgctagcatatgcagtgaatattttctcttttttttttttttttttttttttttttttgagacggagtctcccgcttgcccaggctggagtgcagtggtgcaatctcggctcactacaagctctgcctcctgggttcacaccattctcctgcctcagcctcccgagtagctgggactacaggtgcccaccaccacagctggctaatttttgtattttgtttagcagagacagggtttcaccgtgttagccaggatggtcttgatctcctgacctcgtgatccgcctgcctcggcctcccaaagtgttgggattacaggcgtgagccaccgcgcctggcttctccctcccttttgttgagtatatttggtaattttttccacagtattatctgtgttttcctttatgacctccaggtcttgagtcttgcttataaatacctttcccacttcaaaaattaatttttttatatcctaggattcttatggtttcctttttgtatgtttaaatctggtatccaaggaaaggacctggctccttcccatgcccgtggctaacatccccaggagcctgttccctcactgccttcatgggccctctgccccgagtaggcgcactgcctgcgaggtgggcatctgttccatgtgcagatgcttctgtgtctaggctttctcttcctttattgatctgtttgctctctgctataccaaactaagctagctttataatgtgttttaatcttcttcccccagatttatcctggctcttcttacaagtttatttcatatatgaaacttctttatattattttgttagtgttgtcccaaaaaagtgatgttgagttttgagattatttaggtataattggcaccttatgatactgagtttctccccaaagaatgtcttttttttttttttttttgagacagtctcactcagtcgcccaggctggagtgcagtggtgtgatctcagctcactgcaagctccgcctcccaggttcacaccattctcctgcctcagcctcctgagtagctgggactacaggcacccgccaccacgcctggctaattttttgtatttttagtagagatggggtttcaccatgttagccaggatggtctcgatctcctgacctcgtgatctgcccacctcagcctcccaaagtgctgggattacaggtgtgcgccaccgtgcccggccaacaaatgtctttaatatcaattttagaaccacccccacccccatctgacaaacttttccagtcgattgatggagaaaaatgcttgtgcaccacaagctcctgactgccaggttgggactcatggcgttggaatgttttgatagggaaaggaatgcttacaagaagcaaatttcaagtgtgatcatccttttaagaccagcccaaaattactctgtttttacaaaacattttcccagctatctagatgtaatatatgggccaatcaagtgtttaggtgtttcacactgagattgtctctcagcacatttgaggggattgtaaagaacatatctctgctcccaccactgccctggaaatgctatgtgaatgggtgaacacacgaaaggagcatttgtgcttttcattgctctctccaagttgtgcttgccagagacaatgagacatggtccttggccttaagaagctgatgatagagaaatacgcaattccagtatagaaactggatggtcaagttgtaataggggatatttacaagcaaagcagacgaaggagaatctgcctggggatttcagggaagccattcagaggaggaagtacattatttcagctgagacttaaaggcattttcagaagaaagggcatcctaggtggaaggagtagcatttgggaagacacaaaggaatatggatagttgtcctatgtgccgtttagaactaccacaaattgggaaaggaggaaggaaacagactaaatgaaccaaggtcagatgggagagctggggatggcataaaaagtggcagtgggggtgttcgaggggtgggaaaaggccactttctgcatgttgtggtatttgccccaaggaatataatgtcaacagaaagacttggtctggtgagaaagcttaatcggagctccagatggcttgtgtgacttcataacttctcttgaacctactttctcaaggaggggcaaccataggagaaaggacagtctgctgtttttattttctggaaaacacaagatgtgaagctagggagagcttgcagaagggcaggagatgatattgcagtctatgcaatggagttgatttcttcttataggaaggatttttacggtttttgctcccttaacaacccttaacaactctgaaacttaaaacagccctgttaagttcaattaagtggttcacagacccactagaccagtatctacacgtttccgcaagagctacttgcttctcaaatgcccaaatgaactctgatactggagcaagatggagatatttccattttactcagcaagtcgaaatcattcaagattaaagtcatctctaacggtgcagcaggactttatggagaagtccagtatcagcagagtctaagaccctaaggtgtttggtggccggtaaagatagatgaagaaactaggcctgcttcatagaacttgaggtggtaactcatcagaatgaagacaccgggctcaattcctgttggcttcgttgtgttttcccttgcttagagcgcttgcagtacttgtatgacagaaatgccaagccacagactccaagaagcacaagagaaaagagaacgtacaaagctgtctgtgcttctgtggtgccgagcattagccccaggaactgcacctcctcctgtctcacggggctgatggtgggtccggcatctaggagagtgtgacacagggtggttggtgctctggcgctgatttgagttctcagatctctgagaccccagcagaggctgcacggtaccccaaatccgcacagccattgacgggatgccgaggtggaggtacccatcccctttcactgtgtgtcaggagcctctgagtgaagttaagcagttgtattttttaaacatctctatcagcaattagaatacggttgaatatcccttatctgacatgcttgcttgggatcagaagtgtttcagatttgggattttttaagattttggaatatttgcatatacataatgagatattttggggatgggacccaggtctaaatatgaaattcatatatgttttatatgcaacttatccacgtggtgtgaaggtaattctatacaatatgttaaataattgtgtgcatgaaacaaagctttaactgtgttttgactgcgacctgtcacatggggtcaggtgttgaattttccatttgtgttgtcatgccagtcatgctcaaaaagtttcagattttggagtattttggattttgaattttcagatgaaggattctcagcctgtataattgaaactggataattgtcatttacatttgtgtagtgatttatactcttacatttaacaaatacggggcacccacatggtgcaggcattgtactttcatggtccctttatttgatccttataactgccctgaagcatgtgcctggtttcttatctatgagtgcacagcaagttagtggtagggctggaagaagagtctagacctgcttattcccaggtcagggctctggtttctaggtgtaacattgaccctaagtgtcctttgttccaccccaggaaatgtctggagcattcaaagaaaataaacatttgttgaatgaatgaaggagatggggcagcagagaggagggtaataaactagaagaaaacagactgagagaggcccttccacctgcccttcacccttaggctttattccctcccagagccacatctcacctggctggtggagacaagcgtgaggccctgtagcggggtcagggaagccattgcatcggaccacagaggcgtagaacttcgctgatgctttggggatccttggcagagaagggtcactgtagttcacaaaatgcagaccaaatctctctgaaaagcctgtggcccactcaaaattgtccatcgcactccaaactgtgtatcctcgaaggtccaccttgtcctgcacagctgctcaaacacagaggactaggcataagtttcctatctcataaggcagcttcctgccaggccttcggaagccaggtctgcctactgctctccccaccgccttcacagatggcggtaagctttggctttagctctgtgagaaagctgcccctttctttgcatgcagtgactgttagcgggtcctctgtggatggagatgtagagccaccagcatctttagaaaggctcagccctgaatgggagtcgggaacatgggtggactaatttccctgggtcacctacacttctatccatgatcttggtcagtgccttagaatgttaatgcttctccctgtagaaaatagcccttagatagaatatatttcagctgggtaggatttttctaatcatttcctttgctggtgcattgcttgctcttttactcagcatttgttccattctcttatcctcatggtcccatctcaagttgttagggctgagccaagagcctcaaacttttgctcggagactaagagaccctacaggcaaccacacagcctactcctcctgggccctacccagaccattctcaggagggcactgctgttccgacatcagggaggatcaaggggagcaagtgactcaggccaggaactagggtttggtggcatcaggccactgggcttgcttgctgagcttagacataggaaggaaaaaaactcagagtgcggccctaaagcaaagcttaacccccacaggagcaagaagccttatcgttctcttcttactgtggcccaaggacgctgtatcacactcctgcagatagcagatgtttccaacagggaaaggtgcacgctggggaagggcgggcccgtcgtacctttgagggcctcattgatgtaagtccgaaggtagtagatccttgcagtgtcattgaggtctgtttcttcccgctgggacactccattctctgtgacataaattggagggtcattgtattcctcctttaaccagttcaggatcctcctgaagccaaaaggcgtcatcttcagccagaaggagccagagtctggccacgagcgatctgcgatggaagcaactcctctacaagttcaaaaactaaagatgaggtcttgttttgtaaatctcaagaggccctttacacgaaacacaaaacaggacttagaccaggaaaagccttaggttttgtctagccttaagaatcatactaaacccagaagaatcaaattgcctcaaattctcctcctttcgctggttctagctgcct

SEQ ID NO: 10877 - DNA, 17339 bp, Homo sapiens
  misc_feature (1)...(17339): n = A,T,C or G, or insertion/deletion polymorphism (see Tables 1-2)
gggcttctcagctaggggcaactcgttatgctgcagtgggggcacctaacagaaccccctagggtttttttaaagtatacagcacggtcctgcccaccactggcatcagatgaatgccatgtccaggggaaaccccagtacgtcctcatcacagccatgtgaacactgctgtttgttcataaaaatgtgttgcatccctagggggaaataaaaggagctaatccaatagagagaagagtggctcaggggagacagtcacccgcgaggaatgagggcaggacacacaggcccaggccgagattgcacagggtgttgcatgagtggctgtgtcagagccaagtgcacatgcccactgccacctccgccaaggccatcagtgaatccctccagcacctacaggggctttgcacataagagctgtgcttgcagggggtggggggtgggcacagggcaggaaaccagagaggagggcaccatgtccctgagtaaggtagaaaggggaagcacagcctggacacattcttccattcttttatttcaaaatatcaccaagtgcctgccacagctatgtgctgggaactcagtgaacgcacctgtgctttgcccactggcatggagcccacggtccgggggtgatggtttctgttgcatttcaaagccactggggcgctgcatagatggctggctgcagagtctatttgagacgaaggcaagaagtcagggcccatggactgtagattccacccttgatcgtctactacaggaaagaagccacagaagtgagggggtattcccaacaggaaggcagagaaggagagattaaaactgagtcaagaagtgtagccagtcccatgggagcacctgggctgaggagggtcagtccccgcagagatgttcggaacacctgattggggatgtgccctctccttctatgttcttggtcaccagaggaaccaggtgaagagtgtggatgactcagtccacccctccccgcacaggaaaaacaactcagaggacatcccctactgggagtgggccaggagcgctggcttccacgccaaggagaggagggtgttgctgtggctgcagaggtgagtccacagggaagcgtgggtgtcatggagaaagagagaggagaggaaatggcctctcgctggagccaagcagagaggaacaaaggaggggaggagcccacaggccctggagccccagagcagctctgggtggcccctttccttctctcctcagcacaaaataagctgcttttccaggctttttctcttcctcgtgctcactccattttccttcttccaagcctaagccctggtctaccaaggacccctatgtgaaacacttgtgctagaacttctgtcctgactctcaggcccccagaggaggaaagctgtggaggagggacctcatgagccagtaaccttcacttaggaactcttcacttttttttttttgagacggagtctcactctgtcacccaggctggagtgcagtggcatgaaatcggctcactgcagcctccgcctcgctggttcaaatgattctcctgcctcagcctcctgagtagctgggattacaggtgcctgcccccgcacccggctaatttttgtatttttagtagagatggttttgccatgttggccaggctggtctcaaactcctgagctcaagtgatccacctgccttggcctcccagagtgctgggattacaggcgtgagccaccatacctggccagctttgacagcagaaatcttctctctagaaatattcatatacataaggaattttgcacacatccttacagggtttagggagcctcttaagcctgtccatgaacctctgccattcatttatagcatggtgtcagctgcagagtaataggatctatgtgggcctggaagtccaacaggcctgggtttgaatctttttcaaacatttttgcttgttagcagctggtttggacaaataatttcaacttagttttctcatctgtgaaacagggggaaaaagcacttaccctgtagggctgttgtgaagattgaacaagacaactcatgttaaatacccaggcaccgtgtccgcctgcagcaggcagtcagtacatggtggatctcgtgccccaagcctcctctttatggagtccctcaagttgccccagctggcctcggattcctcccacctccacctcctgggtagctgggactacagcacgccatgcttcagccccctttgtgatcattcaaagccgtttggttccctgcaccctctcacatttactgcaattcctatagaatccaaattcttttaacctggtgttgtaggtcatctacaatcccgatccaagcagcctgtcccttctcccacaccactgtcctccacatgcatgtcccacaccaacccacgccatccgctggttctaaatacacctgaagcaccacaaggccccacgtctggctgcctgctctgtgcttctctcatcattcctcaaggcccggggaaagtcctgccacctccctgaagccaagtgcctacccgcttctccactctaggctgctctcttacgctgtgtgtccccagctggatggcagctcctcagggcaaggaacaatttctcttctttctcagtgcaacttccaaaacacagcagaggagcgtgcactgggggcaaaggctggcacagcaaacacagcagcacagggctgctggaggggtggaggggaccggaggggacagtgacctgcctgcttcataatacatggctgggagccccaccttttgcctatggaagccatgtgctttgagcttgattttctcgggtgtagagtgtctacgccacccacactttctcacccggtccaatgcacgggcacgggcaggggcagggccagaatctgttgctgtagaacacagcagagctgcctgcagtactgtggacgtcaccaaactggcagcttcactgaaggtgaccctggcctgtgtgggcactcagctgatgcccttctcttccctcctaagccccattagctttaggtcttcaccacctgcactgagagaaagattaatggtgagcaccagagtaaaatctagcacagaaggcagggtttcagtaaaaaaccaaaagcatggcagattagagctcaagggcccacaggtgggcaggacagtagaggaactgggcagcccagggtggcaggatggggtggacaggagtggacaggagagagtagccaggaggagggacgtggctgcaccaccagtccacgtgggcggctggagacctggcaggaggccaggagagactgtgcctcctccagcctggctgtcttggccaagttctgatggcagccaggaggactgtgagaaagaaaacaagacaaactttgctacctctggctggtcaggggaagtttgtgttggaaaagaagaagccacagattccactgttccgctgccttctcccctcacaccctgggacggcccagcaccttctagtccactcctccctgccctctgccactcccctcactaccccagtgccccctccctccttgcccaggtcctccagggagccaagcctgagagtctagggaggcccacaagaggaaatgatgttcggaaagagcagcatcactttattttttgagatggagtttcccttttgtcacccaggctggagtgcaatggtgcaatcttggctcactgcaacctctgcctccagggttcaagtgattctcctgcctcagcctcccgagtagcagggattacaggcgcccaccaccacgcctggctaatttttttgtatttttggtagagacggggtttcgccatgttggccaggctgatctcgaactcctggcctcaagtgatccgcccgcatcggcctcccatagtgctgggattacaagcgtgagccaccgtgcccagccgagcagcatcactttaaatggtatctctgtctcacatttgtgcctgcacctctatacaaggcaggaagggagcagaagacactctgctagcattggctgggctggagactcaggaaagggagcctggggctgtgggggtgaagctggcctatttgtctcccccagtggaaggatgaagacaggagcacctgcagggctccatttgctgggcttcctactgggggactgcaccccttgtcccatttaacctttttgataatttcccatttgatgttcacaaaaaccttgcgaaataagtgttatttaaaatacccccatttcacagatgaggagatggaagttcagaaaggtttgaagagccgcccaaagccaagaggttagctgggacttgaacccacgtcatcttcattctgaagccagtgttttttgtttgtttgtttttcccaaggcattagcccccttcaggggaccctgtcctatcccttcctctctccacagctccctcagcccctctttcctcccactcccattctgagtgtcactagcaagtcaagagcaagactagatggcagccactagctgcacgtggccaaccacatcattacaattaattaaaattaaagctccaaatctttggtggttaaacttgctccatgtggccagtggctaccgtatcggacagcacagacaggaaacatttccatcctcctgctggtctgaacttaaagggcggtcaggaggtagagggaatgggagagaccagcccaaggggcccagggacagagctgcctttgtgaggagatgaggtttgggaagtgagtttgggtgaggggagcaggggtgtctgaggcctgggggaggagagggcagcttgctggacttgcaggcacctccctccgatactgatactcccgcaatactagtgagcaattaattggctggggcggggcaggggccagagcaggagggaggccaacgcaatggaggagaagccaccaccctctcagcagatggcagggctccggttctcctggcctcctttcatcctttgaggacccgggagcctgcctggccctcctcgacctgcccagagctggctgctgcttcctgctcgctcatccagcccagggccagcagatgggctacggggccaccaccttcccaattagccttcttagcctcttgctcacccttgaggtctgggttaccagccatggggaggggctgtgagtggcctgtgagtaaccaaggcccagctttgacagaggtcatcagcccaggcccctcccctggctgagccctggctcccagcacccccccccacccccgccaccatgccgtccccagaggcccccagaagcgacaggtcagggagttggttttgggaatgtggtgccccatttctgagaaggagaaggttccccaggtgatggaacacgtaataggtatgtggctggcctggtacttggggagtggtgggagggggagcctgggggatgggggcagaactcatatttgaaggaggaaagtggaggtggagtgatggggtcctaaggaaggagcagatcaggggctgtgaatgggacctcattggggttgggtgggtggggctggagcgggcacccaagtgtggaagaaaaagctgaaacacccacgactgcgagtggagggcagatggagagacaggccaagccacggtaggcaggagagttaaggagccaggcagctgggtcccgtggcaagagtggccgccccagagtgggtggccgtggggcagagcgcctggttccgggttaggcaatgaggagccggggccaggcctgtcaggtggcaggatcgttagagccccgtggccatgggtaccccacactgcagccactgctgctgctgagtaggcagatgcaccgggctgattaccacgctcctcccggccacaccaacttcccccggggcacccaccccctccacctctcctcctctccccacagtgactcctgcccagggaatgtccagctctggcataaaggacccaggtgtcctcgagctgccatcagtcaggaggccgtgcagyccgagatgggctcgtctcgggcaccctggatggggcgtgtgggtgggcacgggatgwtggcactgctgctggctggtctcctcctgccaggtaggaggctgggggccctgggaacaggagggaggcgggagggagactccgggagaggacccagcgaaggggacgggcaggggctctggaatctgccttttgagtctgggggttgctcctcactgtatggtcgcctcaggtaagtttcttaaacttcctgagccccagtttctgaaattctgaagtggggttaatgacacctacctctagtctgtgtgtctcaaattaaataatgtatgtgatatgtactttggaaattctagaggtttatataaatggtggtggtgatttttattatgggagcactacaagataatgattggacatttaatagtaataatatcatttttagagcctttttatatgctagactctgttttaagcacatttggattatatattagaacttttatttttattttttttgtgagatggagtcccactctgtctccaaggctggagtgcagtggcgtaatctcggctcactgcaacttccacctctcaggttcaagcgactctcatgcctcagcctctagagtagctgggacaacaggtgcccatcaccacacctggctaattttcttttttttgtatttttagtagaaacagggttttaccattttggtcaagctggtcttgaactcctgactcaagtgatccgctcgcctcggcctcccaaggtgctgggattacaggcatgagccaccacacccggcctatattagcacttttgatcattacaagaacggtatgaaaagagatttgctatttccactctacagatgaggacactgaggctcggagaggttaggaaactagctcaaaatcatgcattagaaggcagcaaagccaagatttcaaccccaggccaggcaacccctggacctgtgttgttgaccaccgggtacttatagcccttgaggaatttctgcgaccttcccatggtctagtgggtggttggtgtctgagggaatagcgaaagagagaggcaatgcatggtggattcgtgcagaggactgaagggaattggcacagctggggttcggcgtggaggtgcatgcagagaatttctttctgaggagagaacagggacatcacagaggatggcagtctggttgttggtggagggatcaggatgagtggcagtaataattcataatatataatgctttacactttctaaaacatctggccgcacatgatagcttgtgcctgtaatcccaacacttcaggaggccaaggcaggtgaatcgcctgaggtcaggagttcaagaccagcctggccaagatggtgaaaccccctctctactaaaaatacaaaaaattagctgggtgtggtggcgggcacctgtggtcccagctacttgggaggctgaggcaggagaatcgcttgcaccaaggaggcagaggttacagtgagctgagaccgtgttattgcactttagcctgggcaacaagaaactccatctcacaaaaaaaaaaaaaaaaaaaaaaaagaagaaaaaacttccaggtggatgatctcatttagttttcttcatagtaatgctgtgggaaggcagggaaaatttggcccctctgaatgtataaactaaagctcagagaggttcagtaacttgctagtatgtggctctgtttgtaacacgtgggacctggaggggctagggaaggcagaaggaacgcaggtgaaagagtcatggaggaaccatggggtaagttgggcctggggttttgagcaaaggaaaggaaagataaggaaagatgtggctccacatccctgagggaagtcaaggcagcagaagtcagatgaggggctggacagaggcaggtgtgctcagagagggaagctgattgtggccaggagcctcggaggttcgtggggtttcgtcctggttccctgggctgggccagcgagagcagggctggctcagggtgcggtgtcctgacacactggtaccagcaggttctgaagcaacaggtagtgaccccacatcctggcccccacccagctttactggcatggccagtgctgagataggaaatagggtttccattcctgaccccagcctgggctctcacgaagaagctggtgaccaaatcttagtcctcgagtgccctttcctttatttcagcccctctgcccccagctttgtctttttccagtgtctccttctatatgtgtctccacttctcagccctccattgttttgccttttgtcttcttccctctggtcccactgtctggcccaggatttttcccctaagaatttacgcctggactcctcakagcctcagtttccccaattctctgtctcttcagggtcctttcttttagacctatttgttcctgccccttctccattccctcttctttttaaaaaaaattttaattaaaaaacaaaatacagatggggtctatgttgcccaggctggtcttgaactctggggcgcatgcaatcctcccacctcagcctcccaaagtgctgggattaccggcgtgagccactgtgcccagccccctcttatattcaatgtattcctttgaggtcactcactttggcacstaattttctatttttctggttggtgtttgcccacccttcccaaacaaagaaatgcctttattcggccacctcaatatcctttagagacaatagccagttcttcctcctttctccatccctaaactctccctgcgctctgcttgggagaaacccgagaggccgatkactgagataaggcagaaaggtgaggraggaagccaagcctcyttggcccttactaaccactgctttcctccacagggaccttggctaagagcattggcaccttctcagacccytgtaaggaccccacgcgtatcacctcccctaacgacccctgcytcactgggaagggtgactccagcggyttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaarcagcggctctcactcgggmagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaracctytggggtatccagcagtggccaaagcgtcagctccaaccagcgtccctgtagttcggacatccccgactctccctgcagtggagggcccatcgtctcgcactcyggcccctacatccccagctcccactctgtgtcagggggtcagagrcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaycctgtgggctacttcaccaaagagaaccctgtgaaaggctctccaggggtcccttcctttgcagctgggccccccatctctgagggcaaatacttctccagyaaccccatcatccccagccagtcggcagcttcctcggccattgcrttccagccagtggggactggtggggtccagctctgtggaggcggctccacgggctccaagggaccctgctctccctccagttctcgagtccccagcngttctagcatttccagcagckccgkttyaccctaccatccctgcggcagtgcttcccagagcccctgctccccaccaggcaccggctccttcagcagcagctccagttcccaatcsagtggcaaaatcatccttcagccttgyggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcracagtccataagtcaactgttgtgtgtgtgcatrccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcascttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctyaaggcccttatctcagccccttcctgtggccayttccctcagtgcycagatgattccctgggtgagggagacactggggcaccctcagaggttgragcaggctccctgctgtccctggatcctggamagatggctcagtaaactgtggggactaggtgcagactttttgccttcttggartcctgggtctcctctgagagtctggrtggtgctcytcctacgcctctagaggtctctgtgtycctcattttccttcaaaagcgggctgtrtttctcttctaccttccagctsctcccacagaggaggaagacaataaatatttgttgaactgaaagcagagattgcctggcctcccagatccttccgccatttccctcctctctcattgctccaggaaatccattctcttcccattcctcattcaccgtggggtcccccttccccttatttagggccctcagtgttttctctccctcccctcccctcccctccccacccaaactccttttcttccaccattagcattcctcaccttctagatgccatcctctctgggagtcatgagtctcgatttcctgggtttctgggacacctggaagcttgggaaggctgggacacaacaactccaaccagattcctgtcagctgagtaggaggccagttgggcgttgttcctggagctgggggtggagagagtaaaggactgagaggatgggagcggggcagggagtgcagccaagcagggtgactcactggcctagatcaagaggcccagcctgtggcagaacagagctgccagtggtctctccatcttcacactccctgctctgctggggtccagagtgagagtgtgagcaacatggctctcaggtgagggctgagaaggcagagtgccccagtgggaaagaggagtcgcttccactggagaagagagagaaagtggagtgtgtggtggggtccatgcgacttaagtcctgagacaggcagggagaggctgaggcggacgaagttcccgcatcccaaggagggcagagtggattgtgcttgtccctgtaggagccccaccccccaccccaggccacctctcagagcctctgcttggctgcaaaggaattcacccctactgtagcacttaacccattccctcctatcagggtggtgctgtctggtcctgaatttagaactgttgaaactccaagtctggaatcagcaaaaatgtattacattgaccagaaagggattgaatcacccttggtccagcatctggcccctgatctgcagccaatggcaggaatcgaggtcctcagatgcttcatgaatgggaattgcagggagagaaggctctctgatgtggtgtttcctcgagtctcctgctgtgctccaaattaaaagcttgtgtaaaactcatgcatgtcatccaaaaaggcctctgggctccatccactgccagttctggagaggagctcttcactcctccagtggttaagccagcaggggcaggtggggaggacacagcagtagaatcagccaacagctcatgtttagaccttgggcagccagggaagcctactcctggggcctcccggaagccatggagagaacaaagccattgcatttttataataaaatttgcaaacatatttaaaagccaacaaactgttaatgaatctctacattctcatcgcccagcttcaacaaggatcaagtcctggccatttgacagcagcatttaaaggctctcctctactgttacttggaaatagccactttctcccaaggtttcttatactctatggcacatctgaccaccagtagcaggcagaatgatgtcttcaaccccaacaccatcaaagatgtccacatcctaatccctggaacgtaggaattaggttacatggcaaagggaaattaaggttccagatgggattaaggttgctattcggctgacttcacagagattatcatggattattcaggtgggtccagtgtagtcaccaggtcccttaatgtggacatgggaggcagaagaggaagtctgagtgatacagtgtaagaaatggctgattttggctttggagatggaggaaggggaccatgagccaaagaacacaggatgcctctagaaggtgaaaaagcggggaaagggattttcccctgaggcccccagaaagaatcacagccctgctgacacctttattttaatccactgagacctgttttagacttctgatctccaaaactgtaaagtaataaatccatgttgttgtaagccattcggttcatggtaatttgtcactgcagcagcaggaattagtcagtatctcataaggatggcatccaggtccatttccctagctagatccagggtctcatgtaggagcagctcctcagatggggccacttctgcaccccagaacctcctgcaggttggggccaaggtgaaggagatatgaggatgcatgagaaaggggtgctgggaggaaacaatccagctcccaaaaagaaacaagtgtttctgttgctgagagaggcaattaagagagtgggaccccagggtggaggtccttgtgtatagagaagcagggctggggaggctggcaaccagggatgagctgtgagccaggacacctgggccaagaaggggcagggaggtcaaggaaaggagccagggcgggagacacccagcttcctctgggacattcattcaagtgacacctgttgccacagaccacattaggaatgagggtggaatgtggaggtttattgtcttcacaaccactagcccagcctgtttctgctgtcccccaccccactaccaggataaagggctggctgtcttggggctgagggagatcgggtgctgagcaggatgcagggccgcgtggcagggagctgcgctcctctgggcctgctcctggtctgtcttcatctcccaggtatggaggccgtgatgcccttgggcaggagggactggaggtcccccaggaaacaggaattaaggaaaggggtaaaggcaggagggtacacatttaggtccctgagggaaaaggaagaataggcataggggaagcaaagggaactggggactcggggactggagaccactggttgctttatcttccctttccctcaggcctctttgcccggagcatcggtgttgtggaggagaaagtttcccaaaacttggggaccaacttgcctcagctcggacaaccttcctccactggcccctctaactctgaacatccgcagcccgctctggaccctaggtctaatgacttggcaagggttcctctgaagctcagcgtgcctgcatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacccaaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagtcctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgtcagcatgtttccagcactatccccacttttcagtgcctcccctgctcatctccaataaaataaaagcacttatggaatttgcttctccttggtttctttgtttctgggcataagctgaagtgagtctgggcataagctgaagtgagtctgttcattcctgttttctagccatccccacggccctctaggggcccctgcagacgctgtcttgctatccccatccttcacaaaggatcagtgcccaagtgcttgagggtggagcctcagtctcaccccggccaggtgggagagctgttccagaattgtgctggaatctgaaagggggaggagggacagcaggactaattgagatggcacctgcagcagggggcaaggatgaggtcccagaaggcggctccagggccaggtggacaggattccttgcaactcacagaaacaggaagccaaaagtcgcaatgtctacgcttcacttgtcttttcttccccggaaagtcaagcttcttggaagtggaggtacatcgacctcctcccttacaggcatcatttagcacattgtgtcccacagaaccacagactttgaagagttgctgagtaaatagcagacctcgataaaggaaaagagaaaagggagaaaggaaagggagaaaaaaaccttgaagccaacaatcccacctggggtggcatttgatgctttcattcccaagtgatgacacagtctcagcctttggtcacagtattgtctctcctgccctcccttcggttttcccaggagctcaacatcctcacacaggagttggagtgacggcagcgaagggtcaggctacaaaagcacggaagaatcagcaggtgtgggttggaggtgatttgggtctggattctctcttccctgtgccatgcctgcagtggtccaggtgtatgtactctccatccagtcaggtccctgggagttgggcagcttgtgggaggggagaaaggagtaggaaaaacaccagaactcaaggggtagggagctgcctgcctgcctgcctgagtggcagatgggcatttctggagaagatgcccggtcccagcgtctgccataaggctccatcctacactgagaagtccttcctggaacaccttcctcagagcccacctttcccatcaccaagcacactcccttcgtcaacacctcaacctcctcacctgattcttttcccagcttggactctcttggtttctccctgccctagggcaaggggttccatgcctgttttcagcacctgcctcttccaccagcccaaggtcattctatcaagcctggagtctcatttctctctgtccctcttcctggtggcctcttctgcatagtcattcctattcgcacatttaaatttggtgtcaacagtcccctgctctgttccacagactcactagagcataagcaccacgaggacaggggctttgtctctttagttcactgctgcacccccagcacaaagaacagggtctggaccagggcaggcactcagcaggcacgaaggaatggctgatcctctctctctgtccctccccctctctcatcatctctcttcttccactcaattcctgagccatgcggctacacccagagtctaatctacactccggctgtagccctcccagagcctcactgacatttttcaacaacctcatgaagcccttctcagcattaaaatgctctgtgcgtttcatcatttaaccttcattattctctgtgaggaaggcattataagatttttgcggccaggcacggtggctcacacctgtaatcccagcactttgggagaacgaggcaggcggatcacctgaggagttcgagacagcctagtccaacatggggaacatggtgaaacctcatctctactaaaaacacaaaaattagccaggcatggtgcctgtaatgccagctacttaggaggctgaggctggagaatcgcttgaacccgggagttggaggttgtagtgagccgagatcgcgccactgcactccagcctgggtgacagagcgagactccgtctcaaaaaaaaaaaaagatttttacagatggaggaactgagatttagagggattaagcaagtcacacagggttacaagtgacaggggtggtgactcaaacctcatttttctcattatctgtccagggagtattcaagtacaatatgcaattaacagaaataacaacgaac

SEQ ID NO: 10878 - DNA, 13333 bp, Homo sapiens
  misc_feature (1)...(13333): n = A,T,C or G, or insertion/deletion polymorphism (see Tables 1-2)
tccctgagggaagtcaaggcagcagaagtcagatgaggggctggacagaggcaggtgtgctcagagagggaagctgattgtggccaggagcctcggaggttcgtggggtttcgtcctggttccctgggctgggccagcgagagcagggctggctcagggtgcggtgtcctgacacactggtaccagcaggttctgaagcaacaggtagtgaccccacatcctggcccccacccagctttactggcatggccagtgctgagataggaaatagggtttccattcctgaccccagcctgggctctcacgaagaagctggtgaccaaatcttagtcctcgagtgccctttcctttatttcagcccctctgcccccagctttgtctttttccagtgtctccttctatatgtgtctccacttctcagccctccattgttttgccttttgtcttcttccctctggtcccactgtctggcccaggatttttcccctaagaatttacgcctggactcctcagagcctcagtttccccaattctctgtctcttcagggtcctttcttttagacctatttgttcctgccccttctccattccctcttctttttaaaaaaaattttaattaaaaaacaaaatacagatggggtctatgttgcccaggctggtcttgaactctggggcgcatgcaatcctcccacctcagcctcccaaagtgctgggattaccggcgtgagccactgtgcccagccccctcttatattcaatgtattcctttgaggtcactcactttggcacgtaattttctatttttctggttggtgtttgcccacccttcccaaacaaagaaatgcctttattcggccacctcaatatcctttagagacaatagccagttcttcctcctttctccatccctaaactctccctgcgctctgcttgggagaaacccgagaggccgattactgagataaggcagaaaggtgagggaggaagccaagcctccttggcccttactaaccactgctttcctccacagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctttggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaagcagagattgcctggcctcccagatccttccgccatttccctcctctctcattgctccaggaaatccattctcttcccattcctcattcaccgtggggtcccccttccccttatttagggccctcagtgttttctctccctcccctcccctcccctccccacccaaactccttttcttccaccattagcattcctcaccttctagatgccatcctctctgggagtcatgagtctcgatttcctgggtttctgggacacctggaagcttgggaaggctgggacacaacaactccaaccagattcctgtcagctgagtaggaggccagttgggcgttgttcctggagctgggggtggagagagtaaaggactgagaggatgggagcggggcagggagtgcagccaagcagggtgactcactggcctagatcaagaggcccagcctgtggcagaacagagctgccagtggtctctccatcttcacactccctgctctgctggggtccagagtgagagtgtgagcaacatggctctcaggtgagggctgagaaggcagagtgccccagtgggaaagaggagtcgcttccactggagaagagagagaaagtggagtgtgtggtggggtccatgcgacttaagtcctgagacaggcagggagaggctgaggcggacgaagttcccgcatcccaaggagggcagagtggattgtgcttgtccctgtaggagccccaccccccaccccaggccacctctcagagcctctgcttggctgcaaaggaattcacccctactgtagcacttaacccattccctcctatcagggtggtgctgtctggtcctgaatttagaactgttgaaactccaagtctggaatcagcaaaaatgtattacattgaccagaaagggattgaatcacccttggtccagcatctggcccctgatctgcagccaatggcaggaatcgaggtcctcagatgcttcatgaatgggaattgcagggagagaaggctctctgatgtggtgtttcctcgagtctcctgctgtgctccaaattaaaagcttgtgtaaaactcatgcatgtcatccaaaaaggcctctgggctccatccactgccagttctggagaggagctcttcactcctccagtggttaagccagcaggggcaggtggggaggacacagcagtagaatcagccaacagctcatgtttagaccttgggcagccagggaagcctactcctggggcctcccggaagccatggagagaacaaagccattgcatttttataataaaatttgcaaacatatttaaaagccaacaaactgttaatgaatctctacattctcatcgcccagcttcaacaaggatcaagtcctggccatttgacagcagcatttaaaggctctcctctactgttacttggaaatagccactttctcccaaggtttcttatactctatggcacatctgaccaccagtagcaggcagaatgatgtcttcaaccccaacaccatcaaagatgtccacatcctaatccctggaacgtaggaattaggttacatggcaaagggaaattaaggttccagatgggattaaggttgctattcggctgacttcacagagattatcatggattattcaggtgggtccagtgtagtcaccaggtcccttaatgtggacatgggaggcagaagaggaagtctgagtgatacagtgtaagaaatggctgattttggctttggagatggaggaaggggaccatgagccaaagaacacaggatgcctctagaaggtgaaaaagcggggaaagggattttcccctgaggcccccagaaagaatcacagccctgctgacacctttattttaatccactgagacctgttttagacttctgatctccaaaactgtaaagtaataaatccatgttgttgtaagccattcggttcatggtaatttgtcactgcagcagcaggaattagtcagtatctcataaggatggcatccaggtccatttccctagctagatccagggtctcatgtaggagcagctcctcagatggggccacttctgcaccccagaacctcctgcaggttggggccaaggtgaaggagatatgaggatgcatgagaaaggggtgctgggaggaaacaatccagctcccaaaaagaaacaagtgtttctgttgctgagagaggcaattaagagagtgggaccccagggtggaggtccttgtgtatagagaagcagggctggggaggctggcaaccagggatgagctgtgagccaggacacctgggccaagaaggggcagggaggtcaaggaaaggagccagggcgggagacacccagcttcctctgggacattcattcaagtgacacctgttgccacagaccacattaggaatgagggtggaatgtggaggtttattgtcttcacaaccactagcccagcctgtttctgctgtcccccaccccactaccaggataaagggctggctgtcttggggctgagggagatcgggtgctgagcaggatgcagggccgcrtggcagggagctgcgctcctctgggcctgctcctggtctgtcttcatctcccaggtatggaggccgtgatgcccttgggcaggagggactggaggtcccccaggaaacaggaattaaggaaaggggtaaaggcaggagggtacacatttaggtccctgagggaaaaggaagaataggcataggggaagcaaagggaactggggactcggggactggrgacsactggttgctttatcttccctttccctcaggcctctttgcccggagcatcggtgttgtggaggagaaagtttcccaaaacttsgggaccaacttgcctcagctcrgacaaccttcctccactggcccctctaactctgaacatccgcagcccgctctggaccctaggtctaatgacttggcaagggttcctctgaagctcagcgngcctscatcagatggcttcccacctgcaggaggttctgcagtgcagaggtggcctccatcgtgggggctgcctgccatggattcctggccccctgaggatccttggcagatgatggctgctgcggctgaggaccgyctgggggaagcgctgcctgaagaactctcttacctctccagtgctgcggccctcsctccgggcagtggccctttgcctggggagtcttctcccgatgccacaggcctctcaccyraggcttcactcctccaccaggactcggagtccagacgactgccccgttctaattcactgggagcygggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcgstatccaggaggcagctggggaaatattaatcggtatccaggaggcagctgggggaatattaatcggtatccaggaggcagctgggggaatattcatctatacccagrtatcaataacccatttcctccyggagtyctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgtcagcatgtttccagcactatccccacttttcagtgcctcccctgctcatctccaataaaataaaagcacttatggaatttgcttctccttggtttctttgtttctgggcataagctgaagtgagtctgggcataagctgaagtgagtctgttcattcctgttttctagccatccccacggccctctaggggcccctgcagacgctgtcttgctatccccatccttcacaaaggatcagtgcccaagtgcttgagggtggagcctcagtctcaccccggccaggtgggagagctgttccagaattgtgctggaatctgaaagggggaggagggacagcaggactaattgagatggcacctgcagcagggggcaaggatgaggtcccagaaggcggctccagggccaggtggacaggattccttgcaactcacagaaacaggaagccaaaagtcgcaatgtctacgcttcacttgtcttttcttccccggaaagtcaagcttcttggaagtggaggtacatcgacctcctcccttacaggcatcatttagcacattgtgtcccacagaaccacagactttgaagagttgctgagtaaatagcagacctcgataaaggaaaagagaaaagggagaaaggaaagggagaaaaaaaccttgaagccaacaatcccacctggggtggcatttgatgctttcattcccaagtgatgacacagtctcagcctttggtcacagtattgtctctcctgccctcccttcggttttcccaggagctcaacatcctcacacaggagttggagtgacggcagcgaagggtcaggctacaaaagcacggaagaatcagcaggtgtgggttggaggtgatttgggtctggattctctcttccctgtgccatgcctgcagtggtccaggtgtatgtactctccatccagtcaggtccctgggagttgggcagcttgtgggaggggagaaaggagtaggaaaaacaccagaactcaaggggtagggagctgcctgcctgcctgcctgagtggcagatgggcatttctggagaagatgcccggtcccagcgtctgccataaggctccatcctacactgagaagtccttcctggaacaccttcctcagagcccacctttcccatcaccaagcacactcccttcgtcaacacctcaacctcctcacctgattcttttcccagcttggactctcttggtttctccctgccctagggcaaggggttccatgcctgttttcagcacctgcctcttccaccagcccaaggtcattctatcaagcctggagtctcatttctctctgtccctcttcctggtggcctcttctgcatagtcattcctattcgcacatttaaatttggtgtcaacagtcccctgctctgttccacagactcactagagcataagcaccacgaggacaggggctttgtctctttagttcactgctgcacccccagcacaaagaacagggtctggaccagggcaggcactcagcaggcacgaaggaatggctgatcctctctctctgtccctccccctctctcatcatctctcttcttccactcaattcctgagccatgcggctacacccagagtctaatctacactccggctgtagccctcccagagcctcactgacatttttcaacaacctcatgaagcccttctcagcattaaaatgctctgtgcgtttcatcatttaaccttcattattctctgtgaggaaggcattataagatttttgcggccaggcacggtggctcacacctgtaatcccagcactttgggagaacgaggcaggcggatcacctgaggagttcgagacagcctagtccaacatggggaacatggtgaaacctcatctctactaaaaacacaaaaattagccaggcatggtgcctgtaatgccagctacttaggaggctgaggctggagaatcgcttgaacccgggagttggaggttgtagtgagccgagatcgcgccactgcactccagcctgggtgacagagcgagactccgtctcaaaaaaaaaaaaagatttttacagatggaggaactgagatttagagggattaagcaagtcacacagggttacaagtgacaggggtggtgactcaaacctcatttttctcattatctgtccagggagtattcaagtacaatatgcaattaacagaaataacaacgaacttttattatatttacatataggccaggtcctggacaaggggcttgcacacacacccttccagcaaatcctcacaacaaccccattgggtgggcactgcggggcatactgcacagggaagacactgaggcccagagaggatggggagctgaggctcacacacaggcaacactgagccagggcagtgaagttcatctgatgcttggtgctgatggctcagggaagatggactttaacagtggagggtcccagggggatgtggccagtcccctcagggtggtctttggattaacgttagttgttgcttaaaaaatggtggaactgggcatggtggctcatgtctgtaatttcagcactttgggagctgaggcaggaggattacttgagcccaggaattctagaccagcctgggcaacatagggagacctcatctctacaaatagtaattaaaaaattagcttgagcacttaaaaaaaaaattaagagtaggccgggcatggtggctcacacctgtaatcccaacactttgggaggccaaggcaggtggagaccagcctggccaatgtggtgaaaccccatctctactaaaaatacaaaaattagccaggcatggtgttgcacgcctgtaatcccagctagagggaaggctgaggtataagaattgcttgaacttgggagatggaggttgcagtgagctgagattgtgccactgcactccagcctgggcaacagagtgagactctgtctcaaaaaaaaaatcatcatcataagagcaaaaataaactttaaaaaaaataaaatattagcttggcatggtgttatgcctgtggtaccagctacttgggaggctgaggtgggaggatcacccgagcctgggaggttgaggccgcagtgagccatgatcattccactgcactctagcctgggtgacagggcaagactaaaaaggaaaaaaaaagaaaagaaaagaaaggcggcttacacctgtaatcccagcactttgggaggctaaggagggtggatcacctgagattaggagttcaagaccagcctggccaacatggtgctaccctgtctctactaaaaataaaaagttagccaggtgtggtggtgggcgcctgtaatcccagctactcgggagactgaggtaggagaatcgcttgaacctgggaggtagaggttgcagtgagctgagattgcaccattgcactccagcctaggtgacaagagggaaactccatctcagaaaaacaacaacaacaacaaaaacaacacccaaaaaccaaacaacaacaactacaacaaaaagagagggaatgtcttcagtaatctgtgatatgagaaaggtcctaatgtttgcaacagggactactgctggcatactgatttttacatttttattagtggttaattagtggaagtggtggctggagtagcaagagtcattcatttctcctatcctaggagggcgcttatccagaagttaggaaacagaagttccccttctgccacacaactttctgtgccaggtcaccttaggcaagtcattgacctctgtggaccttcgttttctcatctgtaacatgggatgaaagcagatgtccagcctccctcacaggattattaggaagtttaggtaagataatgataaggtgccttagagactggaaaaccctgagccatcgtaagggatagatcctaatgcagtgcgttgtcccagtgaggcagtcctggcaggaccacaggatagttcttcgtcccacagaggagggctggtctggtgcagaggctgtagttgacatcacagtcgattgataagttgatgtgatgctttgcactgggagttacacttgagagaatgactctaagatcaagaggaagagttgagttggcttctcatttaaatatttcatccctcaaacaaacagcattcacttagccatttgtcagtaaaaaagacatttttcacttacacacacactgttgggtgataataataatagtttcctttatgtatttaccatgaactaaatgttacaaggttacttcagttcttagaattctatgatgtgtatgacgtgcttactcttttgtttgtttgtttgtttgtagagatgggggtctcgcttgttgcccaggttggtcttgaactcctggcctcaagtgatcctcctgcctcggccttccaaagtgctgggattacaggtatgagccaccatgaccagcctaaagtgaattaatgtttgattctctggctagacaagccccactgtggaaaggtggtagcaacaagttgtgaaataattttgagaccatttagttcttcttggcctcaggatggcagttgtgactgatgcagcaggtgttttttttttctctttctttctttctttttttttttttttttcttgagacggagtctcgctctgttgccaggctggagtgcagtggcgtgatctctgcttaccacaacctccgactccctggttcaagcgattcccctgcctcagcctcccgagtagctgggattacaggcatgtgccaccatccccagctaatttttgtatttttcagtagagacggggtttccccatgttggccaggatggtctgatctcctgacctcgtgatccgcccgcctcagcctcccaaagtgctgggattacacgcgtgagccaccccgcccggccagagggttgtttctttagcacctcttcctctgtccctcctttctctgaatcccgtacttaaatcactccctggctactcaggaccataatccctcttgactcacccagtcaaaactcacttctcttgagtctctctgtccactgtgacattgtcatatgatgaattcaggagaactaactctgttcatgattaataggtgcaaagatgatgagtctaggaagataaaatctatctggtatgttagtggccccttaaacatctgtcaccagccttcaagttcaggtgcccctctcttttcctgggacaccctctcagtgtctaaatgtcattaaggtatttctacttaatgtaattttgtttctcttatgaatttattaaacaaatagcatttaagcattaaataatattcttctatttatacactatgtacacaactaatacatagacatttatggatttaataatccaaactgattaaaacacattattgattttatttatttatttatttatttatttatttatttatttatttttttgagacggagtcttctctgtcacccaggctggagtgcagtggcgtgatctcggctcactgcaacctctgcctcccaggttcacgccattctcctgcctcagcctcctgagtagctgggactacaggtgcccaccaccacgcttggctaatttttctgtatttttagtagagatggggtttcaccgtgttagccaggatggtctcgatctcctgaccttgtgatccacccacctcagcctcccaaagtgctgggattacaggcgtgagccactgcgcccggcctaaatattgattttagacttaaactcatttaagcatttaattaaaatctttcatttagctgggcacagtggctcatacctgtaatcccagcactttaggaggccgaggcgggtggatcacctgaggtcaggagttcgagaacaggctgaccaacatggtgaaaccctgtctctactaaaaatatacaaattagctgggcatggtggcaagcgcctataatcccagctactcaggagactgaggcagcagaatcgcttgaacccaggaggcagaggttgcagtgagccgaaatcgcgccattgcactccagcctgggtgacaagagcaagactccatcttaaaaaaaaaaaaaaaatcttg

SEQ ID NO: 10879 - DNA, 14111 bp, Homo sapiens
ggactttcttcttcctgacccagctctctctgatcccacatccattcaccttcctcctttcaccagtccttgcatctctttttcccttactccctgtccccactttctcccatgcaaacttcatctctttttctccctgctttttccctcccaggcctgattgctcgaaagcttgcccttgctcagctgcgccaggagaggtgaagtttgggcactttgaggtggatggggctttagggcattggctgctgggacccccaaaaccatgaggactgaggtgggatgggggctttgggatcaggcagctgggtgatttctcctgactctttctcttccccgtctcagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggtacacctggttgccagagggtggagaggatgaggaaaaacccagtgtctagggtgctgggagaggcctgacccagcaccccctccttttaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaaggtgtcgagagggaaatgggtgcttcccttggagggtggggtgggaactgcgaatcaaagctcctgctgatatgccccgtctgcactttcaccccagccctgcaagaaaaggtggctgaagtggaaactcggctgcgggagcaactctcagacacagagaggaggctgaacgaggctcggagggagcatgccaaggccggtgagccttgccagggtggatagggccttccaggaagaaggaagtgttaagacataaggttattattttcccctcaaagtgtgttcaaagcttcattacaggaagtaatgaaggtatccaggagtagcacagatgaattatcacatcgtgaacacacccatgtagccagcaccagattaagaaacagcatatggccggtcgcggtggcttatgcctgtaatccaagcactttgggaggccgaggtgggtgtatcacctgaggtcaggagtttgaggccagcctggacaacatggcgaaaccctgtctcgactaaaaatacaaaaattagctaggcctggtggtgggcacctgtaccccaagcttacttgtgaggctgatgtgggaagactacatgaacccgggaggtcgaggctgcagtgagccaagattgtgccactgcactcaagcctgggtgatagagaaagaccatgtgtcaaaaaaagaattgtgtaatgaatgtatcttctctaactaaatatagcagttaacatttgccacatttggtctcttatctatatacacacatatttgtacatcttttgaatcactttaagttgtaatcatttaatgttttgttgttgttgttgtttgagacagagtcttcctctgtcaccagctggagtgcagtggcatgatcttggctcactgtgacctctgcctcccgggttcaagccattctcctggctcagcctcccaagtagctgggattacaggcgcccaccaccatgcccagctagtttttgtattttcagtagagacgggattacaccatgttggccaggatggtctcgagctcctgacctcgtgatccgcccgccttggcatcccaaagtgctgggattataggcgtgagccaccacgcctaagtaagttgtaaacataagttgttcagccgcatctcccaaagccagtaaattctcctatatagctgcaatcatcacactttaagacagtgaacactaattgcacaaaatctaacccagttcatgttcagatttcccctgaggaactccaggatggttcagggatgaggaagatacttaggttcagattcccaggctcctagagcatcagcccacccctccaactgtacagaagagacagatccacagagcagaacagcctccccaagccacagagttggtgacccagcgtttgttcctgtcttcatggtgcctggctgcctctggcctgactcacacctgcctcctctgtgccttggcctctctgtagtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggtaggagacaggagggcagacaggcagacactagggcccatcctgggctggttcctgggctagaggtgtggaaagaggatggtgagggaggctctatccgggctaggtttaaccctctccttcccaggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaaggtcttgggccaagcacaaagggacaagggacaaatgcgcgcacttcaggaatctcctcttcagactctcgcatgatgagtgttgttctctgcggtccttcgaggcccttagcctcttttagcgatgcccagcttggaccaaagagcctcctctctcccattcctcatttcctgtgccagccctgtttcctctgtaaccacgagcaccttcccttgtctggtgctcatctgctgtcttccttcccagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaaggagccattgtttggaaatgttatttctgggaatctgtgggaattctccctgcagccatctctcttggagattgtgagaagtggtcccacccatagctctctctatgggtggcaccttttcaaatcctttttctaggcagctttggaaatgtttgggaagctcctgcttttctttattctcaacttttgttttaaaactcttttcttctggaagatgataaatgctaggagtggggaagatgaaacattcactcgttcaacaggaatgtcaatgccaggcactgtattagcctgggggccacttggaccctgagagcctacatcctagtgggagagagagcgagcagatgggacctaaacagatgaacgagatcgtttcaaataagtgcttgaagagaaagtacagtatgatgatatgatagaaactgactctggggagaggcctctgagcaggggaccttgtgcagaggcctgcctgaagtgggctcctgtggaggccaggaggtctctgtagagaatgctcaaggatgctgctgcgaggccgagatgtggccaagtttggattttactgtaagtcaatagaaagccattggagtacttctttaaaaacggggaagaaagccaggtgtggtggctcacgcctgtaatcctgacactttgggaggctgaggcacgcggatcacctgagctcaggagtttgagaccagcctgggcaacatggtgaaacttcgtctctactaaaatacaaaaaattagccaggtgtggtggtgtgagcctgtagtcccagctactcaggaggctgacacaggagaattgcttggacacgggaggtggaggttgcagtgagccgtgatcatgccactgcactccagcctgggtgacagagcgagactcagcctcaaaaaaagaagaagaattaaaaaaaaaaaaaaaaaacagggaagggggcccggtgttgtggctcccgcctgtaatcccagcacttttttttttttgagacagttttgctcttgttgccaggctggagtgcagtggcacaatctcagctcactgcaacctccacctcccaggttcaagcaattctcctgcctcagcctccggagtagctgaatcccagcacttttttgggaggccgaggtgagcggatcgcttgagcccaggagtttgagaccagccaacatagggagactccatctatataaaaaataaaaataaaaaacattggagggcatggtggcgtgcacccatggtcctagttactccagaggctgagttgggaggattgtttgagcccaagaggttgaggctgcaatgagctgtgatcgcaccactgcaccccagcctaagagagcgagaacctgtcctcactccccaaacaaagggaagacgcaacatgatttggtgtacattttttttcctgagggacttactggatggtcccttccagagtgaggtacacatatccacgcactgtggtcagcgattgctcccggcacccagcgcagcagatgggtgggtctaaccaggtcacttccccaggagggcataattgagcagtttccgcatcaggtccacgtgggccagcagcatgcggcaggcagcggctgtggcgcttcaggcccagggcgtccccatcagcgtacttggactgcagcagccccaggtaggcctcccacgtgttgcccacagtcttgctgcaggtgaagcagcgcacacaactcctgagctcaagtggtcctcctgtgtcagcttcccaaagtgctggcatgagccactacgcctggcctgatatatatatatatgttttttttttttttgagacggaatttcactcgttgcccaggctggagtgcaatggtgtgatctcagctcaccacaacctctgcctcctgggttcaagcgattctcctgcctcagcctcttgagtagctgggattaccaagaggcatgtgccaccatgtccggctaatatttttgtatttttagtagagacggggtttctccatgttggtcaggctggtcttgaactcccgacctcaggtgatccgcccgcttcggcctcccaaagtgctgggattacaggcgcgagccaccacaccaggcccgcgtgatgtatattttaagacctcttttgctggtggaggacaggctttgtgtgagggggagggataaacagtgggagcaagggggccaattagaagggtgttggggaggctcaggggagatggtggctcaggatgatgggctgggtttggacagggtgtggaggggcttgcaggtggatggtggaggagtgtaacgaaggtttctgcgtgagccctggagggaacagatgagatcacgccattgcataataaggtgttccttactgtggggtagcggaccaggcagggaacaacctgggaggaatcaaattttattttggacatgttacttctgaaaggctaacagacttccaggcagaaaggtccttgagggaaacgttctaggggtctctctgggaggcttagatcaaggagctgagaccaaaaggagaatgggagggaggagacgagtacaatagagttggagccaaggtcctagaggcggataggtggattcctgagggaggaggaaggggctgaggttgctggagcctggcagcttcttccggagccattggcaggactgatgcaaacagctctgggtgggaagagggaaccaggatatcctcctgtgtccttccttttctgcagtcatcctgggtggctgccagatggaattccttggatatcattgcttggaggtcccctgcatgcctgaagaaggacatggtggagagcaggatgcctggatcccatgggggaagggaagtgcccaggaaagcacgaagccccagggggagctttcagtgcggggrtgagtggggaggctggggtagtagctgacactgtcccagctgcatcccaggtttgaaargcacctcctcccycagcgcaggcatcctgcctcccaaccctgtaattayggtgsttcccaacgcccrtcgygtggtttgctcccattctttggcttccaatagttgcaagggatgaaggtggacatctctgtgattacggagatgccaagtgggtattgactgctccaggrtgtggatggagggtgtgaaaaccagggtggggtgacgcaggctctgggtcatgatrgggagagcaggcagctgggtcctgggctggaggactaaaataagggacgccaccttcaggggtgacacatcagcccaggccttcccaacgggtttgaccagttctgttctgatggtattcctgtgccactgggctggyccctcctccactcctcccctataaagcctcttggggttcccaggcacccagactcagcccaccccagctttgggggccagtacatagccatgatcctcaactggaagctcctggggatcctggtcctttgcctgcacaccagaggtgaggtgggaacagaggcagggactgcagtttggggtgatgagggatactcaagatggcggaggtgaactggacgcatggggttggggacaggaattcaggggaygcagaaggtgcatctggctcaccagaaatggctttcwggacacattgggtgggggacatggtgcagaaggtgcatttggctctcaccagaaatggtttgctggctccatgtggcaaagtcggtcaggattaacgtgggggggacgagtttcctyggagctgggatctgtgttaaggagctggggtccttgtaaagctggggtctgtgtgcctgggggccaaggtgtaacccacyttgggttgcaggttggcctgaggacaaagctagtggggtaccccaaccaggggtggatggagcttatttggagaagtctggtcagtttaaagtgggtcaagtgaacggttcagatccatcgggggtaggggttcatgacaytttaccatcagttaagtatttacaaacctaccgagagctctttgagagtgacttttttggtctgtttgtgggtcagttcaggctgcgtccatccagacaggctcctcctcctggggctggggctgggtggggctggggagagaagccctcaccacctcttacctttctccttcctcctttacaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccmtgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccscacctacctcccacccggtcttcctgcccgcgcgatcgctggggcagggctayggtactgtgttcccttctgccacctggtggccggcggcaggaactatcagtagacagctgctgcttccatgaaacggaaaaataaaaatcatgttttcttaattctgaatctaggctgctgctttaactaacacttagggtctttttcatttatttttatttatttgtttttttctttttttgagacgaagtctcgctctgtcgcccaggctggagtacagtggcacgatctcggctcactgcaagctccgcctcccgggttcacgctattctgcctcagcctcccgagtagctgggactacaggcgcccgccaccacgccaggctaattttttgtattttttagtagaggcggggtttcaccgtgttagccagagtggtctcgatctcctgacctcgtgatctgcccgcctgggcctcccaaagtgctgggattacacgcgtgagccacagcgcccggcttctttcttctttttctttcttttttttttagatggagtctcactctatgcccaggctggagtgcaatggcacgatctcggctcactgcaacctccggctcccgggttcaagccattctcctgcctcagccttctgagtagctgggattacaggtgcgcaccaccatgcccggctaatttttgtattttagtagagatggggtttcaccatgttggccaggctggtctcgaactcctgacatcgtgatctccccgcctcggcctcccaaagggctgggattacaggcgtgagccaccgtgcccggccaacacttatgtttttgactattaggatgccctcttcacagtcctaaacttacggagacctggaagtaacttgagttcctatcttgcccatgtccagcatgtaaggctctggggcttagcaggaggagggttggaaatgtcactatgcaagtcacaataacattcaggcccacatttctccctttctgagaacactatattaaagaatgggaaggcaagtttcatctctgtttaatggcctatggcttggatacccctagtggtatatgcaaaccttcccaggggtgtgtcggcaggaccagttttaagggaatcagtttccagattaatatgtgccccccgctagaatgaatctcctgcttgtcctgggcctgaccagagtgcccttcccagagccgccaaaggtcaataggaaacaaatcaacctttcccatctcattaagagattcattttctttcttttctttttttttttttttgagacgtattatctctctgtcgcccaggctggagtgcagtggcacgacagatatcagctcactgcaagcttcgcctcctggattcaagtgattctcctgcctcaacctcccgagtagctgggattacaggtgtgtgccaccacacccagataagttttctatttttagtagagatgggattttgccatgttggccaggctggtctcgaattcctgatctcatgggatctgcttgccttggcctcccaaagtgctaggattacaggtgtaaaccaccacgcctggccaagagatgcattttcaataagttacttttcatgtctttttgtgtgtttgtttgagacagggtctccatctgtcatccaggctggagtgcagtggcacgatcatggctcgtatagcttcaacctcctgggctcaagcaatcctcctatctcagcctctggcgtagctgagactacaggtgcaccacccctgactaattttttgtatttgtttagtttagttttgtttcgtttttagagatggggttttaccgtgttgcccgggcttgtctcaaactccagagctcaagtgatcggcccatcttggcctcccaaagtgctgagattacaggcacgagccaccgcgcctgaccaactttttatgtttaatccttgtgaatattcctagttttggttaactgcaataattgcaatacaaatagaataactgtttctaacacttgttcaagggcttgttcacgtattttttaaaaggatgctaacagatatgaaagttctatggcattatattcaatttgctacacttagagtgacgtgcagtctccgacagactgagcacaacaaattgtttttaattttaaaaactgacatggccaggcatggtggctcacgactgtaatcccagcatttgggaggctgaggtaggcagatcacttgaggtcagcaattcaagaccagcctggacaatggtgaaactctgtctctactaaaaatacaaaaaacttagctgggcatcccagctactcgggaagctagggcatgaggattgcttgaacctgggaggcagaggttgcagtgagccgagatcgcaccactgcactccagcctgggagacagagtgagactccatctcaaaaataataaataaataaataaatacataaatagtgatgtgatttttaacatgtatttgcaattccctgaaaagcctaccctttggaatgctattaaattattacaaatgttaaatgttgacttaaaaatgtgcaaggggctgggcgaggtggctcatgcctgtaataccagcacttcgggaggccgaatcgggtggattgcttgtggccaggagtttgagaccagcctaggcaacatggcaaaactgtttctacagaaaatttaagaaattagccagatgtggtggcccgcacctgtagtcccagctactcaggaggctgaggtgggaagattgcttgaccctgggaggttgaggctgtagtgagccaagatggcaccactgcactccagtctgggcaacagagtgagaccgtgtctcaaaacaatacaaatgtgcaagggacatagtttttcaaaatcctttaaagaggcaatcaggttagaaggacaggagctcagagatcccaatggtctactgtcaatcaagtatccgaccagggttagggatgaagaggggttaaaagaaactgaggttgcataaccttaaatttcaccacttagaacccagtttgcttatgtggtaactctcattaaaaactacatatgagaggccgggcgcggtggctcacgcctgtaatcccagcacttcgggaggccaaggcgggcgaatcacgaggtcaggagatcgagaccatcctggctaacatggtgaaacccagtctctactaaaaaatacaaaaaaaattagctgggcatggtggccggcgcctgtagtcccagctactcgggaggctgagacaggagaatggcgtgaacctgggaggtggagcttgcagtgagccgagattgtgccactgcactccagcctgggcgacagagcgagactccatctcaaaaaaacaaacaaataaaaaaccaaaaaactacacatgagatcaggcgtggtggctcacacctgtaatcctagcactttgggaggctgaggcgggtggattacctgaggtcaggagttcgagaccagcctcaccaacatggtgaatccctgtctctactaaaaatacaaaaaaattagctgggcatggtggcgggcgcctgtaatcccagcttctcaggaggctgaggcaggagaatccattgaacctgggaggcagaggttgcggtgagccaagatcgtgccactgcactgcagcctgggcgacagagcaagaccccgtctcagaaaacaaaaaacaaaaaaaaactacatgtggtccgaatgaaacaaaactaagcttagggtttaggaataatctgagaacacataagaattgtaggttgagcctagtagaattaaataggccccaagctggactggattcacccattcattcattcattatcttacttcctcaatgtgtccacgaatgccgggtgccatgggagaatataagaatataaataataaaaatatgtagtttctactcagaacttaaaattgagagagacagaatttacaggcaagtttaaataacatcaaagacagtaaaaatgcatatttcctaataatgacatgagcgagcgccaacgtaatagccttggcagtaaacgccgtgagttcagaagagtcacggtgagctggactagtcaggggaggcttctgggaggagggcccggagcgggacctgagagaagaacaggcagtgtgtctggaggatggaccaggaagggcagacccggagcctcatacagggtgcaggtacagaagctgcccccaggtgatgagctctcgtggccagaaccaccagctctagggaccagcccttgcgcgtatgtgcatcagccttcgtgtgtgctgttccctatgtctggaatggccgtcctctcccaaaccagctgcatttctcctcagggatgcctctgcctacaccactccttcccgcaccccacccgacccccaacgcccttcaccccagtcaccctatggcaatgatttattcatgtctgtcttcccttcccaggccatgaaccttgtggggcagggactgtgttctacgcatttcttcttgaacccctttaccatttttgtgcctacggactcccagagtgctaaatcactcccaacagccccgcctatgcctctgctgggaccttttccaggggcagagagctggaagcacttggaaatttttctctcccacatcctcacatgccaccaccctcccactcccccagcccgcccccaggccttaaccaacggtggacaaatatgaaggtgtcagtaccccagccctccatgagacttagcttggttccactcatgtgcttgggtcccactttcccactccctttccactcctccccaccctcattacttttttttttttttaagacagggtctcactctgtcacccaggctaaagtgcagtggcacaatcataactcattgcagtctcaacctcctgggctcaagtggtcctcctgcctcagccttctgagtagctggtactatagatgcactccactcactgggctaattttttaatttcttgcagaaatgatgtcttgccatgttgcccaggctggtctggaactcctggactcaagcaatcctcctgccttggcctcccaaagcactgggattacaggtgtgagccatcatgcccagtcccctcattacttttatttatttatttattcaatttttgagacggagtctccctctcgttgcccagactggaatgcagtggtgtgatctcggcccactgcaatctccgcctcctgagttcaagcgattctcctgcctctgcttcctgagtagctgggattacaggcatgcgccactacgcccagctaatttttgtatttttagtagaaacagggtttcaccatgttggccaggctggtctcaaactcctgacctcaggtgatctgcccgccttggcctcccaaagtgttgagattacaggcatgagccactgtgcctggcctatttatttttgagacagttctcactctgttgcccaggctggagtacagtggcacgatcacagctcactgaagcctggacccaagcgatcctcccacctaagcctcccaagtagctggatcacaggcgcatgccaccacgtctggctaattttttttgtagagattgggtcttactatattgcccaacctggtctcaaactcctgagctcaagaaaccctcctgcctccgcctctcaaagtgttgggattataggcgtgagccaccctgcccaacttctcattagttttaaataaatctcttttacttgaatctttgtctcagggcctgcttctggggaatccaacctaggatgcaaagtatttgctacacactattgcaactactttctactgcgcatgtgccatagggcactgttggtaaatgctctacagcttaagctctcgtttaatttgcataacaatgctatcatgatcatttcacagaagacagaaacaggcctagagaggtacagtgacccatgcaaggtcacacaggggacaaatggcagaactgggatttcaatttaggtctgtgctatgctaacaacactgattttaaccactacatcatcccagctctttttttttttttttttttttttgagacggagtcttgctcttttcacccaggctagagtgcaatggcacgatcttggctcactgcaacctccgc

SEQ ID NO: 10880 - DNA, 24208 bp, Homo sapiens
  misc_feature (1)...(24208): n = A,T,C or G, or insertion/deletion polymorphism (see Tables 1-2)
ccatgttgtctctactaaaaaatacaaaaattagccgggcatggtggcgggcacctgtaatcccaactacttgggaggctgaggcaggagagtcacttgaacccaggaggcggaggttgcagtgagccgaggtcgcaccactgcaccccactcttggtgacagagcaagtctccgtctcaaaaaaaaaaaaaaaagatttttccaacctaaaattgctatcaagcataaagtatgatcagctttcctctattttcacaaagtactaagctaaaagaaatatcattacatttcaaaataaaagatttatatacactaaaaagaacattattttaaaactcaatggaggctaggcacggtagctcatgcctgtaatcccaacactttgggaggctgaggtgagtagatcacttgagatcaggagtttgagaacagcctggccaagatggcaaaaccctgtctccactaaaaatacaaaaattagccaggcgtggtggcgtgtgcctgtaatcccagctattcaggaggctgaggcatgagaatcacttgagcccgggaggcggaggttgcagtgagccaagatcatgccactatactccagtctgggtgacagagcgagactccatccgccccccccctcaccccccccaccaaaaaaaaatttttttaactaaaaactcaatggggccaggcgcacggtggctcacgcctgtaatcccagcactttgggaggccaaggcgggtggatcatgaggtcaggagttcgagaccagcctggtcaatatggtgaaacctcatctctactaaaagtacagaaattagccaggcgtggtggtgcatgcctgtagtcccagctacttgggaggttgaggcaaaagaatcacttgaacccgggaggcggagtttgcaatgagctgagatcgcgccactgcactccagcctgggcaacagagcaagattctgtctcaaaaaaaaaaaaaaaacctcaatggaacgagccagttcattaggactgagtacaaggaggacggtccagttcatgcaaggccctccgagacactcctacaaagatgttcagggagacttcttctagtcatactttctcaaactcttattaaaacggcccaaggtcacactgttctctatactttcagtagtgatttcaaccaaaaaagaaaactcagaagttcttacgtatttcactggcaggactgggagcagatctgccaaagagcacttctatgagtgaggaggctgggccagaatgatacttctttagagcaatcagggctctgccaagggagaaaactaaaattagaacacctgcaattcagtgcccgagcctctgccccaatgctgccaccaactcccatgagggccacacccacaccatgacttgttgctctcttttgtgcgacaggcatgtaagaatggattagctgtgttgaaggaagatggtacttaggatttccagtcccatccacttactttttcagtcgcctgtaagtgacatcattggcaagttttaacagtctgtaggaattctctcggtccaagctcaactggaaatcgtgggactcatcaaaggccaccgtgaccgacttctgggtgacccgggtcaagatcccagtggccagctgactgccctcattagcagcatcgtacaggcccacgatatcacctgcaaaaacaaagactcagtgacacaagacactggggaaagcttcaatatcattttctgtaataaaatccactatacttcaaatattttatctttgttactttctttagtaaatgcaatcagtaacagttaaaaaaaaaaaaaagaaagtaagttaggccgggcacggtggctcacgcctgtaatcccagtactttgggaggcagaggtgggcagatcacgaggtcaggagattgagaccatcctggctaacacagtgaaagcccgtctctactaaaaatacaaaaaattagccaggcgtggtggcgggcacctgtggtcccagctactcgggaggctgaggctgcagtgagccaagattgcaccactgcactccggcctgagcgacagagtgagactccatctcagaaaaaaaaaatctcaaactctgctcaggtctgactccaacctacaggttcccctcctggccctctcctctctcaataccctcatctcatcttctccaaatccagccagtattccagtaattgttgggctaaagtctacgaaatcaaaatatgaaatttaaaactccgtcaccaccaaaacaaggcagagacacttccatagtaaaaagtacagccctggcaacgctgcttcctccaggcttccaaggctgtggttgtctaacacaagcatcccaggcgtgtggttaagaagcttcttctaactgtccctcctttccaaccaggctggcacaagtttagccaaagcatgcttggcacaagaaagggttgggaatacagaagtacacatcctgcatgtttaccagctggaccaaggctgcccattacatagaaacataaagagagtcacatgtagtttttcttttgtttttgtctgttttgagagagggtctcactttgcccccaagctagagtgcagtggcgtgatttcagctcactgcagcctcaacctcccaggttcaagcgatcctcctgcctcagcccatcaagtagcaggaactacaggcacacaccaccacatctggctaatttttctatttttttgcagagatggggttttgccacgttgcccaggctggtctcgaactcctgagatcaagtgatccacccacctcggcctcccaaagtgctaggattacaggcacccagtcacgtgtagttttaagttttctagtagccatattaagaaatttaaaagaggctgggtgcactggctcacacctgtaatcccagcactttgggaggccaaagcaggcggatcacctgaagttgggagttcgagaccagcctgaacaacatggagaaaccccgtctctactaaaaatacaaaattagccaggcacggtggcgcatgcctctaatcccagctactcgggaggctgaggcaggagaatcacttgaaccccggaggcggaggttgcagtgagccgagatcatgccactgcactccagactgggcaataagagcgaaactctgtctcaaaaaaaaaaaaaaaaaaagaaaagaaatgggtaaattattttaataagatattttttatttaacccaatatatgaaaaatattatttcaacatgtaatcagtattcagaaaaattactcaagatattcccaattgtttttttaacataatcttccaaatttggtgtgtattctgtatctgcggcaattacaagccacacttcaaacatttgatgaccacgcatggctaatggctaccattttggacaacgctgatctagacaactaaaacccacatcaattgttggacttctgattaagagttcttcattgcaacgctttattctccaactggtcattttaatccagtctttacgagggtacaagtcacggtctgaatgccagtaaatttcaatgtctgtctaggtcaatacgcacacaccagaagtaaagctgttactgggaagagctgccgcggacccgtatcgcctgggctcaaaggtgaccagcagccgtccgtacagcccagtgcgctggctggatacctgcagcttcagcaaacacacgcctcggctctggagctctttcagagagatgttctcctgccaggacctggaagacacccggtattgatgcttcaggatttttactagtttctacttccacccacccaggaaaagtaaaagagaaagaaacatagataaagatctactcacaggcactaaatatgtcccaatggaactccgaattggctccactcccaatcccgctcctcctacatccccctagggcagttaatgccacaacccttctctcagttacctgagacagatctttcaatcagcattcccctctctcctcccatctgtcactaagtcctatcaggcccctcccatttctacctggacttctctgcctctcatcctggctgccacagccccggttcaaatccacatcactgctcacctggactaaacagagcctctcaactaccttacctctggcctctccacgtccaatcaaaagcaggagacccaagaaatcctcctaaaatgcaaagctattcgcctccctcacctgcttaaccccgctgatggcccatccttcatacacagaacagaagactagctccttagccaggcccttcccaggctcgccctgccagtctgctcagcatcctcagaaagagccactgccatgggggctgactctgtccttggcaccacgctgagcacctgactgacaggggatcgtttcattctcagagcaagcctgtgaggtgggaatcatcccagttttacagatgaagtaagtaaggctcagagacagaacctgcaaagtcacacagccataaatgaaacagctgggattctaagaaactcaacataactgcaaaagctctccattgccatgatcaaaagcatctcagacaaatcctacccacatatggctgactgcaaactctggaagcagactgcctgacagcaaatcgggctacactgtgtcaccccggggcaagttacttaacccctctctgtctccatctccttagacggaaaatgacagtaacagaaacctacactgcggccgggcacggtggctcacgcctgtaatcccaacactttgggaggccaaggcgggcagaccacgaggtcaggagatcgagaccatcctggccaacatggtgaaaccctgtctctactaaaaatacaaaaaattagcaggacgtggtggcgcgcctgtagtcccagccactcaggaggctgaggcaggagaatcgcttgaacccgggagatggaagctgcagtaagccgagatcgtgccactgcactccagcctgggcgacagagagagactctgtctaaaaaaaaaaaaaagaaaaagaaaaaaaagaaacttacactgtagggttggcatgggatgaggtgtaaaagaattaacgcatggaaagtacgtaagtgttagctctgattgttttggacaagtaaatagtcccattcggaaacaagcccggctctcacatggctccccacacctctcaggacggctccccaccctaccccgcacccaccagcttaactccaattttccttcaggcaccactccctccttgaagccaccatgaccctccccagggaagggccttcctcctccaggctctttccccgcgacacgcacgcagccggccctggacgcactggaggggaagggactctctgcttatgcccagcccgccgctggccggatcgggggcagccagtgcacctgactcatgctgccggggcctgactgagaatgggcgcaaaccatgtttactgaatgaataagggaaagggctgctaactcgctgcgggtggaactggggtcggggccagggcccaggagtgtaagcttagtggggggtctcgggtcgggaaatcaaagtgcttcttaagggtccccaaacggaacgcgctgcccaggaagtgatgagactgacaactcgggaggtggccaagcaggggacggacgatccctgcccctgactcgaagggtcggagacgaaattcccgccccagactatgaggccgagcccctcggagactctgcccgggacacggcgggaccgaccgcgagggagcggcgccggcggcctcccgtacctgcgctcctccacctccgcgtctctctcgagctccagcaggtccagttgcttggtcacgaagctctccacagctgccgaggccatcgccgccgccggcctgggcccctagaagccgacgtcccgcttctgcgccgggccggtgttacagcggaccggtgttccccgccgggcccgtgcgttacgcacgcggttcgcgtcgtttccgtttccggccgaggctgcgggaagatggcggcggccatggcagcatcttccctgacggtcaccttagggcggctggcgtccgcgtgcagccacagcatcctgagaccttyggggcccggagcaggtgagacctgggatatgggaggaagggaggacgcagagcgagcgctgctccctgcggtctcgccacgtatgtgcctgggtccgaccyggtgccttgtgtgttgatcgcatttgtggtgaatatagcacgggttttggagtcgggggaacccaggttcagattttgattccttcagttagtagcctgaatactgacaatagcccttgaactttggtataggccctatgttatgggggagaagagtgaggctcagaggagctaggtaacgtgcccagggtcacacagcggggaagtggaagaagagtacttcaggcgcagtcatttcggctccaaagcctgtgcttgaaccactgcccccaggctgcgagctggtctgaaaaatggtgatggatatcctcgcctaatctgaactcattctgcaaaagaaacagccgtatttaaggcgctgggctgatacgaggctccaaaaaggttatgtycgttaaaaactctataaatctctgcttgaaaatggttggagtgtgtatttgtgtgcatgagtgtttatgtatgttttaaacctgggtttcatgtctcaccatgacccccaaaaatggaaaactggatctaactctatattggacgatattaaaagaatagtaccataattcccaaaacttggaagcaacccagatgtccttcaggagatgaatggttacataaactgtaggacatccatacagtagaatattatgcagcaataaaaagaaatgagtcatgaagagacatggaggaaacttacatacatgttactaagtaaaagaagccaacctgaaaaggggacatcttgtatgtttcccactatgacattctggaaaaggcaaatctaaggagacagtaaaaagttasatggggggtaagaggattgggggagaaaaggataaataggtggagctcagaggatttttagggcagtgaaactattctgtatgatataatggtagatacatgtcattataagtttgtccaaatccatagaatgtacactaccaagggtgaacccctaatgtagactatggactttggataacaatgatgtgtcaatgtaggttcatcaattgtaaagattgtaccactctggtgagggatgttgataggaagctgtgggcacatggacaggggacatatgggaactctctgtaccttccactcaattttggtgtgaaactaaaactgtgctaaaaaataaagtctattaagaaattaataataatcacagagttgggccagaggcaatgtagatgccaaaattggccatgagttggtaactgttgaacctggaaagggataattgagagagttcactattctgttctctttacttttgtatgcttgacattttccataataaaacttaggtttaagtaggcaggaaagtttttacaaaagcagtgggacttactccattctacctacctacatgaaaccacccctccaatgctatgttcaagtacagactcacgcrttaggagagaaagacacacagtgaagcgagtagagacaaggtgaccaaaacagtgagcagctggggccttgaagagtgagcaaaggagacgtgatggaagtacacagtcacagtctctaggactacctaaaggaaatcctgtgggagaggaaggagactgtttgttccctggggacccaaaaacaaagctwgaagcaaattaggtacagaagcctgctaagtttttaatagtgggatggatttgccaatgggttgactgagtagtgtgcgagagaagagtcaaaactgatggaggtttggggcctgagcaactgggaggatgaagttgccctcatgtgagagggaggagtgtgggagaagcaggcatgggaagaaatgaggagcctctggaggtgtgaggtgctcgtcagacacgagtggctaaggcagatagataggtgggtatgcaaaaccaggagagaagccctggctggaggtgtaaacttgggagtcaccagcacattgggggtgtttaaatccatcggactggatgcagtcaccagaggaatggccatgggcggagaggaggtcaaggccaagggttgagccccggatgcccaaatgggagaggagaggagaaagcagccgaggagatgcaaatggggagctggtgctaatgggtgaactttaaaaaggtggtttttatggtgtgtaaattatagctgagtttctttaaaagtggttattgagaaactgttctctgctttttacacctaagcacttattttgatcccctgtcttctcagtagattgaatgtctttgtttcctggtgtattcctggtgtatgcgttatctacggttacatcagaaattaccccaaaacttagcagcttaaaacatttattaactcacaccagttctgagagccaggaacacagaagcagcttaagtggctggttctggctcagggtcttagcttgcagcaagcaagtctgcaggggctgtagttatctcaagactccactgcgccagcggctggagaatctacctgcaaggtcgttcccatgggtgttggcgataggcctagttccccgccatgtggacctctaggtagggctgctcacagcagggcagccctaaggccagagatcagaaagggtgagcacaggcatccaagatggaagtcccagttggttatcacctcatcccagaagccacgtgctagcatgtctgtcactagctgttggacacacaggccactcccaggggkctaacmggggtaagaatagcaggaggcggggcccagcagggccatcttggaggctgctcccacgcttgggcacagatcagagtctgaacctaccaggcacttagtcaaggcatgagttagtggacgggtggttctggtctcaggcgcttgtagatgatgtggctaactgatctcaacacatataaccagtagctgtaagtgacgttcttgtagttttgctcacctaggygtttctgtgggcaggctgtcatgcagtggttcataccatgtaccaggagcagcagctgtgcatttagcatcataaagggcagtttgcatttgtagtattaatggtaatgatctgtgtttctcttcttccctcagcctccctttggtctgcttctcgaaggttcaattcacagagcacttcatatctaccagggtaatatcaaaatgtgggttttggtgcctcttttcctttcatttgtagaaccatctttctaaagtcaaaacttcctaccttttggttctcaataatatttaaatttcctcttttgtttttaagagacagagtttcactatgtttcccagactggttttgaactcctggcctaaagtggtcctcccgcctcagcctcctgagtagctgggattacaggcatgcaccaccactttcagctttaacttttttgacggtatttttctgagacccttaaaagaagacgtaactgcaagagaccaaagagaaattctgtatgtgtttgctctcttttattatggaggagcttgaagtcttaactcaagatttctgatgaggaagtttgtatcagagtctctaagagaaactcattatttgaaaaagcacattcagtgttaaaattttatacttgagaaaacatttttaggtatcataaactgcagaaaacattcgacaaagttccactcactggtgggagacacaggagcagtgcagggatagcagttactgtagggacccccccggggtgcagttccggctgcccctcacagcctgggacgccaggcttctgcaagatggaagtaatgttcatttctatctgcatgggtgttggagaggattaagtaaatgtatacatttaaagctcttagaacagtgcctggcatacagtcagcactcacaaaacattggctgctggaactgctgctgggactccagggatcctctgcagtggggagatgtgggagtctttcttgcttctcaaagaagcggcaaaacattckgagcataggaagaagttgtaagtgagcatgtgggtaggttgtgcctactacccctgtgtcctgtgtgagaggttagcaccttcctgccagcgtgttcttctcacactgggcactgctgaacccgtatggggagactagacatcaaacaggtcaaagacgttttgtagagagcagcaccttccttgtcctccttgtctctcaaggtcattgaccaaccacagatcacggagttcatgtctctaggagctccaagccctaccccactgggaaagcattcattcctctcccagattggtgtggagcccctcctgcgcgccagccaacaggacgggtgggcctggtctttggtgtggaggccggtgcattttgcatatggagcaagtcgttttcttcctcctaatgcaaccctggagtagaaagactgaaattttactttgcagtggcagcagcaataaaagcttaaaaacggttctgaataattcggtttgggatctacctaccctccctctttgyagactacagaaagaaagaccccacctccttttgaatctaggcccccctctttctttcctcccttcctctcccctccacctacctgaggctgagcaggcaggggagagttaggaaatgaagaagatcttgggctgggcacggtggctcatgcctgtaatcccagaattttgggaggccgaggtgggcggatcacttgaggccaggagttcgagaccagcctggccaatgtggcgaaaccccatctctactaaaaatacaaaaattagccagatgtggtggcatgtgcctgtaatcccagctactaaggtgactgaggcaggagaatcgctggaaccctggaggcagaggttgcagtgagctgagatcatgccaccgcactctarcctgggtgacagagcgagactccgtctcaaaaaaaaaaggcattgcccgcaccaagcttggcatcctgasggtggggaggggaagtggctggggacygcagtgctatagctgctgagactgagcactcctaacacccgaccctcactggccatgctgggaccggctgtgaacagtagccatctaatacctaacacagccctttcaggcgggtgcttgttttcccatttgctcagttgtagacaccagracacagaattgtctggggttccgagccagttctgcctggcactcacctgggtgtgaaggaagagcaggcacctacctaggaggaggtggaggtggagcagggaacgtcatggtcctgtttgagcaggatgtggtgaagggtcattggagctgccattccagggccactggatgccaagggaggcgggagagctgctggccctgtgtcctgggttgtggggaaagtagaggcagcctgtgcctccaagataaatgtgccccaagacaccacaagcccagccttcttggatgggcacccttccagcactgagaagtacccaagtgagggctcttttgcagaacaatgagagttcctgctttgattattgaatgatgagccattgttccctgtggttctaaaaggatacagggagcctgtcctcggggttaccccagaggggcggggcctgtccgaaagagcgagccttttgttgccggggatcccttcctaacatttgtgtgtggccatttcttagaggatttgagctgccttttcaggtgcttgtgacatttgtctacgaaatgtgttttacagatatgttcctaaaacatccctgagttcaccaccttggccagaagttgttctgccagacccagttgaggagaccagacaccatgcaggtaagacctccctgggagacagaagctagagggcaccacctagaccctgctccagtcagccacagaggttgtcaccaggccacagaacgaggcttcatgtttccagatgctcccagacacagcacagtgccagcactcatgtccattttcaccagttaacaccagaatttcagatgtttttcattaactactccttgaacacctgccacactgcaggcaggtggcataattgagggcagggggcccctgctccatctcgtctgcttctgttggtgggtgcagcgacagctctccccagttagcacagttaagcacaattactggaagccggtgccacccgggctgttggagaaacatgcagaggtatcaggactcatgtcgacctggagcccgtgtcagaagggacaggatcattagccactcttgccatgatcctcgctttccagaacactggaaatcaagatcctcgagtggaatcttcttatatgttaaataccgtttgagattccgtgcgagtgaaacaagtctgccaagagtttcaccctcggtgctggtgcttctggtgttgacagtgtttccagggcaggcactctgtcgtcccttctgtgtgtctcgccctcggtcaggccggggggtcggtgcccattaaatgcttgttcagagtaaacggtgcagaagagaggggactgtgacctgggtcagagcagagataacaggaactgagcacggagcccctctgggcacaggcgtgcagggggaacgcgtcctgccccaggggtgggatatggggttgggatacggggggctcctcattgcaaagtcctctcctttcgcttcctggggtttgcacacttctggtctgctggctcctcattctcatgagaatgaaccaggtggagggtttcgcccaccctagagttgtagaaacctagccaggcgtgccgagtgcttaggcgagggagttgcatgaggcggtttgggcgttctctgcagtcttggggagcttccttctgtgaaagccccatgtgccacagtgctggtgctcctgaagcagcagactgaccctgtgcctgcccttgtgcctgcagggggtggagcaggggctgggccgccagcagtgaggtgctcacaaggggtgctggctrtcaggtccaccctagggccccacsaccaggagctgcacatcacactgcagcgcgtgggggagcaggtgagggtgactgcccacccacccgccttcccctgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtgagaccacygagcttctctggatattcarggactcagccaccaagtatgtaatctccacgccccagctcacacggaggagggaccctcgccgaccccgtctcaggtggaggccaacaaagctgaggctcagaagggactttggggggcgcccacggcggggctggggtccaagggcagggcaggcttccactgctctgagggcggtgcctggcccagcaggtctgctccctggaggaagggagacagcacataaaacagtgctgagggcagaaacatgtctttattgtgttccagtcttattagtatattcccatagaaaaatgcttgattgcaaagataataaaaatcccggttaaggatgtagtgcactttatagcccctgtctatgaggaaaaaactgttaagtttctgctaagacagtactctgtcattagctttgacagctgctgctgtttttaaatagtaaacactggttgacaggcatttccctgggtgctaatttacctcaccgaccattcaaaactgcatggtctaggccaggcatggtggctcacactgrtgacccaccacattgggaggccaaggtgggggattgcttgaactcaggagttcaagactagcctgggcaacatggtgagacctcagagacctcatctctactaaaattccaaacaattaggtgggcatggtggcacacacatgtagtcccagctatttgtggggctgaagtagaaggatcatttgagcctgggaagttgaggctgcagtgagccgtgattggccactgcactcgagcctgggcaacacagcgagaccctgtctcaaaaaaaactgcatggtttgtctgtttattattatttttcagactcagtctcgctctgtcacccaggctggagtgcaatggcgcagtcttggctcactgcaacccccacctcctgggttcaagtgattctcctgcctcagcctcccgagtagctaggattacaggtgcatgccaccacgccctgctaatttttatatttttagttgagatggggtttcaccatattggtcaggctggtctcgaactcctgacctcaggtgatccacctgccttggcctcccaaagcgctgggattataggcatgagccaacgtgcctggccagtctgtttatttagctaggcatttctagccttcagctatgattctatttgctgggggcgtctatttgatttttgcctactctttttttttgtttgtttgtttgagaaggagttttgctcttgttgtccaggctggagtacagtggcacaatctcggctcactgcaacctctgccttccgggttcaagtgattctcctgcctcagcctcctgagtagctgggattacaggcatgcactaccatgcctggctaattttgtatttttagtagagatggggtttctccatgttggtcaggctggtcttgaactcccaacctcaggcagtctgcccgcctcggcctcccacagtgttgggattacaggcgtgagccaccacgcccggcctgcccactctttttataaaattataattacctctgcaacaggtaatttttctgggatgcttaattatcaatataagttacatggttttctttatgaattaaagctcctcctctgaaggcagatgtttgcatatttgaaacatttcacattaacaaaaaattctagaaagcccctcctaagcagattgttttttataacaggaaacccagtgggagtgcacatgtcatgctgaaacaaactctaaaaatacttattttattatttgtcactatctaacatgcgtrtccgctgagtttgttatatgatatactttgtctctagacatttaagttgagtatgattggattttttcttatcagtaaaatttaagatgawctccaacatctaataaaaacactgtaggccgtgcgtggtggctcacgcctgtwatcccagcactttgggaagccgaggcgggcagatcacctgaggtcagtttgagaccagcctagccaacatggtgaaaccccatctctaataaaaataccaaaaaaaattagccggggtttgtggtgggcgcctgtagtcccagctactcagggggctgaggcaggagaatcacttgaacctgggaggcagaggttgcagcaagccaagatcacgccactgcactccagcctgggtgacagagcgagactctgggtcacaaaaagaagaaagaacactgttgcatttggaagcaaagatgtcttcatctgcagccacacttggtgtcgtgatttcccggcattgagaatggttgcctggctcttgagaattttgcagtcgttaaaagaatacaggagagcctcaatcattgcaatattagtagaactgtaaactgcgccaagagacacaatggtatgatttgtgctttttctctctatgttatgctttgatagaaagggttttgtttttttttgtttatttgttttctttgagacagagtctcgctctgtcgcccaggctggagtgcagtggtgcaatctcagcctcctgagtagctgggactacaggtgcatgccgccacgcccagctaagtttttgtatttttttagtagagactaatttcaccgtgttagccaggatggtctccatctcctgaccttgtgatccacccacctcggcctcccaaagtgctgggattacaggcatgagccaccgcacctggccggagatagaaagggtttttgaagtcaccgttggtatgaggattacagcagctatctggatgcatatccatggtatctaataatcaaattgtgcgtctcctctgagggttggagcatttcccttaggcagccccacggctgtgcagtgctgccacttgtcagctcacagccccggttgtagatattaaagagatcattagacagcagatgaaattcatgtcacaatgttttcagtctttctcattttgtgtggtgttgacatcactacctgttattagcaactgttcttactcatcgtaatgagccactgatgaaacacacctgttgaatttttcaggtcctgctggttggggcagacaacttcacgctgcttggcaagccactcctcgggtaatggctgtgaagtgctgggctttgtctggggctccagggctggacatgcagacagtggtcacagtgcaattaggccaggtggggagttgcattcatattctttgttgacaccaaacacaacatttatacttaataatagtggacatttagggcccatgagaacatccagaccaaattattggtctcttgctgtttcatgacagtgtggtcctctgaagatttgttcagactccctggaactgttctttgtggtcctttttcrtggttttcaaaatgtttccattgagggcgtattacttttataatcaacaaaagagaaagtataacttcattttagaaattctcacctaaggcatttgaaaaataatccaaaaggtacattattgttgatttttcttccttctagaaaggatcttgttcgagtagaagccacagtcattgaaaagacagaatcatggccaagaatcattatgagattcaggaaaaggaaaaacttcaagaagaaaagaagtaagttagagaaagtaccgctgggccctgttgcacggtgctggttgcccaggcgcatgcggacggagggtgtggggcacgtgggtctcgggacaggaagcccaggcaggtctcaacctggctgccactgcccacttgccaccctcatcctagagggagcacccagagggtccagcctcgctccccttctcctccacgctccacgcgtgaccccacctcgctccccttctcctccaccctccgcacgtgaccccacctcgctccccttctcctccaccctccgcgcgtgaccccacctcgctccccttctcctccaccctccgcgcgtgaccccacctcgctccccttctcctccaccctccgcgcgtgaccccacctcgctccccttctcctccaccctccgcgcgtgaacccacctcgctccccttctccaccctccacgcgtgaccccacctcgctccccttctcctccaccctccacgcatgaccccactttgttccaacccatgaygcctagcactgtccccaaagcagcagtgaatccgcaagcaggtgtagggctgtcctagcaggtctgcactgaggacatcccccayagtgggcatcctgagggatggcacccacggggcatgggccacatagctgagcggctgcagaattctgtccctcacagctcttgctataactgcagttgccggcctaaaccaccaacagtgggcatagttaaatatacccagaatactggtattggctgtcaccttagagtcatctgggtaggggagcctctcrtgtaccttctgacacttccaggtagcctcaaggtcactcaggtggggccatcctcccacgcactccagaagtcacagcatagacagtgtgggaggagaggtgaggtgccagcgcagggcactcctggccatgaggcgtctggtgtcccagcctctgcacctgccaacagagtgaacgaacaagctagcgaggcagtcagtgcacacctggagataaacacggccatgtgcagcaggggacgttgccggggtcgcgctggctggggagggctgtgtgcagagcccctgctgtaactgatgacaacagtcagggtctgtggtcaagcctgtgacatcctttctttcagtcrtcacgaccccgcagactgtcctccggataaacagcattgagattgctccgtgtttgttgtgattaccgagttaatacttacaaaaggataaaaataaactcctgcttcccaaggagaccaggtttctgtgttctggtttaaagccgtgcatgcctgttgtagatagtttaactggagcagcatgtctgtaagcaccaggcccccgagccagagaaaacaggaactcggggagaatgacaagcatggccctcccagggctggataaatagtattcttggcagccctccaccccatgtggcggcggcagggcccaggggagtggggcggggacgcagctgggacttggagctgacatcaagagaggcgcaacctagattccacgagatggacaagaacagcaaattccatctgagtaatcgaaacagatctgtcgccagcggggcttttgtaaggctggggttcagagcaggtggcctcgggtccctgctcctggcccttctgcctcacacagtcgagcaggggcagggatcacagtgcagggggagtgacacagcgcagcagggatccaggagggctgggcaggacaggaggagggacagctggggagtgggcacagcacattctgggagctgacaacagcagggacagagcagaggcccaggctgtgctgaactcagtcttggaagtagcaggcagacccagagggcttgggctgctgggatcgataggggtggctgaggcaggcagcagggcctgctgggagctacccaggtgagaagggacagggtcctggagccagagtagcgaaggaaccagcaaagggaagggcctgggcgtggggatgaggggctctcagatgatgccaggcccctggtttggttcattcacaaagacagagccatcctccaaaagaagagttagggcttcaagtgacaagatacaaacctgtaatccgacccggctaagtattttccccaggagtcctacagggagtcgctctgagatctggagataagaaaacccctcaggtgcccagcgccctggtaggtgctggcccagctcccccatcgtgttctccgcgtgcagcagggggcgccagcccagtgggctgagcgctcctggtcccgcccatcccgggcatcctgaatttggagacgtgagaacccagagagtcaggcctccagggctccacatgggttggagcgaagctgggggtggtgggagggacctggggctgtggtgtgcttgcgtctttaatgcagccacatctggaagtaataaatttctaaatgcggtagctcatgctatctccatctgaaagtgatgtctctagaatcatgaggcctcgcatcctttccccttacccaccccctctctaggttctctcccagccagcccagcagcgtctcgtgtggtctctgttctatgtggaggttataggatgtttaagacgggaatcgttggcctattccatattctttgacataagcacatctccatttcttactatgcttgaaataaaaaacaggttctggagactcctgctgcagtcaggcagttcagcttggtggtggggtggggtgtaagcatgggttctgcagctagagagctgagtgtgaatcccagacccaccgcagtgagctgggtgtgatcttgagcaagttacccagcccctgtctcatctgtcaaatgggggtcatcctagcaccaaacctaatgcgttgctgtgaggaatccagcagttagcaagccacccacagcaagtgctcagtcagtgttcactatttgtattacctacagccactgccgtctggggaactgtttggtgacatgcctataaaatattaccaatattggctgggtgtggtggctcacgcctataatcccagcactttgggaggctgaggcgggcagatcacttgaagtcaggagtttgagaccagcctggccaacatggtgaaaccctgtctctactaaaaatacaaaaattagccaggtatggtggcgtgcacctgaaatcccagctactggggaggctgaggcaagagaatcgcttgagccccagaggcaaaggctgcagtgagcagagataacgccactgcactccagcctgggagacagagtgagactctgtctcaataaataaataaatatatatatatataaatatataaaatattatcaatatcaaactggtgaaagttaactccttttaaaaactagacaagtttcctcaaattatcacacgatccagcagttccacttctggggctatacacaaaggaattgacaacagggtcttttttttttaagatggaattttgctcttgttgcccaggctggagtgcagtggtgtgatctcgacccactgcaacctccacctcctgggttcaagtgattgtcgtgcctcagcctcctgagtagctgggattacaggcgtgcaccaccacacccggctaattttttgtatttttagtagagacgggttttcaccatgttggccaggctggtcttgaactccggacctcaggtgatccaccgcctcagcctcccaaagtgctgggattacaggcatgaaccatgacacccggccaacagcaaggtcttgaagagacatttgtacaaccatgttcgtagcagcactgttcacaatggccaaaaggtggaagcaacccaagtgtccatccatggatggaaggatcaacaaaatgtggtccatccacacaatggaatatcattcagccatagaaaggaaggaaattcttatgcatgtcacaacacggatgaaccttgaagacactgtgctcagtgagagaagccagacacaaaaagacaagcatttgtatgtttctgcttacatgaggtccctagagtagtcgaattccagcagcagaaagtagtaggatggtgggtgccaggagctggaggagggaggagtaggaggtgagtgtttaatggggacagaacaggcctggtgctgtggctcatgcctgtaatcccagcactttgggaggccaaggtggacggatcacctgaggtcgggggttcgagaccagcctgaccaacatggggaaaccccgtctctactaaaaatacaaaattagccaggtgtggtggcgcatgcctgtaatcccagatactcaggaggctgaagcaggagaatcgcttgaacccgnnnnnnnnnnnnnnnnnnnntggtctcaaactcctggccttaagcaatcctcccaccttggcctctcaaagtgctggaattacaggcatgagccaccgtgcctggccacaagttaactatataaatgcaatagtctctataaaatcctgtagtgaaatcctatgattttgtgttatcttggcattcatttttaatcttcctctaacacacctgagctccttttaaaatgcttactttctctcgttgtgctttgaatgaaatataaatttgctaccctggtttctcaaaaactctgtaagggcttcagctataacttgttccatttacagtggcataatttagtctaactgtccttttaaaccagtgagttttgcctatcttgtggctaaaatttaaaaatcaaagctataagatttgtatttatgtttgtttgtatttgtattaatacatgtgtatacatgtctgttggtatactgtctacttggtaccaaactgacttacaaataagcaagtcctcattattaataagccaaaggctgggcgtggtggctcatgcctgtaatcccagcactttgggaggccgaggcatgtggatcagccaaggtcaggagttcgtgaccagcctgaccaacatggtgaaaccccatctctactaaatacaaaaaattagccaggcgtggtggcatgcgcctgtaatcccagctacttgggaggctgaggtaggagaatcgcttgaacctgagaggcgggggttgcagtgagccaagatcacgccattgttacactccagcctgggtgacgagcgaaactccgtctcaaaaaaaaaaaaaaaaaaagcctaaatgcttttcaagttcacatgactttagtaatctttgataaatgaaactagttttaaaactgttggtgcccaggcatggtggttcacacctgtaatcccagcactttgggaggccgaagtgggaggatcgcttgaagccaggagtttgagaccagcctgggcaacacaagaccctacctctatttaaaattttaaaaactcacagaaagtagttagatgaaaaataaaaggctaaaaaataaaatgaaataaacttaataacttctggtaaaataagataaaaatatctgcagaatttcaaacatttctgcctgggtctataggtcagagtaatttatacaatcttggttagatgttttaaggtcataaaactgttgcttctgtgatttttgtttcttgtttttttttctttttgagatggagtcttgctctgtcatccaggctggagtgcaatagcgcgatcttagctcactgcaacctccacctcccgggttcaagcaattctcttgcctcagcctcccaagtagctgggactgtaggtgcacagcaccataccaggttaattttttttgtatttttagtagagacaggatttcaccatgttggccaggctggtctcgaactcctgacctcatgtgatccgcctcctcagtctcccaaagtgctgggattacaggcttgagccaccacatgttgacatgatttttgctgagaaaaatgcagaatttcatttaccttttagaaaacttaaaatttccccaaatttgctcttctaagactccttccttttgccatctttgataccacatgaagaaatctaggggagacttctagcagccctgagaccccttgaagaacatagaaaaaggtgccttgcacatcccctatttggggttttctgttttccttgtggagccccaagagtcatgagctcccaagaccctcaggtctaaagggctgctgtcttctgcattgagttaccagatctctttggcttttgagatacccaggattattttgtactgtgagagagcgcttgacctctgtgtgtgcggcaactggcaagtcactggcaagggctacaattttggaggtggctgacggtggttgcagtgaatagttattactgcaggggcttcttgtttctttgtgactttctataagaaaggcacgatttgaggccaggtgcggtggctcatgtctgtaatctcagcactttgggaggctgaggcaggcagatcacctgaggttaggagtttgagactagcctggccagcatggcgaaacgctgtctgtactaaaaatacaaaaatcagccaggcgtggtagcatgcacctgtggtcccagctacttgagaggatgaggcaggagaatcgcatgaacccaggaggcagaggttgcagtgagccaagatcgcgccactgcactccagcctgggtgacagagcgagactcttgtctcgaaaagaaagagagagagaaggaaggaaggaaggaaggacggaaggaaggaaggagaaagaggaagggaggatgaggaggaaagggagggagggaggaaaagaaagaaggaaggaagggagggagggatggagggggagagagaggagagagagagagagaaatacaaagaaaggaagaaaaggaaggaaggaaagaaaaagaaagggaaaggaaaggaaggaaggaaggaggaaagagaagaaagaaaggttagaacacttggacgcaatggaaacaccacagaggaagaaggctcccatggtggatgggctgatcacagaaggggctgattggcactggaccacacatcagccttgggggatgccttttcagtgtgctgcttgtggaagctctgtggaggccggtcctagagcatttccttcttatcggggacccaagtttcagtgtaaaaatggaatccttcatttctgggggtctagatgctctgccctccagctacacctgttttttgcataaataagtatccggccctggaaactgcaaaagctttgttggttctgtttggtaatggactccaccctgagctcattggtccagttggaaaatagaaattaaactagaaactatgtatctatttacac

SEQ ID NO: 10881 - DNA, 144232 bp, Homo sapiens
  misc_feature (1)...(144232): n = A,T,C or G, or insertion/deletion polymorphism (see Tables 1-2)
gaaaccccgtctctactaaaattacaaaaattagcctggtgtggtggtgcgcacctgtgcttccagctactcgggaggctgcggtgggagaactgcttgaacccaggaggcagaggttgcagtgagctgagattgtgccgctgcgctccagcctgcgtgacaagaacgagactccgtctcaaaaaacaaaaacaaaaaaactcctgggctcaagtgaccctactcagcctctcaagtggctaggactataggtatgtgctaccatgcccagccaattttttttttttttaatttatgttttgagatggagtccaggctggaatgcagtggcatgatttcggctcactgccacctccatcccccaggttcaagcaattctttgcgtcagcctcccaagtagctgggattacagacgcccgccaccatgcccagctaatttgttgtatttttagtagagacagggtttcaccatgttggccaggccggtctggaactcctgacctcgtgatccacccacctcggcctcccaaagtgctgggattacagatgtgagccaccgcgcctggcataatttttattttttgtagagacagggtctcaccatgtggaccgggctgtgggttgcatttagatgagtgggaccagattgcagtttttgtatgagctgagattacctgccatcatgagaaggctctgtctggccagcactgaagttctggtgccagctgcccctttcctctcttcccttgcctgtatcatcagatgtttacacttgcaaaagggatggggctaggatgaatctgtaacccctgaatagagttagaattattgaatgttaaagctgaaggggaaaattgaggttatctttttcaattcctttttgtaaaatcttactcattttgtaaaatcgggaaactgatccccaagaggtgaagggacttgactgaaatagcccaatactgaatctcctgccttccagggctcctgctgtacaagcctacaggagagcattttattgtatttaatttttttgagatggagtcttgctatgtcacctaggctgaagtgcagtggcacgatcttggctcactgcaaccttagcctcccgggttcaagcgattctcctgcctcagcctcccgagtagctgggattacaggcacccaccatcatgcccggttgatttttgtatttttagtagagatgaggtttcagtatgttagctaggctggtctcgaactcctgacctcaagtgatctgcccgccttggcctcccaaagtgtgggattacaggtgtgagaaacagctgatacttttgaatttagtactgaattctattaatcaactgatggcttaagcgaagcctggtggcccaaggaaactgagctcggagaaagtgtaaatgctagatggttcttgcaaacatgggtgtaaagtagctagctggtcattgcttagatctattctatgacagctgtttagaagatggtggactttttgtttttgtttttggagatggagtttcgctcttgttgcctaggctggagtgccatggcacaatctcagctcactgcaacctccacctcccgggttcaagtgattctcctgccttagcctcccaagaagctgggattacaggcatgcgccaccatgcccggctaattttgttttagtagagatggagtttcaccatgttggtcaggctggtcttgaactcctaacctcaggtgatctgcctgctttggcctcccaaagtgatagtattaaacgttagatagtatctaaacgatagtgctgggattacacgcgtgagccagcatgcccagccttcttcttcttctttttttttttaatagagacagggtctccctatgttgcctaggctggtctggaactcccggactcaagcgatcctcccacctcggcctcccaaagtgatagtattaaacgtgtgagccacctcacctagccagatggtggactattcatttctatttcctttctgagccactgctgggaagttaattccttagtttttttaaaaaactctgctttatgtctgagctattctactctagctagagccacatataactttcacctgcattcttgggtttttggacagaagctttcttttctttttataactgagatctccatcaaggaaagatgacaccctgaaccccgtcctacccccaaggtttatgcctttatcatcctaaagcatcctatgtcctattaaatttagctttgaagataagaccacaatataaagtaataacaggataacctggtttctgaaccttcctgggtgataatgcctgtatttaagtaaagtcatgcacaggtctttccttaaaaaaccgagtcataaggggagaaagtgcttggttgcagaataaaacccttcctggactcttctcccttttttcttttctcttctcttcttctcttctctctctctttctctctctctctctctccccctccctccctcctttcttttttttttttttttgggggttggggatggagtctcagtctgtctcccaggctggagcacagtggtgcgatctcagcccactgcaagctctgcctcccgggttcaagcgactctcctgcctcagcctcctgagtagttgggattaaaggcgcatgccaccacgcccggctgattttttttttgtatttttagtagagacagggtttcaccatgttggtcagactggtctcaaactcctgaccttgtgatccgcccgcctcagcctcccaaagtgctgggattacaggcgtgagccactgtgcccggccttctccttttctttttttccattccttcagcagaaggccaaaccttctgtctctgcaaacaaagcaactgaggcctgaattttgaactcatttatgcagaagcctctgtaagttccagaatataaaagtttatctgtccactttggtctgtggccatgtgaatttatctgacgggtagggatatttttcagctgtgtagggatctaactggtgaggcgagctgagtcatcctgcccatcaacccctgctttacggatgatggaatttaggcaaatcacttcacttccccattttcaatgtcaatgtaaaatcaaggtaaatgtaaaaaagggagttgaactagactctgatgagcttagatctcttcctgccctaatagtctatacttctatgacagcctttgaccgtcacttgctttaatccttctaagccctttgaaggcaaggccgaagagttggtcttcttaaagctcttaggccatatttgttaatttctgtgtaccattaactggctgcacagttatggaaaccacagaatcctgaacttctagaacttctatcatctgtaaagcatgggttgtcaggggagtctctcaagccttttccaacttacaaaactcgacaattctgaatgggggttcccggcagccatcttcccttcaccctagtgttcttctggaggaagtacaatgacacaatccacgggcagtttggaggatttcctagtagcatgtggttaagtgtccccttaaataaatgagtattggccgggtgcggtagctcatgcctataatcccagcaattagggaggccgaagcaggcagattacttgagcccaggagtttgagaccaacccgggcaacatagtgaggctgtgtctctacaaaaaaattaaaaaatgaggtgggaggatcgcttgagcccgggaggtcgaggctgcaatgagcagagatcacgctactgcactcccatgatgggagtgagaccctgcctctaaacaaataaataagtaggtatcttgccaaaggcttggaaatccgctatccttgggagtttcactgtgatttaatttgtcgagagaagatttggcccgagggcatgaaaaaaattgtattattgtagaccatcagagtgttattccagggtcagctaagagcaagtttcaaaacgcaggctctggatggaaatggggtggctactgttgtaggcagacctcgagcaaaagcactgcggatttctcttcttcttaaaggcgtagcccggagaacagctttgacaagttgtttctggcccaagttgtcaaaaccagtctgtatttggctaaagttcatctgcattctctatttaaaaaaaatttccaaacctaacctggatagctgcctcacgatgttgaatcactggctacaaccgagtcaccattttacaagactatggtgttgaaacctgagcccctaatttaagtgtcctcctcaggagttccactgaggaaagtcctttttcggaaaccacagaaggaaaactcagggttagtggtactcattacactggaaggagcttttccacttggctgcattgtttatttacacactgtaagttcctattttggacactcttcccttaattatgagaagaggggtttctattatatcatctggccggatgtattgttgaccccaaaaatgccacataacggtgcttgggacatggggagatgcatggtttagagatttcagcataagcacttggcatcttttttacaagcaagacacctatcttaccatgatttgcaaaaacaatcagatcactgagaaatctcattcccggggtagaaaccatctcctgcgagaaggagctggcacggagtgtctaaccgtgcaaacaaaaccggcttccaggttgacaagttgtaattgctcttccccagttggctccggggagctttttctaagactgacgccccccatgtttggtgacattttatatacgccacctaacaaacttctatgacctgtcttgctagggtggggggaataaaaagaaaagacgacaacaacctagaaggaaataacccatttcctctgcaaaaccatcttcccttgctacggaactgcttggcgacaccagcgctttcctgcggttggcagcccgggaaccttgaagttgcgcgggaccggccgtcagccgctgacagttctgacagtccaggtggaggacccgcgctctgccgggaaatccccggcttcccgctggggacaaacggtggccgccgcagggagtgctgtgtttgggggtcgggggaggcagggagccccactttccctcgcgctgcctcagtgcccggcctgcgtgcgcgcgccagcctggggtaggaaggtacctctgacatttcgctcctgcgacgcgcaggcaacttcatgcggaaaatccgcggaggggctgagcctggagcccccgactcttccgacgtcccggagcccccaacccggggcagggggcactcaaaggccaggcgtgcctttaggtatcttccgggacccaactgtaccagggtcacggacattcaactctcagctacccacaccggcgcgagcgcgtcatcccggtggccctgggcattcctaactgtcagagcgaatatttttgggaataacctctccaaaatgtgaagatgttcagtggtctcctccgcctcccatcccaaaaaaaggccccaacacatattttttaaaaaacaacccacatcccacaatcaaacttttaaacatgtaaaataataaaccaactcaccaagttagaagggaagagaataaacccccaaaggctcccaataaggcggaggcttggcctccccctccttataagccgctcggtaacatgagaaaaggattaaccccttagggggcgggcccgactctagcgcaagttggctcgggctggtgaggcccgagcgcccgggccctccacccactcccgcgactcgggcacccgagccacaccctccccccgccccccaccccggccgcctgcgacccgggccgtgcgtgctgccgcccgcgccccggccccgcgtcgctgcctagctcttatcctataccggctgcagccggtctccgccggcctcgggggcgcgccgccgccgaccatgtgctgcgagcgctgagcgcagccaaggagggggcctgcctggcgcgcgcgcgccgtcccacgtggacctgagccgcgccggtcgcgcgcccgccagcctgccgcctgggctgggggtcacgaaaggtaaccgcgtcgcggtccggggccgggccgcccccgccagcgccgccggggtccttggcacaacgccccgatctcccaacccgggtgcgcctctgcgcgcgtgacccgcccagaccccggagctttgctgcaacgctagtaggagcgcgagcgtgcagggtgttgggggtgcctgcatcctgtctcggagcacctcggccaggcgcgagcgcgcgggtccccgtccccacccccgggcgccttcccggcgcgcccaccgcccagtcccgcccgcgccctgaggatttagggatttagcggcgagggggaacacgcgcgcgccggggctgatcccgcgcggcgctcgcggctgcggcggcttcgcgcccgccccgggcagaacaggttccttccagtttgggtgtgagctgcgcgcgcggcgcctgagttcctcctgcagcgcccacttcccccagtttcgtcaactcgcgcacccccacagttccccttccggcagtggggagggagtgtcgcagtgggccccagggagcgagcggccgggccgctgcgggtgccttgcttcccccactttgctgcaccggcagcagcggcagcaacagcatccgcgttgcgcgaaaggaatgtgagcagccgggctgagtcagcatccccggcccggggcgcgcgcgcaccctccaggcagtggcggcgtcggcacaggtgcatggctcccatacccgcggggagccctctgtaagggacctggaggtttagacagtccgtgcccctcatcccgtagtccccgaccccaaggtcaccgtgaactaagcggatgatgcacgcgaaatctcaggagctcctcatggggacaaagcatgtgtcagatcctagacatttcagagcctgcgggggcgcaaacttagcttcttggtctctacctcacatcccgagggcaaatttggaaactgctcggaagcaaaggccatgttatttgcattcgtatgcagactttggcgccggctgctgccttcattggggttcggagaatgtggttctgatgtcagaaactcaagagagcctagtttgggagtgcatgcacggagggtcgccaccgggaggagtcggcgatctgaattttaataaaaatccttccttgctcgctgagttctctcaccattttgggataggctctcctgagttaaatgccatcctttgccgttgacaagttctggttgtgtaagtggggagaagattcgttggtacagggtgccttgtatggccagtagtgtacagccaaggggccgctgagcagctttgcaaccttgtaggcgtaatttaacctcgtagagcgtmaatttctccagatctgtaaaatggggatggaggtggtattcccagaattggagggtttaatttatggtacttgtaaagtgcggatcgcagtgactggcatttggtaaggcctcagtacccattagctcttgctgctgttacgatttatgctttaccaaggccaattaattgctgactccaacacactccctgtgagagagagcccttttttgagttgttcttcaaaggatccatatataatgatatttagaaactgatttgaacacttcatgctaatgcagggctgcctgtaagataatctttgatatttaggatcttacactttaatacttaggacctgttactgtactctatatggaaatatcatgtgcaatatgacagcatattctgtatgtcttaggaacctaaaggtgcagccagccatttatacctgagtgactcgaagcaagtcacataaaatctctgtacttcagtctcttgatttaaaaaatgactcaaattatacctaaatcctcaggagtgaatgaatgattggaaaaatcacatctgaatgtttgagcaagtgaaacctggcttttggggagcatgattctaataataataataataataataatagatttttgttactaatgtgttactattcttatattttattaatattaatcttttttaaatgtttgctttgtcctcaacactgcattaagtgccatacatgtaatgcaatgttaaccgcatcagtaaccttctgtagttgacactcattattcccattttacagatgaggaaagtggaggcactgagcactggagggattgacctaaggttacaccatgtttatagatacacactagcactttttaccactagagctcatccaaagatgacatttgccatctgtgtttgaataatggagaggtagctggaaacccaacctacgcacagccttgctagtcacaaaaaagtcacgcaacatgacttttgcccaccctagttagaggctggcttcaccttgttccctcaatcctagtgagaccaagcgtgaaaacccctgcttttttaacttctccagagaaagcactgcattgccatgctaatcaacgcccccttgcccccaaacaaaactaactctgtttagttctaaataagaacaaaagaacctttggagtctggagtacaggaccagaaaaatcaggaaatcaagtgaagggctcagctcccctcttagcctctcctgttgtgtctgcctgatcccaagtggcaggcagagccccctctcggctttcctttacagtgggcaagaccatcatgatgcccttaagaagacccccaacatcttcttggggaaaaagttggctcttcagagctgtccccaaggctccctcttttagccctcttgcatagggtcatttgcatgagaacagattcctttgtgtaaagttggcctgcctgttctctgtccacgtttatagtccttcaagtcttcgtgttgggttgctaggcagatatgaccctggcttgcaaataagctcactgcatttaccagcctgtgagaacttcaacttgggtaagtagactgaaaggaatctggtctggacctctgggaagagggtcccgcaagcctgcttttgggggctgactcttcagggcagccatcaaagggggagaatatgtgaagggggcttccatgggaggcttcgatggcccacccacccttccattcttcctcttccagtctctgttccacccaccatgctcccacccaggggcttgtgttctgggcaagtgacttgtatgccactgaagcaatttcttgctttaaaactttaatatctgcttctccaattggccaggaacttcacacactctgccatctagcaacagtgaaccgatggtacaggtagttctgctaggtttattttgtgatttgggttcctcccccgcagcaccccgccaaatttcacagtttgtaggaaggcagggcccttcaaactgggaaacacacacttctgggagaatttaaagatttgccaaggggttctgaggcacagatagtgatgacgatgataataataatactacagagttgtgtgcatggcttagtacagttgctaagttaactgaattaacacgtgcaaggggcttagcactgggattggctcatggtcaggttccctaactcttggctgcgactctttcaacctgtgagtcctgggggattgaggaggatggcgatcagggaagccttcaactggcagagaggaccttgggagaactggcaaggggtgctgagccaagggagaggtgaacagcatgagaagaaggtaggaggtaggtgaggccattctgtatttggggacagtgaggtcaccttcccactcgtgtgtgtgggcggccgatgattgatttctgtcatacctgttaccatttggtgcagtatcgatgtatcgttggtgtctgtcattaactctgaagtaacttttacttgatcagtactgaatttcattcctaggcttctcagtcttcatagttgactgctcctgtagttttgccatttattactgcttaaaaattaaaaaaaaaaatagagaacatagcctccgggaggcttctataaattatctcaagcctgttgcaaaagtcctagaaaacaaacccaggctgagtgtgataatcctagtgcttttggcatgaaggcaggaggattgcttgaagaccaaacgtttgagaccagcctgggcaacacggcaagacaccacatctaagacaaattttttttttttttttttttttttttgagatggagtcttcctctgttgcccaggctggagtgcagtggcgcgatcttggctcactgcaacctctgcctcccgggttcaagcaattctcctgcctcagcctcccaagtagctgggactacaggtgtgtgccaccatgcctggctaatttttgtacttttagtagagacagggttttaccatgttggccaggctggtctcgaactcctggcctcaggtgatccacccacctcagcctcccacagtgctgggattataggcatgagccactgctccggcctaaaaaatatatatttttaaaaaattagctgggtgtggtggtgctgtcacaccactgcacttcagcctgggcaacagagtaagaccctgtctcaaaccaaccaaccaactccaaatctcagaacaaaattatttaaatcacattacatttaggagtgaatgcacgtcacattaaactgtgtgacacagttgtgggtcgtgggatctcattggcaatattgggaagggctgtgtgtgggaccagtggattttgccccgatcgagtcacgctttcttcagatagttgttgaagttgttccacctgccctgttcctcaaggcccaatgaataaaaacctgctctcctgctgtgtttcttgcctaaagggagatgctgactttccctatcttgtctaaacaggtacctcctgtcctgtgtttctagattcccaggaacaataggcaatgttaagcttccattttaaccctttaggagcagtgcctccgtgagtttccagatggctaggggacgatgcgaagaaactacaaggatgctgcaggattgtgttgtgggcaaatggtgaggaggggccccgccctgctgtgatcggtgggggcctgtggagttaggtgagctttgtagggatacacagcaggactgggtccagggagcatccatccctccatccttccctcccatgcccatcgttcatccgtccatccacccaagcggcctctgctcatccatagcccactcgtgagcactgacaactgctgttgtctcccaggccacaaaaccacacctcagaggatgtggttccttctctcatagtgtgtatagtttagttcagaagacaggacacatgcgattgttacgtaaaacagcatttcaacaagtacaattttacaagtgagaattacaagtgaatgtcttctaagaaagaacttagaaaagtcatctaagttgaggggaatgatgagatgaagctggcagggcgaggcagagcaggctgggctgttgatgttcatgttacatgcactcatccagcaaatattgactgaataccttctgggccgggtgccggaattatgcagtgcataaactatacagaatgtccctgcctttacagagtttccgccctggagttgtagatctttcttgcttgagcacctagctagccaagcatcctggacaaagagttcttttgaaatgtttctgatatggaaatgtaacttccattttcaattaacatcaacaaaggggagattcccctcacacgcatcctacatcttgacctcatattgttaaattgtccgaaaccagatttgctggaaggcagcatactccaaggatgccagctattattagagtctgcttggctgaagggacctggctcaggtttagccaagatggcacagatagtcatgggattgtgtaacaaggaaccatagtttggaacgttgaaaatgtaaactgaaatcagtctttatttcctctttgccttgtttgtgactatggtggcgtgtttgtagcttctgtcttctctaggttcagaaaccagcatcagagcttgcttaacaaacaattctggcagattcagccagtagctgcagggagtctggattttgccatctatactcagaatagttatgtttttatctttttttaaaattaaaaaaattttttttctaatagagatggggtcttgctatgttgcccaggttggtctggaactcctggggtcaggtgatcctcctgtctcrgcatcccagagtgttgggattacaggcgtgagccgctgtgcccagccattatgttttattttaatgttagtaacgctttggcttgcatagcacatttttagtgtgttctcatatttattatccctttatcctcaaaacaatcaagagatggactaacagtagccaatatttcttagcacttactgagaacttgggttggattatttcattctcacattgtgtttggggttgagaaagtttactgtgactctttttttttttttttttttcccctgatatctaattccaggccaaaactccatttttcaggtaagggaggaaactgagacacaaagagattctgtaacatatccatggtcacacagctggcaaatcactgctgaatcccggatacatactcctctggaaataacacatctcaaaagtcaattccccaaaaggcaaatttgctaagtaactgcttcactaaattgtttttttcctaaatttgggtcttacccctatttctgcccctacctgagccttggcttcagagattcctaaaactttaggggaatctgtcttggggtgctcaggatgccataataaaataccatggactaggctgggcttggtgccccacatctgtaatcccagcaatttgggagggtgaggtgggtggatcactttgagatcaggagttcaagaccagtctggtgaaaccctgtctctactaaaaatataaaaattagctgggcatggtggtgtgcatctgtagtcccagctacttgtgaggctgaggcacgagaatcacttgaacccaggaggtggaggttgcagtgagctgagattgctctactgccctccagcctgggtgacagagcgggatcctgtctcaaaaaaaaaaaaaaaaaaaaaagagaagaacactactgtagactaacaacagaaatttacaaaaatacagcccaaacaacagaaatttattgtttacagttctggaggctggccagtttggttcctggtgagggctctcttcctggcctgcagacagccaccttcttgctgtgtcctcacatggcagagagagtgagcaagcaagttctctgatgtttcttcttgtaaaggcactaatcccattatctcatgacctcatctaagccttatcacccctccaaaggcctatcttcaaatatcatcacactgagagttagggcttcaacatacaaattttgggggcacacaaacttttagtttataaaaacatatttcattgagaaagtagaatggatccagggcaaggataaatctacaaaaatagaaaagatagtacaaagcactgtttttcttaagagaaagtttcctattctcatgcaaaaatgacaaagggaaaaaaattgaacttttttttttttttttttttttgagacagagtctcactctgttgcccaggctggagtgcagtggcactgtgttggctcactgcaacctccgtctcctgggttcaagcaattctcctgcctcagcctcctgagtagccaggattacaggcgcccaccaccacgcccggctaatttttatatttttagtagagatggggtttcaccatgttgaccaggctggtctcgaactcctgacgtcaggtgatctgcccacctcggcctcccaaagtgctgggattacaggcatgagccaccgcgcctagctgaaaaaatggaacgttgacacgtaaaccactgatcaggctgaacatgacaaggggaaagatatgatgcataaggtgggcctgccaaaaaaaaaatcgaacctggatcggatctcatcctagatctacaagccagtttaccaggaaaacgggtccagggaacatttcaatagaggatacaatcagctaaatccaaaatttgagaaatgttacagggcaaacaccgtaatttatttacaaatctatgcagagaaaggaagaggggagccataaatgaaaagaaaagagacacgtgaaccaagtgcagtgtgttgtgaaccttgtctggatactgattagaacaaaccaactgttaaaaaaatactgatgagataatggaggacatttgaactctgattggatttttgatgatactaaccaattgttaatttttaaaaggagggtgttatggaattgtagttatatagtaagaattaacttttagagaattgtaccaaaatacttctggataaaattatatgatatttggtattgctttttttttttttttttaagagacagggtcttgctctgttgcccaggctggagtgcagtgacatgatcacagctcacttgcagccttgaactcctgagctccagccatcttcccacttcagcctccctagcagctgggactacaggcacatgccaccatatccagttattttgttgttgttgttgttgcagagagatggggtctcgctttgttgccaaggctggcctctaacccctggccgcaggtgatcctcctgcctcagcctcccaaagcgctgggattacacgtgtggcccaccacgcctggcctggggcttatttcaaaataatccagcatatgtggagagggaggctaagggaaattgaaggagagagccagcctgaccatgtgttgataattgttgaattgaaatgttgggtaagtacatgtgagtttctcaacttttgtgtgtttgacaacttccataataaaatgtttaataagtgataagtaaatacagctttgtaaaaggttcttaaaaatgtggcaaacaggcttccagtgagcgaatttcagacattgacctggagctttcttcttgatcatacccctcaggatttttcttctcaagtggaggatagacttttagaggaaagacgttattcagaggtccatctcctctctctgatctgtgagcgaggacacagatataatttccgcagggctactgggtttttagatgcatggcgtgatgccacctaggctctctcaaactggctcctgcaacatggctttcttctgtgacagtctcaacaggtggttcgagcctaaaactaggcaggatgtcatatgccccctgtggatgggtttcctggcatcgttgggttcacagaaatgatattgcccgaaacagtgtctggtgtgaggtctccaagctttaaaaaaaaaaaaagccactttgggaggccaaggtgggtagatcacgaagtcaggagatcgagaccatcctggctaacatggtgaaaccccgtctctactaaaaatacaaaaaattagccgggcgtggtggcgggcgcctgtagtcccagctactcgggaggctgaggcaggagaatggtgtgaacctggaaggcggagcttgcagtgagccgagatcgcaccactgcactccagcctgggtgacagagtgagactccgtctcaaaaaaaaaaaaaaagcattttaattacgtaagtgaaattgctctcccaggctggatagaggcattcaaagatgtcttgtgcatcttctgttgagcttagactactacatcttggcccctacactctaagaaagcagtctttccaagttgggctagcctcaaaattacatattggggtctatgggcaaaagcctgggacacaaggatgtttattacatgtagataataaataaccctttgtcctggctatcgtggtaactgggttttccttttcacctggatggactagggtgaggcaacatgtaaggaagtgctcactgcccaggtggtgcgagtacagggtggctacccgagcagaagggccacctcctgacgttttgtgccctaggcattttgcttgtctcgctctagcactgtctctcacctggactcacctggacccatgcaagagactcctaactcagctgcttctttcatctgctgccctgcggggcatttgtgtattctcaacagggcagggattctgttacaatgtaaaccagagcctgctgctcttgctgaatccctctggcttcccatctctcgcagcaaaagcctttctttcctctctgaytaatccctgcccttcctttctccattgcttctgcagtggcttctttgccgctccttgcttgtgccagacctcagcctttcccagtttctctgcctttcctgcttggcttcctgatggctgcgtagcttcctccctgacctcacacagatccttatccaaattgtgttttctcgatgagattgtcccagaccaccccctttaactttgcagcctccatcccatgcctgagctccttctttgatgttcttcacgctatttacattttattgatttcatttctcccctcactgtcaaaaaagtaagtggtgtgagggcagggacttttgtctgtttcatttacggctgtatgcactatgcctggtttaaaatctgtcagtcagtacaaatttggtggacagatgacagaatgcgttggggagttgcttccgacaacacgtgagcagctgatgcccaaggccccttctgacagcccctgatggctcgtggccgccagccagcacacagaccatgttctgatctggggagtaaaacaacagcagtccacatcccagagacctgctcccccctgctcttttgtcttttttggcctcggctcatcagatgcttttgtctctggaaaaccaacagaaccctctgccagaaaggtctgcccgaccttcttgttatttcagctgttttcaaggttctctaggaggatgcttggccacagggaggcccatgggaaacgagggtcaggtgatgaagtgagtggctcaggaagcccaaggacttcagctctgtgttttcagacactgctcagcagatcttcaggttgctgcattccattcgcttctcagtgcttctggcccacagcctgcctgtgggtcatttggctgtttatcagtacctttacccctaagcaagcctggaaactgaagggaggtcaaacttgagcacacttagcagccctgctttaaaatgggggtcgtggagaagaataggaatcatgggtaaagctgattgtcaactaaagttcactctgctcctgcttggggagcatgagacatgggaaattgtttatgcttgtgctcaacaaggatctttcacagtcagttgtgctctgatggagcagatgggccttcgttgtgggatttgttgactgacgtggccragtaccttctgccccagtggaaggaggggtgaatgctgtatttgccaaagactctgcctttctttatagccaggagtgctccttccctgtgtctactctcctttctgagagtgatggagaaagaaaaagctggcaaaataacatcagataagatctgagggtagcaagtaaggccattttcttttcttcctttgttctaggggctagatgcaatcaaatgcttggcttatatagctgtatgtttggaggtattgttttcagagacaggatcttgctctgttgcccaggctggagtacagtggcaccatcatagctcgccacagccttgaactcctgggctccagtggtccttccacctcagtttcccaagtatctgggattgtagatgtacaccaccatgcgtggctaattttttaatttttttgtagagatcaggtctcgccatcttgcccaggctggtctccaactctcaggctcaagcagtcctcccaccttgcctcccaaagtgctgggattacaggcatgagccactgagtctggctatggaaccattttccttatatttttgtttcgttttattttttgagatggagtctcactctgtcacccaggttggagtgcagtggcgcaatctcagctcactgcaacccccgcctcccaggttcaagcgattctcctgcctcagcctcccaagcagctgggactacaggtgcacgccactatgcctggctaattttttgtatttttagtagagatggggcttcaccatgttgaccaggctggtcttgaactcctgacctcaggtgrtctgcctgccttggcttcccaaagtgctgagattacaggcatgagccaccgcacccagccccattttccttatagcacttgagctcaacgtttgagcttagatcttaatcaaagtctgtacctgggcatccattctttgagtgtctggtctgccttttccatttagttaacaaaaatggggaaaggattaaatgtttccctggaggtgtgggtgtgaagaataatgcagtggtctgctggctagattcgcttatttccattctatgaacattttaagtaatgattctctttgaaaatcctcaatggaatgtttcatcatggaacactgaagaaacacaatctgtttatttatattcccacctaaattttagcttctttcttaagtgawttttttttccctgaagtcttgtacatgggntccattctgaaatggattattgaccaggcrtgaggccactctagtgttccaagctaagaagctttaagaggaaaagtctcctgtgtctgttgcacatggtcagaagccagtagaatgatctcggaatcaagcagcaggtccacaggtgtttgttaaccaccctccttgtgctgaggctctttctcctgaaaagggagatgcctttggagtcttaagatcaacaaataccagttgagtctaattgagtttgagataatacatctccttttgggaaacagaagaatttgcatttctgaacaattgattcattggcctccagatgacatgactgtttacttggatttccttttagtttgattaagtacatatttgcccattcttttggtttttatcccggtcttccaaaatttacatacctctaaccacccccatccatgtggattgatcaattgggttggcttgcaaggatgtacaactggaaaaagtgtctgtcataatcccaggcctatcttttttacacagtggttctcctttaatctgctccatacactggatgttcaactgaagctttgttgttgttgttgttaattttagatttaaaaaatacagataaggtctcactatgttggacaggctgatcttgaaccgctagcctcaagtaatccttccgcctcggcctcccaaagtgttgggattacaggaatgaaccacaatgcccagccaactgaaatttttgtttggtccacaatttcaactctgttcctccttattaaacttgcaaattggctggatgtggtgactcatgcatgtaatcccagcactttgagaggttgaggtgggaggatcacttgaacccaggagttccagactggcctgggcaatatagtgagatccagtctgtacaaaaagtaaaaaaattagctgggcgtggtggcatacacttgtaattctagctacccgggaggctgaggcagaaggatcgtttgaacccaggagtttgagattgcagtgagctgggatctgtctctttaaaaataaatacataaataaaataaacttgcaaatttagggcttttaagtgaactagagctaatctagttttatccttggctccatttgcaacctgcagcttaaagtataaccttcaattcccgtctttcaaaactcaagtctgatttgtcgtttttatttgtccactgaagttgagtcatcagttagattaagcagtttcctttttcttcttgcactagcctcatgatgtttttgttttccagcaactttgctgcttaaagtgtgatccaaagacgagcagtayaggcctcacatgggcttgttagaaatacagatcccaggcccagccttacctactgaatctgcggtttaatcaacataaaatccacagcagattcatatgtacctccatgtgtaagatgcaccactggttgaacatgtctttagattttcttattaaaattacatggctaggatgcaaagggacacatttccatgaaaaaaattttttgaaattttttctaacattttattatgaaaattacaaacatacagcaaaattaaaagagttctttagtaagcacccatatatctgctacctagattctattattaactttttaaaaccatttccttttcccccagattaacttctgtcaagaattttggctgggcctgggtgtggtggctcacacctgtaatcccagcacttaaggaggccaaggcgggcagatcacttgagaggtcaggagttcgagaccagcctggccaacatggtgaaaccccgtttctaccaaaaatacaaaaattagctggggtgtgttggtgggcacctgtaatcccagctactaggaggctgaggcatgagaatttcttttttctttttcttctttttttttttgagatggagttttgttcttgttgcccaggctggagtgcagtggtgcgatctcagctcgccgcaatctctgcctcctgggttcaagcgattctcttgcctcagcctcccaagtagctgggattgcaggcatacgccaccatgcccggctcattttgtatttttagtagaactggggtttctccatgttggtcaggctggtctcaaactcccaacctcaggtgatccgcccgccttgacctcccaaagtgctgggattacaggtgtgaaccaccgctccctgcgagaatttcttgaacccgggaggcggaggtttcagtgagccgagattgtgccattgcactccagcctgggtgacagagtgagactcagtctcaaaaaaaaaagaattttagctggtcatagtggcacatgcctgtaatcccagctatgtgggaggttgaggcaagaggatgacttgagccaggagttcaagactggcctaggcaacgtagcaggaccctatctccaaaaatttttttaaatgtagaaacattaggttatagcttgactgttacaaataaccatgtcttggtaataagggtctcacctctccttctggaattctcagtggcacactgggatttagcagcattgggggctggtcctggtcccacccagaacactgggcctcaatatcctcatctctacagtgagtgggttggcagagatcatctctaatgttacttccaaccctgtcgctataggtccattgcgaatattattatcatcactatttttcaggtggagaaactgatgaaccagttaaatatttgaataaaaacatctrttggcatggaaaagtgattatttcctaagctactgagtaaaacacagctgcactggcagttttaactctgttttcttgtcaatttttgttctttcaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcygtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggngggagtgagtttctcaggatttctttatcctcttgtggatttttgcatcagtggraaaacaagaggacagaagccaaactttgtgattattttggccgatgacatggggtggggtgacctgggagcaaactgggcagaaacaaaggacactgccaaccttgataagatggcttcggagggaatgaggtgagtcttgagatgccaggccagcctttctttggatgtcttactcccgttcttgagaggggawggggccgtgcaaagcacttaaagagtcattgatggacccatgctgatttagttaatttattaattaatttggtttgaagccagcatagcatcgtgaagaaatccagccatctagcacccatccatctatctagtaacattcattatgtgttaggagctaggaatacagaggtgaacaagataaaacatttttgccctcaagttattcattgtctggtagagaagacaggttaaaaggaaagtaaggggctaggtacagtggctcatggctgtaatcccaatgctttgggagactcaggtgggaggttcacctgagcccatgattttgggaccagcttgggcaacctggcaagatcccacttctacaaaaaataaaagcaaattagctagcggtggtggcacgctcctgtggtctcagctactcgggaggctgaagtgggagtgtgtctggaattggtgggttcttggtctcactgacttcaagaatgaagctgcaaaccctcgcggtgagtgttacagctcttaaggtggcacgtctggagtttgttccttctgatgttcagatgtgttcggagtttcttccttctggtgggttcatggtctcactggctcaggagtgaagctgcagaccttcacggtgagtgttacagttcttaaggcggtgcgtctggagttgttcgttcctcccggtgggctcgtggtctcgctggcttcaggagtgaagctgcagaccttcatggtgagtgttacagctcataaaagcagygtggacccaaagagtgagcagtagcaagatttattgcagagagcgaaagaacaaagcttccacagtgtggaaagggacctgagcgggttgccactgctggctcgggcagcctgcttttattctcttatctggccccacccacatcctgctgattggtagagctgagtggcctgttttgacagggtgctgattggtgtgtttacaaaccttgagctagatacagagtgccgattggtgtatttacaatccctgagctagacataaaggttctccaaggccccaccagactcaggagcccagctggcttcacccrgtggatcccgcaccggygctgcaggtggagctgcctgccagtcccgcgccctgcgcctgcactcctcagcctttgggtggtcgatgggactgggcgctgtggagcagggggtggtgctcgaggaggctcgggccgcacaggagcccacggagggggtgggaggctcaggcatggcgggctgcaggtcccgagccctgccccacaggaaggcagctaaggctcggtgagaaatcgagygcagtgctggtgggctggccctgctgagggacctagtacaccctccgcagctgctggcccgggttctaagcccctcattgcccggggcccgcagggccagctggctgctccgagtgyggggcccgccaagcccacgcccacccggaactccagctggcccrcaagcgcagcacgcagccccagttcccgctcgcgcctctcsctccacacctccctgcaagccgagggagccggctctcgccttggccagcctagaaaggggatcctacagtgcagcggtgggctgaagggctcaagtgccaccaaagtgggagcccaggcagaggaggcgccgagagcgagcgagggctgtgaggactgccagcacgctgtcacctctcaggaggatcactggagcccaggagttcaaggttgcagtgagctatgattgtgccactgcactccagtgtgggtcacagagcgagactctgtctcttaaaaaataagtaaataggctgggtgcagtggctcacgcctgtagcactttgggaggctgaggcaggtggatcacctgaggtcaagagttcgagactagcctggccaacctgccgaaaccctctctctactaaaaatacaaaatgtagccgggcgcagtggcaggcacctgtgaccccagctactcgggaggctgaggcaggagaatcacttgaacctgggaggcagaggttgcagtgagctgagatcgcaccactgcactccagcctgggcaataagagtgagactctgtctaaaaaaaaataaataaaataaaaaagtaaataaataaagaaagaaagggaaataagaattataagcaaatagcttctgagcccacatccagagttttttgtttgtttgtttgttttgttgtgttttttttttgagatggagttccgctcttgttgcccaggttggcgtgcagtggcacgatctcagctcactgcaacctccatctcccgggttcaagcgattctcctgcctcagcctcccgagtagctgggattacaggtgtgtgccacctggggagaaaccccagagatcgggtttctccatgttggttagtctggtctcaaactcccaacctcaggtgatccgcccgtctcggcctcccaaaatgctgggattacaagcgtgagccaccacacccagccccaacatccagagtttttggagaacagaagcgagggtgtggaacccaacctggggtttcaagggaggagatggcctttgaagagcaaaagagagtctgtgaggcgtgggagatgtgactcacttatttatgaaaggcgtggcttacacttaaggcatactgaactctaagggaccacaaaagaggagcctatgcatctgatgagttgaagtgtttagaaaacagctattgcagatttttgttaaaacacccagctcctttcccttcttagatggagaacaagcgttagagctttcagacttcaggattttcttcttgggctaacattggtctgattgtccagctcggattctgtctgcactgggcgaaactcctccatgtggttcggggggaatcatttcagctcaccgcttaggatgacgcatagggcatctccacagagttttggccacttgcatcctagagcttgatgcttttcctgagatacgcgcccttggtgggtggtagtttctgcatctggtctcacccactccagttcttcctcacctccatcaaggtgaactttgtagaaacactcttctgcttccagtccttcaaagacattttttagccctaaggataaaacccataccccataccacagctaacaaactggagtttggctgggtgtggtggctcacgcctgtaattccagcactttaggaggccaaggtgggcacatcacttgacaggagttcaagaccagcctggccaacatggcgaaatcccatctctactgaaaatgcaaaaattagccagatgtggcggtgcacgggagaacctgggagacagaggttgcagtgatctgagattgcactgctgcactccagcccgggcaacagactgagactctgtctcaaaacaaacaaacaaaaccaacaaaaccccaaactgatttcttctccactcttctctcttgcagtggtctttggatgagccctcccttcatctgtgtgatgggttcatcctggtgcactctccacttcctctgtttaattagtttctactcactacttaggtctcagttgtacacgagggcctcaggaaagctttcgtggatgcctcgggtgttctgtgatggtccttgctgctttctgtggtggctgttcaatcatctgaccactacattgggttgaatagcatcctccctaaattcatgtccatctagaacctcagaatgtgaccatatttggaaacagggtctttgcaaatgttattaattaaggctctcgatgatctcagaatcgatttagggtgggtcctaaatccagtgacatttccttataagaagaggagaagacacagggacacacagagagagatggtgacgtgaagatggaggcagagattggagccatgcctctacaagccaggaacaccaaggaccgctggcaaccagcagaaccaggagagaggcatggaacagattctccctcagagcctccagaaggtaccagcccggccgacatcttgatttcagacttttagcctcctgtactgtactttttttttttttttttttttgacggagtcttgctctgtcgcccaggttggagtgcagtagtgcgatcttggctcactgcaacctccacctcccaggttcaagcgattctccagcctcagcctcccaagtagctgggattacaagcatctgctgccatgcctggctaatttttgtatttttgtagagatggggtttcaccatgttggctaggctagtctcgaacccctgacctcaagtgatccactcgccttggcctcccaaagtgctgcgattacaggtctgagccaccacgcctggcctgtactgttgttttaagccacacagcttgtggtaatttgttatggcagccacagaaaacttacacacctccctcctagctctggacttcaggaagaaaaatgcctcatctgttctttcccgcttatattcctagcatgtaacacagtgcttggtacgtagtgggcaattaataaatatttgttcatcaataaatgggctctaggagctcaagatgccctggaatgtcaccccaaattttgcatgtaggaatacttttctggggagagagttcatccattcatgaacatttaccagattctccraagggcgtgggttgccaaatgcttaggaacttccgctttcagtgtttagcaggttagcggggaaatattagtcccattatttaagctgagatttgcgaggcctacacgttttttttttctcatgtgctgtctctactgtcacactctcatcctgagcagaaagggcgactcaggggtcagatgccaaatgtggttcgttgggctttccttctccccacccccttatgaaagtgtttctttccatctgagccttgtgacagtggccaggtggctagccctctggcctgaggtccacggcttttcattcttctttgttgacaggaaagccgggcttcctgtgaggccatgaactgattcatcgctggtttctcccactgcctactcacggccagtggggaaccatgactttcagacacgaactcttattgcccaacagggtctggggtgactagctgggactgcacgctcaagccaccacgcccggttctgttgcctcctctttatttgtgcatgaattttctaggactgctggaacaaattactccaaactggacagcttaaaatgttactttgttctggccaggcacagtggctcacacctgtaatcccagcactttgggaggccgaggcgggcagatcacgaggtcaggagatcaagaccatcctggctaacgtggtgaaacgctgtcactactaaaaatacaaaaaattagccgggcatggtggcaggtgcctgtagtcccagctactcaggaggctgaggcaggagaatggcgtgaacccgggaggcagagattgcagtgagccgagattgcgccactgcactccagcctgggtgacagagtgagactccatctcaaaaaaaacaaaaataaaaacaaaaaaacattactttgtcctttcacagttcggagagccagaagtccaaaatcaaggttatgactgaaggctctgacagagaatccattccttgcctctctcctggattctggtgcctgctggaatccttggcattctgggcttctagactcctatctccgcctcagttgttatgaggcgttctttcatgccagtgtccagactcccctcctctaataaaaataccagtctttggattgaaggcccaccctactccagtatgacctcatcttaacttaatgacatctgcgaagacgctatctccaaataaggtcacatcacaggttctggattgatatgaaattgaggggaacgctgttcagtctggtgcaattagctgtattacgtatctctctctctctttttyttttttttttttttgagacacagtttcactctgttgcccaggctggagtgcagtggtgcaatcttggctcactgcaacctccgcctccgggttcaagcgattctcctgcctcggccttctgagtagctggaattacaggcacctgccactacgcacggctgatttttgtatttttagtagagacggagttttgccatgttggccaggctggtcttgaactcctgacctcaagtgattcacctgccttggcctcccaaagtgctgggattacaagcgtgagccaccatgcctggcctacatatctctttttactccgcttctaacgcagtctataatgtagtaggtggtcagtcagtatctgtcgcattaaagactaaatgtcatgcttaagagggcaggagccagacagtttgagctcaaatcccagctctgccacttcctatctgtggccccgggcaaactgcatcatcccctggagttttgctttcctcttctgtaagtggggacaatgatagcacctctacctcacaggatgttgtgagggttaaattaagtaatctgggccgggcacagtggctcacacctgtaatcccagcactttgggaggccgaggcagatggatcacctgaggtcaggagtttgagaccagcctgaccaacaagaagaaaccccatctctactaaaaatacaaaagtagccaggcgtggcggcacatgcttgtaatcccagctactcgggaggctgaggcgggagaatcatttgaacccgggaggcagaagttgcagtgagctgagattgcgccattgtactccagcctgggcaacagagcaagactccatctcaaaaaaaaaaaaaaaaattaagtaatctgtaaaccaggtgtggtgttgcacatctgtggtcccagctactccagaggctgaagcacacggatcccttaatgccaggagttcaaggctgcagtgagctatgatcatgccattgtactccagcctggacaacagagtgtctcataaaaaaaataaaaaataaaaaattaagtaatctgtgtaatcagttagcatagagcctagcatacaatagatagggttctatgttagctatggttatttttgttattgttactagaaatgtccaaatggaatgtcagtgtgaattggctaatctgcatgataaaaggtccagtgacaaaacttggaaggatgaggtggagttccagtgacaaattcctgttaatccctatgctggctgtgcattggggccaacacctttatttgaatcaacacaacagctgcaacaatcactaacccttaccaagctcttgcaaggtgccaggctctaggcattaccctggctaattcttggtaccaccctacttttctcttatatctcagatgaggaaattgaggttaagtaacacgcccagagttggtgagtggccaagccaatattcaaactcagatttcctcattctagagccttattctttcagggctgggcagaantggggaatcagcaaagagaatccatcaagatttggccagctttcccatatggctgtcaaagagcaggaggccaggcgtggtggttcacatctgtaattccagtactttgggagatcgaggcggaaggattgcttgagctcaggagtttgagagcagcctgggcaacatagcaagacttcatctctacaaaaaaatcaataaattagctgggcgtggtcctacctactccggaggcggagtcaggaggattgcttgagcccaggaggttgaggccacagtgagctatgatcgtgtcactgcactccagcctgggtgatggagtgaaatcctgtctcaaaaaaaaaaggagattggaatctcatcattttttttctccctttggtgctaatgaaggatttttgtgctgtccaagcataagaggcaacctgagaaatgggattgtatttagttatttattttaagatgaagtcttgctctatcgcctaggctggagtgcagtggcgcgatcttggctcactataacctctgcctcccaggttcaagtgattctcctgccttaacctctcgagtagctgggactacaagtgtgtgccaccatacctggctaatttttgtatttttagtagagacagcatttcaccatgttggccaggctgatcttgaactcgacctcaggtgatccacctgcctcggcctcccaaagtgctgggattacaaagtgcgtgggtggcacccaggcagaaatgggatttagatgtcagtcatcaaaatsgttgatgcaaccatcgttcaggaggctcacccagccagggatgtgtgatggctgcagtttcaggtgcctgcaatcttatccngcctactccagcttcatctccaaccctctcctcatgttcctcacattgcacntgtttctgttccttgaacatatgcttttccctgcctcagggcctttgcactggctgttgcctcttattggcgaggtctctcctcaggcttcaagcagctgatcgcttctcatccttctggcctccactcaaataccatgtcctcagagaggcctttcctgaccgtgctctccaacattgccttcctaccccatgcacatctcctacccattctcctgttctgtttccatgacctgtatcactgttgaaatgatcttctttgtttacttctttgttgcctgtctctcccactggaatattgcctccttacagcagcctccttatctgtcttatttatgtcttcagtggctaaaacaatgcctggcacatggtaggtgctcaaacaataattgttcacgtacttggattcctggatctaaacttctaggtgtgcacacatgggttgacccgagcatgagagctggaactagactgccttggtctgttacttgctagctctgggacactgtgctagttattaaaccttgctggaccttagtatgcttatctctgcaatgggaaaataatggcacctacatcacagggctatggtgaggaggaaataagttaggtcatataaggcagcaaaagggtccctggcatgtattggtgcttgatgggtgctagctcttatgattccctatgacaccggccctgctcccctgttcgtcacaattccctcctctggctggagggtgaggcctgttttctcagcgtctgttccaaaagcaccttgctctatctattcccagactctcacccttccccaggttgagctgtaggactcatctggcttcttagaatctgcttgtttcttctcattcctagaccaaatccccaagtcaacacctaaaggtctcagtaacatttcccttttagtttgtggccagcgcacacgattcgttttttgtttgtttttaacctggttgcaggagatgtgatttgcccatttttgcacagaaagggcaccatccgtaccacaattatgatgtcgttatttgttaaaggaagaaaggaatctgggggaagaaaagcagaatctttcggtgacttcatattttggtatcccttttcagacttctaaactctatttacatggagataaaatagggattatggcctaaaatcccacagccttaagcccatttacagtagcccaggtcaaagagcattcatgtcaccatatccctttgggagaaactgaggccgagagagacgaagtgtttttactgttataatcagctctctgccatgtgggggtcgattatgtggtttgtgggtttgctagctcaaagattgactacatgaaaaataatgatgaactgttttgtttttttttttttgtatgtgaaaaacccaaagctactgcaaatcagcaaacatctctttatcagagggcgttgtcgtttagggcccccagtgttgagagattgctcatgtatgcaccgcaaggccccaagtcccctcgcacatgtcagtaggttaagcagccaacctattttgccgttgaccttgtgggatgtcattttgccaatgtcctttgtagatctgagctgggctgtgctgttgaacacttatcagtttaaaaatgataagatagccagaagataattgaaatgaaatttaaatgaaaatgtcagggacttagtaatcaactaaaacttaaaaatgttaagcaattggccaggcgcagcagctcatgcctgtaatcccagcactttgggaggccaaggccggtggatcacctgaggtcaggagttcaagaccagcctggccaatgtggtgaaaccccgtctctactaaaaatacaaaaattagccgggcgtggtggcgggtgcctgtaatcccagctactcgggaggctgaggcaggagaatctcttgaacccgggaggtggaggttgcagtgagctgagattgtgcctttgcactccagactgggcgacaagagcgagactctgtcttggaaaaaaaaaaaaatcaagtaaaacaggagatgaaagcaacttgcattacaataggggacagaggatgaattgctcatgatttaaaaaagagaagaggaccaatgcattctgttggcatcatttccagctcttcatgcagtctgaaattagttaagataactctgagagctcggtgaataaccctgatgatacaacactagtttggttcttgctggcagcacatctcagacccagggaaagccagtgctggtttcacctgtgataaacaagtgacattatttcttgaaaattctcaggctgggaagtgccttgcatatgactcctggctgggtggctggattcaggcaatggcctaggatttctgaatggggatttgagctcctgggcagtaatgactcacaggtctcttgggagagagacagagaatgcccagtgatcgtgagagagaggtggccacaggcagcgaagcccagatacttcccatttgcttgaactgtctgccaggctgactcagaggtgcaggtgacagcacactgtaatcatgtttacttatgtacgttgatttgcaatatgttaactttgygccttgatctcatttcttctctgctttcccccttctctacccctggtttaattttgagtcaagtcaatgctgctgctgctaggagttacgggcagtggcttagctcggaatcaaagatcaatatttgccacaggaaggtcaggggctcccagggacttgaggctgtttctaaaacgggcctcagtgagcaatgaattgagctgtcaatttagttgaacacttggcttgatttgtgttctcagaattggctttttgcaagagttcatgcaccctgttacctctcagacctctttttctcagccaccctgctgccttggggatttggcagtaacctaatggaagatgcgaaccaggttggcagtcacactgcaggggattgtgatgaggtcttgatatctggtggacagtatggggacgagggcagaaaggacagtctaaacaagaccaatattagggagagcaggccgcttcctctttcatgtaattccttttcagctgtattcctaaccctgacagtaactcagattcagggttgggaggaccctcactggagagaaatcctcttgtcctctgaccttcaccattatcccctagaggccagctttgggaggtcccatcctgacttctctttgtaagctctcggcatggtgggacaggcgactttatgtttttgcacttgagtaaataggtcaaatagaatcaaaatcatgtcatgcccacctttcaactggggccaggtaagtgctgaacaaaagggacttcaggtttttacctcatggctctgtttgatagatggggacaggcaggaacacaatgacctagatggtagccaatcttagagaaaagaaaaggaactgaaatattaaccagtggggccttggtgccagcctgcttaaccaactgcaagctcaaagtagcctgtccaattgctattaatagttcctcttttaagcctcccaaatacagtcattcaacagtgaatctctacgaagaggaggacgtgagacaactgctgggagaccctagccagctctgcccttaagggaccgatggcctgatggcaaataaagacaagaaaaccagcctttagaatgcaggagggtagtgtgctgtgagagtggagactcctgccatatctcctactccttttgcttttataacctgaggtagatgtatctgaattgacagcttaggggatagaactagcatatcacttatagattggtctcagtcaagaaagagaaaggccccttgctgggcttctcaccttttaggtgataaagcttgcagtgaggaatcctgttaaagatagtgccgtggctgggtgcggtggctgacgcctgtaatccaaacactttgggaggccaaggtgggcagactacctgagcccaggagttcgagaccagcctgggcaacacggtgaaatcccatctctactaaaatgcaaaagaaattagtcgggcgtgatggcgtgcgcctgtagtcctagctactcaggaggctgagacaggcgaatcgcttagaacctgggagttggaggttgcagtgagccgagatcgtgccactgcactctggcctaggtgacagagcaagactccgtcttaaaaaaaaaaaaaagatagtgccgtggggctacaggaagagaaaagtcatttctctagagcaaagtcaagaggtcatgagtaaagattatctgttaagacttgaatgctgagacttaaaatgaagggagaggagagtgttgtaggcagaagggaaggcaagagaaaagacccagacctgattcctaggatctccctcggggcactgtcccaggtgctgggaacacagctgtgatccagacaaccaaaagccctcactctccggggggtgttgcattctagcagttgagtatggcagggctgggagtgtgagactggatggagggactgggcatctggtacagtgtgtcatatacatgtttacaggattggacatgatcctgcaagctgtggggatcctgaatgactgaagtcatccacctacatttgagaatttgagatgggattttccagcttaccaggatggcccacctgggtggctggaagggcgggggtcacgttgcagtgatctccaggatggcttgactcagaattgtggcaatggagagagatgtcagattcaggaggcttatagatgcctatgtgtatgtcgcattgtcgtataccttgtgtgtgtgcttccttgaatgtgaatgtgcatatatatatgagactgtgaaaaggaaaggagaaatttgccaaggaccataaccaagctcagctgccaggaatcctttctggaaaagaacaagaggctggatgtggtgacgtgcggtggctacttaggaggccacccaggaggctgagacaggaggatcgcttgagcccaggaatttgaggctgcagtgcactatccttgctcctgtaaatagtcactgcactccagcctggacaacatagcaagaccccatctcaaaaaaaggagaaagaaacaaaaagaaaaagagtataaatggattaatgaatgaatgagtagacgaaaggcaccaagttcactatttgctgccacatttgcttgtagcttacaaagggcctgcgtatccatgatctcaatgatctcacttgacaaccttctgaggaataagtcagctgtgttcccatttaacagaaggcaatgtggaggctgggctgagctggttctctgagttttatttcagctactttccagttcccatctcccaaccctgtccctttacacacaaaggccgcagcaaaagattttaaaaacctattttcacgtccatgcctttaaattatgaatggaacaaggacagtttttattccagtcagagttgccacagaacaccccatcatctattttaaattccttgtaaatgaaggctggacacgcttaactttgcaacgttatgtctctccggggcttttgtggcagcctttccagtgctagccttccctgattctaatacacataatttatgcaatggcaagttgctttggtttctgtctggctgtgtcttaatttgcgttgattttcttgttaacaggctgctgtaatgtctggctctgtatttccagctttgctttacaatgtattttcagactttaattaggacccctgatgatgaactggcctgagcctgcccagatagacttgggaggaaagaaagctttccaaataacaaggtcattttattgcttattaattagtccaactaaatggagacagtggccaggagggggaaaaaaggtgacgtgcaggccagttcataaagctgcatttttgggggtgggtacagcgtctccaaagaattgcaaataaaggaaacgagattgtttctgagagttaagctatgaactttaacacactgtggggaaggaattgagccctgaaagcatccgcttaagtgattacatgaagaatgaactgacatgttttttccaatcaaaccacctgagtttctctaagttttgtttgttcaccagatattgctggggcagccctgccccaccaaggtgctgtgcttggggctggagttgcaactctaagccccatctcatgaaacctacacccggcaaaggaactcaaaactgcatcccnctgtagaaatgtacgatagctggccgggcgcggtggctcatgcctataatcccagcactctgggaggctgaggcaggcggatcacaaggtcaagagatcgagaccatcctggccaaccccatctctactaaaaatacaaaaattagctgggcatggtgttgcgtgcctgtagtcccagctactcaggaggctgaggcaggagaattgcttgaacctgggaggcggaggttgcagtgcgccaagattgtgccactgcactccagcctggcgatagagtgagactccgtctcaaaaaaataaaataaaaaaaaattaaaaaaaaaagaaattaagatagctgttcccaagatgaggacgttaacaagcccacggggagattacatttagggccactgttaaaattgggcaagcagggataacattcaggcagtgtgtttttggcactgaccagccatattagtcagcttgggttgctgtaacaaatacaacagactgtatggcttaaacaataaatgtttatttctcacagttctggaggctaaagtccaacatcagggtactagcatggtcaggttttggtgagggctctttcctggcttgcagayggcccccttcttgctgtattctcacaaggagaatacagttcaagaccagcctggtcaacatagcaagaccccatctctacaataataataaattaataagagagggctctctctctctctctctctgatgttatcatcctaattattggaagacatggagggtctgggaggagaactggttattttttttttggagtgaacagatttcgaatkaacatctagttggtgccatatcctatcagtgtgayttataaattctctcatttgatccttgcagggattttataagattagcattattatcctcacttacatatgagtaaaatgaagttcagatagtttgagtcactgcagactctaatttataaattctaggtctgagaagtcaatgaaaactaggaaaaggactcaaattaacttgactttaccccaaagccatagacatacttaatgagagagagagaaagaaccctcttattaattaattaatcattattattgtaaagatgggctcttgctatgttgccgaggctgattttgaactcctgggctcaagcagtccttccacttcascttcccaaaatgctgggattataggtatgaggcaccactcccagccaagtcctcttttcacaaatgcacttatctcatcatggaagctgatggaaccctcatwaccttatctaaatctaattaccacctaaagggcccatgtccacatatggacacactggggattcgggtttccacatatgaatttcggagggacacaaacattcagtccatggaaccaggcaagaggaaatggtggctcaacagcctttgagtatcccagacccactgtcaaagatcaatccacaggctgggtgctgtagctcatgcctgtaatcccaacactttgggaggccgaagcgggtggatcacctgaggtcaggagttcgagaccagcctggccaacatggcgaaaccccatctctagtaaaaatacaaaaattagccaggtgtggtggcgggtgcctgtaatcccagctatttgggaggctgaggcaggagaattgcttgaaactgggaagtggaggttgcagtgagctgagatcatgccactgcactccagcctggttaacagagcaaaactccatcaaaaaaaaaaaaaaaaaaaaagttaatctacagtagagaaaaggccctcaagcttcacaaagtaaaggacttttttgatgctccatttgaattctcttagcattaacgaagtccacactcactaaggcaaacttcagattctgatttcctgtgtagcttgtgcacaggaagaaaacatgttgaccacgctgacattctggttcctgtacccatccttggaagtcagatgggtcgtgggcattcctgcctctttcttgggctcacatggtttgtgtggatgtgagtcaggctctcggggctggcaccaccaagcatgactctcaggaccttcccagccaaagactggctcctgtaacacgatgacctagttaatacgatacctcctgcggaccggcccagctccagacaaccttccctcgcgtggctgtagtggaaagggcataggaatttgggttggaaaggcctgggttcaaattctggctttgccatttcctccctgtaggggtctgcagtcttcaatatggcaccgtgatgagacaggccttggcataagatgcactgagctcataccagctatgtagtcttggaaagctatttaaactctctctgcctcagcttccttctctgtagaatgggaatttggatgcctrttttacagagtgttttaaaagttagaaatatgtgtaacatgagtagagtagtagccacttggtacgtgttagatatttttgttactataagacaacgctaatgcctatttataccttaggtctcagcttacacttaacttcttttgggaaatgctttcccaacacacaggtatacacacttggtgccctttgagaacatcctgtgcttcatgtttcccaaatcctcttacataatgaaattatccacctccctcactgaccagtgagcagcttgagggcagggatttgtcttgttcattgatatatcctggatcacctacagcaggggttctcaacccccaggccactgtaccagtccatgacttgttaggagctgggccctacagcaggaggtgagcggcatgtgagtgaagcttcatctgtatttacagccactcctcatcgcttgcattaccgcctgagctccgcctcctgtcagatcaacagcggcattagattctcacaggagtgcgagccctattgtgaactgcccatgtgagggatctaggttgcatgttccttataagaatctaatgcctgatgatctgtcagtggctcccatcacccccagatgggaccatctagttgcaggaaaacaagctcagggctcccacttgttctacattatggtgagttgtgtaattatttcattatatattacaatataataataatagaaataaagtgcacaataaatgtaatgcatttgaatcatctcgaaaccatccctcccaacccctgtctgtggaaaaactgtcttccatgaaactggtccctggtaccaggaaggtgggggatagctgacctacagtataatagccaggactctctggttgtaagtgacggaaacccaactcaatcaacctaaacacaaaagaggcacaggtggggctcttgaactaagcccctgagagcctccattttttcctctgtgcttctgagccagttggcccattctttcaagttcctccatgtgatagtcaaggaagcccttacccttctggggttgcctgcttatagcttgatattccagagggggagaaaagagctatttctcattctctggttcagaaaattccaagtttaaattcacaatagccctgcttggctcatgggtcatgggccagttcaccaaggacagaagcttgtgctagtttgattagcatgcagtggagtcccacactgcattagtatccaggtgggacattacatgggaaactatcattaggtctcaccaggtagagtgcaggacccgagctgctgttggtggagaaacagcgttcctgaggtctggaattataccctagggcagtgacaagactaggcagacatacctctgctcttgtggaactctaacctagataagggagccagcagcagcaagaagacaaatccctgaacaagataaagtcagatatgataagggttagggacaaactcgaacagtgctgctgcaggtgtagccgggtcagggagatctccccaggaggcgaaatgagagctgaagcccagctgaccaggaggggccagccctgtggagaccagagcagagtgatcaggacagagggaacacaaaaagggcctgaggccagagccagctggaagtgttctagaaaaaacaactcagcctggcgcggtggctcacacctgtaattccagcacttttggaggcccaggtggatggatcttgaggtcaggagtttgagaccagcctggccaagatggtgaaactccgtctctactctaaatacaaaaattagccaggcgtggtggcccatgcctatagtcccagctacttgggaggctgaggcagaagaatctcttgaacctgggaggcggaggttgtggtcagccgagatcgtgccattgcactccagcctgggtgacaagagcgaaactccgtctaaaaaacaaacaaacaaaaaaagcagaaagtaaaagcaactcaccttgtctggctggaggggagagagcttggggaggaggggagttgatgccaaacggggtccagatcactgaggtggcaagttcccacctttcccgtgttgtgtcacacctggaaactaatacttcttgtggtgggttggggtgggtggttgtgcatcaagcaacagtcgtcagcagccccatgagtcatgtggaaggagtggccagagaaagagtggatgctctacagcaaaacacaactgatggtagcaatagtcagtgctcagacaacaggcagatgtctacattagacatgaaaaggctgcaagacagtttcacgtgcttccgaagtcaaagtcagggcttatcctcctggagggtaaggaaagactttgtgataatagtaggttctgaaggacaagtaggagtttggaagggcaagaagagggtaatgcattatttagcagagatacaacagagttaacatgttgagctggagagttgagtggggcgtgggggagggagggattccagatgttccaggaaaaagaatactgttgagctggaccctggagacacgcagggaggtgtactcgttttgaggcctgctgtaacacagtaccacaaattgagtagcttacaaccaccaaaatatattatcttacaatgctggagtctagaagttcaagatcaaggtgttggcagagccacactccctccacagcgctaggagaagttccttcctttcctcttccagcttttggtagctccaggcattccttggcttgtgctggcatcattttcatctctgcctcttcttcacatggccatcttccctctgtgtgtctctgtgtcttcgcagcattctcttctctgtgtctctctgctcttctaaaataaggacaacagttacattgcatcaagacccactctacttcggtataatctcatcttaacttaaaattacctctgcaatcaccctttttctaattacattcacattctaaggtagagggctcaggacttcaacatatcttttggggggacgcagcccaacccacagcaagcagccatggctcagaggctgataggtaggttgagccagagcatgaygggttatggtggctgagacttggggctacaaaatggcatgaccaatcagcgtgctaccatgggttagagagagtgcttcgggtgagggacaaccatcattttgatcctgggtggcgtcattgggaatgaggaggatctgaaggatgcaggaagtggcagagagacttgaagataatgccttggtctctactgcctcagtgccactgcttgaccaggagggggtggtcacagcttttggagggagaatgctgagcttggttcagtgcatgttgagtctgagttgacatgtgacatacgtgtggcagtgtacatgataccaggatagcagcagcagcatcgaaatgccactcacccccagagttccatccactcacatcccgctcacttattgcccctccacacactgaaatgttctctttctcccatttagctggtgatggcagtcatcatgttgcctgccatgaattttaaaaacctactctgtgctggatgctttgctaattactttatgtacatcaccttatggaattcttcaaataacttgatgagataggtctgattatgcccattttgcagaagaagataactgaggcttagattgagttacctgtctagtctcacactagacagagttggggtcgtatttggacccaggcttgtctttccgtgcctttaattttcttatcactctgcctcccatagcattttctttgtatttctcagatagggctcatcttattttctcttattatccacatatgacagttctgctagagtataaactcgttgatggaaagggctgtagctccccagctagctctgtcgtggttggttgaactagaccaggagcttgtaggtgaaaggtttgagatggcaggtgataygcatgtgtctgtttggaggcagagagatgaacaaagggagggatgtccagtggtgtcttcaggtctacatgcctagatgctggagggatgaagtcatgggacctgcagagaacccagctgaggaagccagtgtcgatgcaggctatggctttcccaccagactggaagaaacaggtcttacgaggtagagtgcaggacctgagctgctgatggtggaaaaacagcattcttgaggtctggaattacaccccagggcagtgatgagactaggcagacatacctctgctcttgtggaactctaatctggataagggagccagcagcagcaaaaagacaaatccctgaacaagataaagtcagatatgataagggttagggacaaactcgaacagtgctgctgcgggtgtagccgggtcagggagacctccccaggaggtgaaatgagagctgaagtccagctgaccaagaggggccagccatgtggagaccagagcagagtgattaggacagagggaacaagaaaagggcctgaggccagaaccagctgggggtgttctagaaaaagcaactcaccttgtctggctggacgggagagagcttggggaggaggggtttgatgccacacagggtccagatcactggggtggtgagttcccacctttcccgtgtcatgtcacatctggaaattagtgatatttgtgcccctttccaaggacctccactgaggctggcagtggagggctgtctccacattgtgctgtaaggggactgctttccgtggagctgggcgggtaacagacagagcccacattggacagctctggtgcctcgagttgccccaggccccactggctgccccaggggctgagatgagcacagtctaagaaaacttttggttcatttgggcctaactgtgctccagctcccctgctgggaggctgtgatggagggcctgtagaccgtgctgacttcgaatttgctttgactgcaataagaacccatgaaagggtttccagccagggactaatcgcaggggtgtctaatcttttggcttccctgggccatgttggaagaagaattgtcttgggccacatataaaatactctaacattaacgataactgataagctaaaaaaaatcacaaaaaaatcaatgttttaagaaagtttatgaatttgtgttgggccgcattcaagctatcctgggctgtatgtactcatgctaggtgataatcattttcaaagacgctgggtgtggtggctcactcctgaaatcccagcactttgggaagccaagacgggtggatcacctgaggttgggggttcgagaccagcctggctaacatggtgaaaccctgtctctattaaaaatacaaaaattagctgggtgtggtggcatgtgcctgtaatcccagctacttgggaggctgaggcaggagaaccacttgaaccctggaagtggaggttgtagtgagctgagatcgagccactgcactccagcctgggtggcagagtgaggctccatctcaaaaaaaaaaagaaaaagaaaaagtttaaagatgactttggatgcaccatggaaaatgaggggagggggaattggagacaggaattggaagtggggagtaagtagggctgccacttatagctggggagactgtatattgctcacctctggactgtggtgtgaatggtggcccttgggttgtttgacatgatggccctaggatctgggtacaaggtggtggtagcttggaccaggacatgagcagatagatggagagaaatggatagattctggatatatttggaagttgagttgataggacatgctaataatttagctgtggagaggcaggagggaatgagagaaacctcagatgactgtgacttgagtgacagggtggggggtgctatttactgagagggaagattggtataggaatagctggtatgtagggaaaaatctaaagaaagcccagataaacttgcagaaactggcaaaggaagcaaccacatgccacatgggagcgctgtctggggccctgagaccaacaagcagttttctcctggcctgggaagcccattgggctgagagatttaagacaaggctgatggcattgtggagggctagctttaggggcactgtggcctgggcagttgcacacttagaccctgtgcttggttgcaggctttgctgtcactgtcttaaaatttttagtgattcttgaaccagggacgctgcattttctttacctttttcttttctttacttttctttatttctttttttttgcggggggggggggaggtggtgggcggggacagagtgttactctgtcacccaggctggagtgcagtggcatgatctcagctcactgcaacatctgcctcctgggttcaagcaattctcgtgtctcagcctcccgagtagctgggactataggcgcccaccaccacatccagctaattttttgtattttagcaaagacagggtttctttctttctttctttctttctttctttctttctttgctttctttctttctttctttctttctttttttgagacagagtcttgctctgtcacccagactggagtgtagtggcacaatctcggctcactgaaagctcctgggttcatgccattctcctgcctcagcctctggagtagctgggactacaggcgcccaccagcttgcctggctaatttttcgtatttttagtagagacggggtttcaccgtgttagccaggatggtcttgatctcctgacctcatgatctgcccgccttggcctcccaaagtgctgggattacaggcgtgagccactgcgcctggtgcaaaggcaaggtttcactgtgttgctcaggctggtcttgaactcctgagctcagacaatccgcctacctcggcttcccaaagtgctaggattacaggcatgagccactgtgcctggcctgactattgggggaaactcagcccctgatatttcacgtgcgtccttttctattttccctaagtgtcagccagtctgagaaataaagggaaagagtacaaaacagagaaattttaaagctgggtgtccgggggagacatcacatgttggcaggttccgtgatgcccccaagccacaaaaccagcaagcttggggagggagtgtacgaatagggtgtgggtcacagagatcacatgcttcacgaggtaatagaatattacaaggcaaatggaggcagggcgagatcacaggaccgaggcaaaattagaattgctaatgaagtttccgacatgcattgtcattgataacatcttattaggagrcagggtttgagagcagacaaccggtctgaccaaaatttattaggtgggaatttcctcgtcctaataagcctgggagcactacgggcgaccggggattatttcatcctttatgtacaaccgtgaaagacagacattcccaaagtggccattttagagacctccccttgggaacgcattctgcttctcagggatgttccttgctgagaaaaagaattcagcgatatttctcctatttgcttttgaaagaagagaaatatagctctgttccgcccagcccacaggcagccagactttaaggttatctcctttgttccctgaacatcgctgttaccctgtttttttcaagatgcccagatttcatattgtttaaacaatttgtgcagttaatgcaatcatcacagggtcctgaggcgacattcatcctcagcttacaaagatgacaggattaagagattaaaggcaggcataggaaatcacaagagtattgattggggaagtgataagtgtccatgaaatcttcacaattgatgttaagagattgcagtaaagacaggcataagaaattataaaagtataattttggggaactaataaatgtccatgaaatcatcacaatttatgttcagagattgcagtaaagacagacataagaaattataaaagtattaatttggaraacttaataaatgtccatgaaatcttcacaatttatgttcttctgccatggcttcagccagtccctccgttcggggtccctgacttcctgcaacacctgaccctgcattttcatattttactgggttccatgaattttgaagctggttatgctgtggtggataaagagacaacaccagtaagcttgggccagcttgtacagagctacaaattctgaccaaaatgaagccaggggcaacagaagcttatgacttaatgtatgtgaagtgcttggaaaagtgcctggattatagtaagtgttgcataaatgtcagctataagagtaataagagggctgggcccagtggctcacgcctgtaatcccagcattttgggaggctgaggtgggtggatcatgaggtcaggagattgagaccatcctggctaacatggtgaaaccccgtctctactaaaaatacaacaacaacaacaaaaaattagccaggcatgggggcagacacctgtagtcccagctactcgagaggctgaggtaggagaatggcgtgaacgtgggaggcagagcttgcagcgaagggagatcgcgccactgcactccagcctgggcgacagagcgagactccgtctcaaaaaaaataaaagagtaataagaggccgggcgtggtggctcacgcctgtaatcctagcactttgggaggccaaggcgggcggatcacctgaggtcaggagttcgagaccagcctggccaacagtggcaaaaccccatctctactaaaaatacaaaattagccgagcatggtggtgtacgcctgtaatcccagctacttgggaggctgaggcaggagaatcgcttgaactcgggaggtggaggttgcagtgagccgagatcgtgccattgcactccagcctgggcaacaagggcaaaactctgtctcaaaaataataataataataataataataataataataataataaaagagtaataagagttgttataaggaatgtttaggagtgtgagccaagaggatccttgtgcttcagtctcaggaggaagggaacagaaaaagctgggtagagatgaatatttggggagcaaagttgtgagcaatagctagaactcgatttggacatcaaagggtagcagttactagctaccagccacatccacatcctgggctcagaagttgggtcctggtggtcccaatacgtgtggctgccagggacgctttgaaagaaacctgtgcctagggaattttacccaaggcccccagtgatggagggaagaaagcctgcagtgtttcttctagcctccaggagactgatggttcaggaaggaagagctggccggggtggcgccaggagctccctgaggttctggagggaggacctcacccaacctgtcagtgcatatgttggcgcacacaccttcccttccctcattctggcagaaagagggatcaatggcctgcttctaagatttggtttcaaggccaggccaggcttccagatggacaggactgggatctcacagtgcaatttcactgctctctgatgatgtccattgctgtttgtcaccttgaaaaacagcatcagggaatgaacccatcttctgggactgaggcccaggtctctttagcaagccttgttatgtggtacgaaagcaaagaggacagtggcgtcacccaatcagcacacatttggtagcaccccatttattctttgctgtgctggagacttcatagtgaaccaaaccttatcttatgagagacacagacattcttctggctgtgtattgctgagtaacaagccagccctaaccttaggttcaagcaacaaccattttcttagagcccatgatctttgcggtgaggaattcaggcactccttggttgggcaattctttagtactgggcgttgactaaggtcgcctcgtggagtgtagcaagcagatggtcaggctgggaggtctgagatggccttgctcctatggcggacatctccacggggaaggtctgagctggagtcaccggccagaggacctacagacggcctctgcaacgtgatggtctctgggtggttcagcttcttatatggcggctcacagagtgtttccagacaggaggtagaagctgccagtcttgtaaggcctgagcccagaaactggcatgtagggtcactcactgccacattattctgttggtcactgcagtcacagaacccatgcagattcaaggggaggggacatagaccccacctctcaatgggaggcatgtcaaagcattagtggcctttattatttatttatttatttgttgagacagggtctcactctgtcacccaggttggagtgcagtggtgcgatcatgattcactgcagcctctaactcctgggcttaagccatcctcccgcctcagccccccaagtagctgggactacaggtatgtatcaccacacctggctaatttttaaatattttgtagagacgggagtctccctatattgcccaggctgggtctcgaactcctggactcaagcaattatcactgttgtagttgagtgttataagagatatgtcggccaggtggctcatgcctgtaatcccagcactttgggaggccgagacgggtggatcgcaaggtccggagattgagaccatcctggctaacacggagaaacctcgtctctactaaaaatacaaaaaaattagccgggcgtagtggcgggcgcctgtagtcccagctactcgggaggctgagacaggagaatggcgtgaacccaggaggcggagcttgcagtgagccgagatcatgccactgccctccagcctgggcaacagagcgagactccatctcaaaaaaaaaaaaaaaaagatatatgtcaaatggtatataattacatggagaagggagaccccgcttctgtgcgggtattggggcgtggcagataggttgcaggaggagagatcagggaggatgtcatcgaggtgctaacattggaacatttgaactaggccttgaagacagctgggatttgccaatgaatggaaggtaggatagtggggagagacattcccagtggggagaacagcgtgtgcgaaggcacagatgcatgggagtaatgtggtgtgttggaagcaaaggaggtgcaggcatcggggcagcagataagcccagagaagcaagaagagcaatatcgtgtttttcttttctgtttttgagatggagtctcactctgccacccaggctggagtgcagtggtgctatctgagctcactgcaacctctgcctcccagtttcaagcgattcttctgcctcagcctcccaagtagctgggactacagacacccaccaccacacctggctaatttttgtatttttagtagagacggggtttcactacgttggccaggatggtcttgatctcctgacctcaggtgatctgcctgcctcggcctcccaaagtgctgggattacaggtgtcagccaccgtgcctggtcttctttcttttcttttctttctttttttttagacagactctcactctgtcgcccaggctgcagtgcagtggcacgatctcagctcactgcaacctccttctcccagattcaagcggttctcctgcctcagtctcctgagtagctgggactacagacacccgccaccacacctggctcatttttgtatttttagtagggacagggtttcactatgttggccaggctggtcttgaactcctgacctaaagtgatccacccaccttggcctcccaaaatgctgggattacaggcgtgaaccaccacacctggccaagatcatgtttttcagtaagggattagtgtgatcaaattcgcattatggaaaaacatttgggttgggcacagtggctcatgcctgtaatcccagcactttgggaggccagggcgggaggatcacttgaggccaggaatttgagaccagccttgccaacatggcaaaatcccgtttctattaaaagtataaaaattagctgagcatggtggcgtgcatctataatcttaggtactcaggaggctgaggtaggataatcacttgaacccaggaggtggaggttgcagtgagctgagattgcaacatcactgcactctagcctgggcaacagaatgagactctgtctcaaataaataaataaataaacaaataaataagaaaaagaaagaaaaatatttgtactagtgtggagggtgacctgaggtgacaggaagatcaggctcctgtaataaccttgactctagctcctaaggacctctatggaggccgtgatagtgggtggaagagagggaggacagatctgggagacttgatagaacttggtgaccacctgacatggagaatgagcgggagtgaagcgtctaggcagccctgatgggttctctgctgggatgtggggtggatggtggtggcactgctccccagatggcagatgggagcaattttggaggggaaacactgagggcagccctggattattgcgtttaaggtgccaagaagagatgttcgggaggggaggggagcgaaggtggtccccacatgaagtctgaactggaaatacggatttggagatcatcagcttttaggcattagtttagagagtggggctgtctgagacttcccagagtgtgtgagtggactagaagtaaaaagagggctggggagggagcctgggcacattccaacatcttagatgtggacaaaagaagacaggcccacagtggagggagaacagcagccatcagggaggccaaaggaggatgaagacaggtctcctggaaggcgaaggaggaaggtttccagaaacaaggtgctgtctggatgatcatgaccctgaacaggcacctggagattaggaagctaagcagaaacgcttctatttatttatttatttattgttttgaggtggagtttcgctcttgttgcccaggctggagggcaatggcacggtctcagctcaccgcgacctctgtcccctggattccagtgattctcctgcctcagcctcccgagtagctgagactacaggcatgtgccaccacgcccggctaattttgtatttttagtagagacggggtttctccatgttggtcaggctggtctcgaactcccaacctcaggtgatccgcctgccttggcctcccaaagtgctgggattacaggtgtgagccactgcgcccggccagcagaaactcttctttccaaaagcatacattcctagaatcccagcaccgctcgctccaggaaacttctgtttcaggcaggtctccgaggaaaaccccccaggcattcaggtgcctggtttttctctagatggtttttagggtataaaaaccttgaaaaactggcttccctgaatagatcattccagtgttgtgtcatctgatttcaagaggccttccccaggcccagttagtactttcctccgttcacattgagctgtatttgaagatgtgtgtgtgtgtgtgcatgcatgtgtgtttttagtgtgtgtgtgcgcgtgtgggtgtcccacacctgtctttggatggttaagcctcaaggtctcttctcatgcccaaaccaaattcatttttctgtcctcccttacattaggccagggggactgggcacattttcctctccgctttaaaacttcactttatctcagtttcctccttccaagactggctgtggagtgggcgagtctcccctgccccttcccttcaactttcaagacaagcttctggagttcttagtagaggcagcatggtttaatggcacctgcataggatttggaatcagacacgcctgagtcccagggtgtgcccttggatacctgactgcatagtgccacggccaggagcatggactggatttgcctggatacaaattgtggctctaccccttccagcagtgtgaggcaaggtctttaacctccccctgcctcagtttcttcatctatatatgggaatccttatatgagcccatcctagggctctcccaggaggggcatttaatgccattaaatgacttagcacatgtaaagcgccctgttcgtagttcaagctaaaaaatggttataactattcgttgtaaaatggaaacracctccttggactttcgtttgaaaatgaaactggaaggtcattgagtatagggactgtttctttgcttccttaacatggattacagggtctgccccagtagctgttgctgctcagtaaatatttttggaatgagtgaaatgataaatgaatccctttgttataaatcagtagctttctctcctgaagacctcctgacagccagcttaaggggccaaggcccctgcctaagagattctctttgagcattctccactcagtttgtaggattttttttttttaaatgaagtgatatatacataagataaaattagccactttgtagccgggcgtggtggcgcgtgcctgtagtcccagctacagctctcagttgggaggctgaggcagaagaatcgcttgaacctgggaggtggaggttgcagtgagccgagrtcgcaccactgcactccagcctgggcgacagagcgagactgtatctcaaaaagagaaaaataaataaaaattaaaattaaaaaaataaaaaagaggaatattattcttccatatgcctataatactgttattatactcagaaaatgaacaaaaattccctgatgtcttacattgggtctgtattaaaattcccttaattatcctcaaacgtattgctagtttatgtgaactgcaggccaatcaaggatcacatgttacatttggttttgtctctttaatggctttaatgtaggttactacccaccccaatcccattttatcccatgatactgactttttgaagagactagaccagttttcttgtagaatatcaaaatactggtttgttaaattacttccttgtggtgtcatttaatttgtttttctatgagctgtatttcctgtaacctggaaattagatctagaggtttgattagattcagggtaaacgcttttggcaagaatccttgattttataaacttcatcttgcatcccatcaggagatgtacgaggtcagggtacccgttgtgcatgacactaaacttaatcattttataaggtggggatcgccagctctgtccaatttatgatgctccgcggttgacactctgaacaaccactcccaacacatccactgatcatcagctattagctgggggatgggttgatttggctgcaccaaagaaaaaagaaaatagatgagggttgggtgaggtggaggtggggttgcaaaaatggtgatttcctgagcctgccatcccttccttgcatctgactgcctggcatccttctgaaaaggagtgctttctctcatcacctagtgatgactgtggtccttctaaagtgtcaagatgaatgtttaattacgaatttttagggtgtggagttggcataacattcttttctaatggtggtaaatgaatttttctgagtgtcagtatggactaatggatttttatttattcatggcttacaatcaaatacactaattgttctttttgtgtgtgtgtgtgtgactgagtcttgctttgtctcccaagctggagtacagtggtgcgatctcggctcactgcaacctctgcctcccaggttcaagcagttctcatgcttcagcctcctgagtagctggaatcacaggcgtgtgccaccatgtccggctatttttttgtatttttagtagagacggagtttcgccatgttagccaggctggtctcgaactcctggcctcaagtgatccacctgcctcagcctcccaaagtgctgggatgacaggtgtgagccaccacgccaggcctaattgttttttgatgcccacattgtcccaagtttggccaggaggagcccctcgaagttgactcttgggtctttctttgcttcctggcacaagcagatgtcccagactcccctggtacttctccttcctcaaatctgcaattaactatttctcaaaggagagccaattccttttattgcaggatggggtttaaaacaaagatagaggtgtagtatcctcattgccacaggcgtgtcaatgattctaggccctttcagcagatagtagctgggagatctgtatttttaaaaagcatgagttcataatgacttctatattaattttaacattataggttttttattatcttcttttattttatatctttaccttttaccctggaaatctcggttcctgattaggaacattaatataattacttgtttgctttactctaccatatcacataaaatcgtttcaaaatcctgaacccaatattgccaccagtggaacagctactgagtgaagtttaagctttttttgtggttctctttgtccttagattatatcccattaatattgtacagccagaacactgggtgctgatattacttgaaatgattctttcctctgtgtggtcatattactgtttattatatgattggatttatttgtttcagcgttttttgttttttgttttttaattatagggtctgcttgttttccccttgtggtttaattctactttttggccatgtcaaacgtttacaaggtacgaaagtcaaactgtataacaacatagtccagagatacttgctttccccctccacatactgtttctccctccccttgtgggaaaccattcttttattagcttctggtgtatcctttcagtgtttccttgtgctttttgaagtgttcataacagtcccatcttttagattgattccaacctctgtgccacttcctctatggagatttctctaaaccttggaccgtcatccagttctttctccgtatctcaatcctagagcattctttatctccatgtcctgtggctctattcatctatttggggtcttaattacatgccattgtgcattgttgtgacttacatttgctcacgtcttgtcactcaatgtcttgtttctgcatgttccttgaggataggataatggctagaattcttttgtatttctcaacaatgtctaaaaaaggactgggcatacagtaataggtaatagattcagtcaattcttttttttaattttttgatacagactcttgctctgtcgtccagactggagtgcagtgacgcgatcttggctcactgcaacctccaacccctcggttcaagcgattctcctgcctcagcctcccaagtagctggggttacaggcatgcaccaccatgcctggctgatttttgtattttttgtggagatggggtttcgccatgttggccaggctggtctccaactcctgacctcagttgatccacctgcctcagcctcccaaagtgctgggattaaaggagtgaaccactacgcccgacctcagtcaattcttgttattgataatagttatgttctatcaagccaccgtgagtactgaattggggaatactgactcttttgctcccagggaaaatatggagttagcttcctatgggcatctgttcacaatattttcattcactagttaaattaatatataactgtattttatgaatgctgctgtgtaaagataccttattttatgtacatatatatatatacatatatatatgtatgtgtttttttttttttgagttggagtcttgctctgtcacccaggctggagtgcagtggtgtgatctcggctcactgcaacttccacctcctgggttgaagcgattctcctgccttggcctcccaagtagctggggttacaggcacctgccaccacacccagctaattttttaaaaaatattattggtagagacagggtttcaccatgttgaccaggctggtcttgaactcctgacctcargtgatccacctgcctcggcctcccaaagtgttgggattacaggcgtgagccaccgcacctggtcctaacacatacattttctttataaggcacatcaaagcctttgagtgcttaggaacactacacagcacttaggcactacatctgggggccattttccacagtgaaaccaccaacacaaaacacaaaaatgcaaaagccatggctctaaatacactgtgaggacatttgtttacagtgcgatatgagagctgaaaccagaagggagagggtcacctccttcagcctccactgagaatgtgtgcgccaaagctactcaaactttgcaggtctgcctatatccgcaaatgaccctaaatcacctcaagtattgattttgggattaaaaacatacaacgttagtaagtaggcacatttgaaatgtggaatcttcgaataaataagattgaatttgttggattaaatccatttgaatgagttgtggaaacttggactacttgtgttgcctctctgggtttctttttcctgaaacccagaaatcctatttcctttttttgttttgttttgttttcttttttgagatggagtctcgctcctgtcacccaggctggagtgcggtggcgtgctcttggctctccgcaacctccgcctcccaggttcaagcaattctcctgtctcagcctcctgagtagccgggactacaggcgcacgccactgcaccaagctaatttttatatttttagtagagacggggtttcaccatgttggccaggctggtcttgaactcctgacctcaggtgatcctcccacctcggcctctcaaagtgttgggattacaggggtgagccaccgcgcctggccagaaatcccatttcctgacttgttccatgactgggtgatctttgatctttgagcactgaaattgcaggaactgagtgggcactgccttttcttttactctggcttcctgtggttggtgcggtcctgaccactgtcctttccctgcaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggtaactctgggccccgtctgcctgttgcatttactgcagtggcagccgccttgtgtttgcaaattcccaacatactccctgtctgctttcctgttcatgtcttgctgtgtgagttagggatgctctcagctataaggaactgaaaagacctaacagtgaattaaaacatacatggagctattttcctcccattatagcaagttttgtggtaactggttgctttcattaattcagctgctcaaagatgctgccgggagccaggtgctctcactcgatctttctgctctgccatccttagcatgttggtgtttggtgtttgtcctcatgctcactgcctcatgactgccatccagcgactttaggcccctgaaccacgatttggctcaaggaaggaagaagagaagggagatggctcagctctgcctgcaccccaagaattgcacttatatcttattggccagagctgggtcttttggccacgcctcactgctgcactcccagattgagaaactggggacagcattgtagtgactgacttgaacttgggcatggtaatcttcctccctttgaacaaaaccacagttctattagcaggatacatggggacatgggcattgctgggagaccagcaacgtctgccacattgtccaatgactccctctcctttaaaacatttttttaggcatctcttactcagcatttattatgtgctaggcactgggctgtttattggcatgaagatgattattgtattggcaagagaactgagtttcaggccggtgaagagaagctgcctaacctggaggggtggaggccaggtctaggcaggtatatctgttcccagccttgccctgaggctctgcctcactgcccttctcccctccaggagccaagacagcccagtattcccagaagtatcctcagctccctgtgtttgttagtctaactctcaaagagctggaccccttgggatccctgcctcctccactatacaggaaattgcaagggagggagggtgcaaccacaagcgggtggccctgtgggcatgccttgggtgtctgaaccgtgtgaacctgtgggaggttgttctacccagacccagggctggtgcctctgctattggcccttttatcccactctgggttaaagagcctgatatccttttacggaagctcaacctggagtgcggcattctttgtcccagaaggggtaagtcccaggctgtaggagagaccaattaaggtcacacacttctctttttccaatccctttcttcccataccccaaggagtcattatgttaacaacatcaacaccaagacaccatttgtgaaactgccactgtgggctgactctccttactaggccagttacatgcgtccatgtaaacctcacagccagctgaacgaagtggctcacgcctgtaatcccagcactatggaaggccgaggtgggaggatccctcgagcccaggagatcgagaccagcctgggcaccatagtgagactctgtatctacaaataagtaaataaataataaaactcatagccaggaagagttaggtcccagggctgtcccagactcagcccctatgctgcagaagtggggctggcttcttctggagctgaatttgacctcactggcccctccgtcttcatgcctttaaactcccagtaagcaactgtttgcagcttgactgtttagctgcattcctcaccccctcaccactcacgacaccttttgcacatcctgggcaggatatttaagcatatccagctgttgcaattatgaactaaagtacacttttaggaaaaattaaagacccaccaaaggaatatcagatccttttacaacactcacactttgcttctaatcttggtccatgtttatgtgttgcctagctgtgcgaataccactgggctccacttttccccctttcacattattctatgtttccatgtcatataattttacatagtataatttttatgattaaacaatacttttcataattttaatataatgtcatgttcncatgtaatgtttaatccaaatatttcacataatgcttaatacatttctctcaatcttttttatttatttgggacaaagtcttactctgtcacccaggctggagtacagtggctcaatctctgcccactgcaacccccacctcccgggttcaagtgattctcctgcctcagcctcccgagtagttgggattacaggcgtgcaccaccacacccagctaatttttgtatttttagtagagataaggttttgccacgttgcccaggctagtctcaaactcctggcctcatgtgatccgcctgcctcggcctcccaaagtgctgggattacagacatgagccactcaattgagagaaattgagagcccatttctctcaattttttattaatcttttttttcaatcccatagagcagttgcagggagggaataatggactcctagaggcccttcatccagtttcaccgattcttaatttttgctacatgcagttgtcttgaaaaaatagatcgatagttccttattgaggccacatcaaataatgtacttagacatactcctgtggttgcccgttaatctctcgtttgagcggtttaatgctgccagcgtctcaatctttgtaccacattcttttctttgccccctcaccatgggggtggcgtccctggggtctactcctcagagcggaagagcagatcagagagttctgacactgtcagagctcttgccacacattgcccgattattcccccagactgagcgcatttgcagaccgaggagcagcagggtgtctgagtttcctcatttgctgccccgtaggtgtctcrgtgcttgaactgcgggctgctgatgttggccagagaggaagatgatgaaaccaggcaggaagcgggcatttctgagacgatgtggggyggtgcacctgcaccctgggcctcctggtgcctttgcagggccccagcrcgggagggcaaagtgaaggagcccatgtggggttgctgtgtctgtggagccctctttgagkggcagaggctcaggcttctccgggctcctggtgatgggctstcttcccctttcactgtggtttcccgtgtgagtctggggtcatcctttatgtgtccctgtggacaccgtctcggccccagagagcaaagcctggcttgtacaccacattgcagcttcttttggcttgtccacagtgcgaggcgaagctaatggagrgctgagtgtgtgatcagctcctcagggggctgtggtacccctatggggattcctctgaaaatctctcttatgtttttctacaggcaaatggcatcttggacaccacggctcttatcaccccaacttccgtggtaagaattcttttggggatttgttacctgggaaacagaaaataaaggtctctgtgtaagactccatgaacagctaagccatcctgtctctgggggcaaccctaagttaggacatctttgttcacgaggtcatttgagtgcatttggggtgccagggctctccgggaccttacatcccacttgctggcatcttccttgactgtccttccttggtgcctgtttgcccttccaactgccccatcacaggcccatcagcttttttgccatctctcggttctttacacctcagggaacattctgccccatgaggtccagacatggctaatctgggaagaagtaaaaattgactgatgggttcaccgaagcaggaaacctggccatagacccaaacaggagatgctgcctcttggcctcttcctgcagcctttgcttcctcaccctctggccttggggaagtaggccaagatcaagctaccaaagctggttctctgaaaatcactttgctgaagggcggattctccaaacgtccaattcactgaattactgatggtttttcaaagttgcagttcgtgccactgaccttttccatttcctataggaagccgtggactttctcttaaaggcatttaccatgatctcagctttggtggcttctcctgtccctggccccttcctcttctgccattttataagcaaatgtgattctctgactattttgcagacttctcccctcccctgccccagtatctctccctatctctatggaaaacggctgaattgttctgtcctagacctggcggaaggtttgcattggaagatttttgcatttggagaatgactttcagagggttggcctggagccagccttcagcagggacccactggtcagtaaccccattggctgacgtcttcttcaactcttacctcccctttgatgctcattcctctccctctcctcccttgagccccttttcccaggtgggcattcgtggcatcatccacacatgctttaaaaaaaatgacagatgggagaagtgaagacctggcttttgcactcactaaaaattactccagaacttgtttcctccttggtcttcagtttnctcacttgacagttgaggggttggaccagatcaggtgttggcaccttgagggcatattcctgtggtgaggggatactgagaccagctcctatgcagcaggaagtggtaccatgatggatctggtgtctcctgtgggtgtgggaagtgggaagaaagagtacctcctacctatttgctctttggaccagacaattccaaaaagccttctggcatggacactctgaggtttcttcatgcttatgtccaagttcactccttttccctcctgcctcttacatcctctctgyggtgcactgtcctggttccccgtctcactctgtctcccaggctagagtgcagtggcatgatctcggctcactgcaacctccgcctcccaggttcaagtgattctcatgcctcagcctcccaagtagctgggactacaggtgcccgccaccatgcctggttaatcttttgattaaaagcttgggttggagaagagatagaatgaaggaggaagtcggaaaaaaacttcacatgccctgggttatgccaagcacacttacacattccttctaagcacccacgctcctcttgctgccctgggctgttcctcaggtcagggctcctgcaaacacaacgaggtctttctaacactggggtatgaggatgcctatgatttagatcagtggttggcatagacctgtggtccaaatccagtatgctagctgtttttgtaaataaaattttattagaaaacagcaaggccaagcatggtggctcacgcctgtaatcccagcactttgggaggctgaggtgggtggatcacctgaggtcaggagtttgagatcagccaacatggtgaacccctgtctctactaaaaaaataaaarattagctcagcacagtggtgcatgcctgtaaccccagctatttgggaggctgaggcaggggaaccgcttgaacccaggaggtggaggttgcagtgagttgagattgcaccactccagcctaggcgacaaaactgaaactccatctcaagaaaaaaaaagaaaaaaagaaaacagccaatatgtacagtcatttgtgtacatattgtctgtgggtgtgtttgcgctacaatggcagagttgagtggccttaacagagatcatctgacccacaaaacctaaaatgtttactatttggctctttccggcagaagtttgctctccttggtggagagtcatcctgataccagatgcagtagcatttcagggctatgttgtgtacctagggggtagctaaatccatttgtgcaaaccaagttagcatgaagatatcaattttttaaaaatacaacaaacaggctgggcrtggtggctcatgcctatagtcccagcactttgggaggccgaggcaggtggattacttgaggtcagcagtttgcaaccagcctggccaacatgctgaaatcccatctctacaaaaatacaaagattagctgggcgtggtgacaggtgcctgtagtcccagctactcgggaggctgaagcacgagaatcgcttgaacccaggaggtggaggttgcatgagctgagatcgtgccactgcactccagcctgggagacagactgagactccgtctcaaaaagaaaaaaaaatacgacaagcatctactagttattctacatacaccacatattgggttggcaaagatctaatgtctaactcgaggagtgcatcactaatggggaagacggtattacccagatgataaaaagtctgtaggctacactaggagaatgggttgagtgcagggctgtggcaggcgggatgcagtgaagagcagggaaattctgtaggaaacttcacactcaaactgggctgggaagtgctaatgcagtttcacctgtgagagacacagagcagataattccaggcaaagccaccgaggccccaaagcatgaggctcacagggaactgaagagagcttgcttcttttaggaagggtgcttatagagagggccaaaaacgatttggaggggcaggagttgaagctgaaaacacagctctccctactcctgggcctggaatttgaggctaatgagaaatagcaattctttgtgagattcgagttctatctacctctaggaaataaagagagctgaagcagttacctgggtaattggggaaggtttcctttttctggagaatttttgcattctagctgcatatgcagctatagcctttgattaaaagcttgggctgggccgggcgcggtggctcacacctgtaatcccagcactttgggaggctgaggtgggtgtatcacgaggtcaggagattgagaccatcctggctaacacggtgaaaacccatctctactaaaaatacaaaaaattagccgggcgtggtggcacgtgcctgtagtcccagctactcaggaggctgaggcaggagaatggcatgaacctgggaggcggagcttgcattgagccgagatttccccactgcactccagcctgggtgacagagcgagactccgtctcaaaaaataaaataaaataaaataaataaatwcataaataaagcttgggctggagaagagatagaaggaaggaggaactcagaagaaaacttcaacacaaaggctttgggtttcaatgctcacacccttccatccctcaccttcactccaccactccaagcccaaattctgtcagccttttgagtcccagctgaaaggcagtatctttcaaggcgcattttgagattcctgccccatccccatcccaccatctctatcgggggtaacttcctgtgatcactcttgttggctcacctattcatctcttatttcttaatctttatatcttattttctcctcacatgaaaagtctcttgaaggcagaatttattctttctaaaaaattttttataattttttttttctctgtggttgtggcagctaagaacaactgttttttttttatcccttaaagtgtcatgtatatagtaggttttcaccaaatactgagtatgtccataatttcgttgaagatgttaggcattcaataattctctccacttcctcccaaactgggttaattctaatcacaagatgttttgcaaatctaatctaacagccagaacccagcaaagtgattttctatgcatactacaaagggatattaatcaaatcctcttataattacatactctatagcactgcagtattaaatcataggaaattacatttttgtcgtgggtgtacaaaggcaagcacatggagtcgcagccacgtgggggtgctaaccggttgcttctattccaggttttgattactactttggaatcccatatagccatgatatgggctgtactgatactccaggctacaaccaccctccttgtccagcgtgtccacagggtgatggaccatcaaggtaatgctgtctgacacatttgcgataggctccaggacaaggcaaagttccaagactgtggtccatcagcartaaattaaagatgcagacaggaaacagttaaracggcaaataagatacacggtacattctgtgcaaatttaaatgtgttatttgcagggagtgcaagaaacctttcaacgatgaggtccacaaaattcttctattgaaatttttacaggttcctcagactattgagctcagctagggagaggcttgtgctgctagggtctcacacatgtggggcctccctcctcctctgcctgctgtctttgcttctagcccagacactggacataaggagggagggagggagagagcagaggagagagacagaggagagagagagagagagagacagaggagagagagagagagagagagagagacagaggagagagagagagagagacagaggagagagagagagagagagacagagagagagagagagagagasagagacagagagagagagaacaggattccttttgagcttctccccgcatggacaactaagccagcattctgatgttggaatgccaaacaggcaccaaataggatgttttgaaaaaacatttaatgaaatgggaaaatgcttatgatataatagtaagtgaaaaaaaaaaaaagcaggaagcaagtcatcaacggtaagatcctaatgagctctgtaaccctatctttgtagtcctatcaacggagactcaaaggagatatgccataatgttatcaaggaatctctctggtcrtgggactcagggttttcattttcttttttctttctttttttttttttttgagatggagtgttgctctcttacccaggctagagcgcagtggcgcgatctcggctcactgcaacctctgcctccctggttcaagagattctcttgcctcagcctcttgagtagctaggattacaggtacccactaccacaccaggctaatttttgtatttttagaagagacggggtttcgccatgttggccaggctggtcttgaactcctgacctcaggtgatctgcccacttcggcctcccaaagtgctgggatttcaggcgtgagtcaccgcacccagcggtgactctttctccactttctctttattttcctctttgtcattgtatttcctaagtatcctgagatgcatttatgatcacaaaaaaaagatgataagcctcactcaggtaataaagcagcacaaaacacgtgttcccttgttcggacagagcactgtggttatttctaaggctacagttgtctgagccacttgggaaaggtgagtctcagctcgtctatctataaaacaatagttaatataatagtgggtatttattgagaaattgttacattctaagcactgtctatatttatctgtaatccacgtgaccactgtgtgaggtaggtatttcttaggttggtgcaaaagtaattgcggtttttgctgttgaaagtaaaaccacaattacttttgcaccaacctgatacctgattttacagataaggaagcttatgttgcccaggttacaccggagctggaaagaggtaggaatggagattccaatccaggtctctctgagtccagagcccatatgcccttcctatctttgctactcatagcrtagtcattgaaccagcatggtggatatcacttacatgcttggtagaagtgcacagattcacatcctacccccaggtctgctttttaacaagacttatgcatgcagtgagctatgattgcatcactgcacttcaccctgggtgacagagtaagatcccgtctcaaaaaacaaaaacaaaaacaaaaaccagcccagggattctgcacattatggcatgaaaagcgaggctatagagcatcctgctgcccttcttacccaccgtggcctgctgggcatacctgtaatcacacctggccatatgaaggtatgacatatgtcagccaatctctttttaaaattttaaaattttaattaatttattttttggaaggatggagtctcgttctgttgcccaggctggagtgcagtagcacaatctctgatcattacaatttccgcctcccaggttcaagtgattttcctgcctcagtcacctgagtagctgggattacaggcttgtgttaccatgcctggctgagttttgtatttttagtagagatggggtttcaccgtgttggccaagctggtcttgaactcctgacctcaagtgatctgcctacctcggcttcccgaaatgctgggattacaggcatgagccactgcacctggccttctttttcttcttcttgttctttttttttttttttttatttcaatcctgytccttctgtatttttttatttttattttttaatttttaatctatgttaaaaatctctttttaatctatgttaaaaatccagtagaaagccaggtgcagtgggtcactcctgtaatcccagcactttgggaggctgaggtgggtggaccttgtgaacccaggagtttgagatcagcttggtcaacacaacaaaaccccatctctacagaaaatacaaaaattagctgggtgtggtggcccatgcctgtagtcccagctacacaggaggctgaggtgggaggatggcttgaggaggaggttgcagtgagctgagattatgccactgcacttcagcctgggtgacagagccagatcctgtctcaaaaaaaraaaaaaagaaaaaaagaaaaaaaaatcaaacagagaaataatgggtggcttaggagagagagaaaaacaggaaagaatgtaaatgactcatggagttgcaatggtataataaaaagctgaaaaattcaacataaatatgcgattagtgttctaatgcccagcatggtgataattctttttctcttttaaaaaatttgggatgcctgtaatcccagcactttgggaggccgaggtgggtggattgcttgagctcaggagtttgagaccagcctgggcaacatggtgaaacccgttctttacaaaaaatacaaaaattagccaggtgtggtggcacacacctatagtctcagctgctcagggactaagatgggagtttgaggctgcaatgagctgagattgtgccactgcacttcagcctgggcgacagagtgagaccctgtgtcaaaaaaacaaaacaaaacaaaaattgtggtttttgacaattatccacacagtctgaccatatctcctatatttctgtaatggggtgtgtgtgcatgtaggtgtgatggcaagttttgatttcttcacaaatccttcccagcactattaggatgacgtatttgcctgagagaactccattcattaccacctctgtctgcattgctctcagcttctctcttggttctctttggtgaccaggactgagagcttgagatttttcagaattcctaatacactgaagatgtgtgcaatgcactaaccatttgttatctcccttagaccaccagcacccctgtaaggatggcacaggccctccaatgctacggataaggagataactctgggagcttaagtaacttgccagagatcatgaccagagtcagaccatgactcagccacattgatgggcagctatgggtcagattcatttcaatctgtaagaccaaaacttgagcttgtgttgttttgttttgagatggagttttgctcttgtcgcccaggctgtagtacaatggcgcaatctcagctcactgcaacctccgcctcctaggttcaagcaattctcctgcctcagcctcctgagtagctgagactacaggcgtgcagcaccacggctaatttttgtatttttagtagagatggggtttcaccatgttggccaggctggtcttgaactcctgaccttaggtgatccacccgccttggcctcccaaagttctgggattacacgcatgagccactgtgcctggcctggtcttgaacttctgacctcaggtgatctgcctgcctcagcctcccaaagtattgggattacaggcgtgagccacggcgtctggccatgagcttgttttttttttttttccaggagatgttattagtttgactcttattttttttccaactgctgaagtttctccaaattctgcaaacatggcttaaaattaaaattgtcccaacccatcttatgtattcctttttatgtatttatttatttttgagatggagtctcactctgtcacccagggtagagtgcagtgggatgatctcagttcactgcaacctccgcctcccgggttcaaatgattctcctgcctcagcctcctgagtagctgggattacagatgtgcactgccatgcccagctaatttttgtatttttagtagagacagggtttcaccctgctggccaggctggtctcgaactcctgacctcaagtgatctgctggcctcngtctcccaaagtgctgggatcacaggcatgagccactgcaccyggcccatcttatatattctgtcctattgacagacctgstattacatgaagtcccaattgttgacttcggaaaacgctgagttgcacgccatacacagaggctgggattgaagtgagacagcagagaaagccagcaatggggctactgattggtggtgggactctgcttgacatcatttaggttctttagacctcagtttctctccccgcaaaatgcaagtaataaaaaataatgtccctagctcacgagagtctttgcaagstttacagagtggtcagctcgtccatggaacntaaatatctattcaaagggaatggaagaaagcattatgcatagacttttacacttggaggaaatggccaaccagaaaaatcatttggggccagagtgttgtatttatgtgcatatgcattgttgcattaaagcatttagttctgctccgtgagtacgtaggaartgaatactctatggtctgtggtttccacacaggaaccttcaaagagactgttacactgacgtggccctccctctttatgaaaacctcaacattgtggagcagccggtgaacttgagcagccttgcccagaagtatgctgagaaagcaacccagttcatccagcgtgcaaggtgaggagtctccctccctccgcagggcctccccctgcctccacctacccgtgcacacacaccatgtcccttggcctcagcacgcttgaggccatggcagagttttgctgctcagcagagatggatgcatacatgtctcctataagtaaagctggaaaacagccccttctggaaatctgcggtcctggattagagattcctcaggtatgttcctagagtccctggggcttatccctctgttgctttgatcacgttccactgccatgatcattttgtcctctccttctagggtacgagctcctcaagggtagggcctgcccactgcactctgggcactcaaggcatttgttgagctcactagctggcaggatgtattacttttccattgctgctgtaacaaccaaccactaatttagtagctaaaacaacagtaacttaccctgctacagatctggaggccagatgtctgaaatgagtcttagggggctaaaatcaaggcaycagcaggactgttttcttggggagtctctagggaggattccttccttgccttttccagcttctggcatttctgagctatggccatatcattctcaactctaattctgttgttcacttgcatcttcagtcaaatctcccctctggctcccacttacgatagcacttgtgatggcgtttagggtccaccaggagaatccaaggtgatccccctacctcaagacccttaacataattccacctgaaaactctcttttgccatataccgtaacattcacagattccaggaattagaccctgcttatctttgggagctatccttcattctaccagacagaagttacaaattcccrcatctagaaggcacagataggtaaccttaaagagggaagcaggatgaacgtaaggcattagggagtggtggggtctacagtgaacctgtaagcacatgccccatctgaagggggcagctactacctagctccagctgcttggtgcttctttgtgaaaatgtgaacctggaatatcacatcttttcattttacaacagagataggatacctggcttttatgtgaaatctcctgatcttgaaatattagaaactactaattaacaaaaggctgggggtggtagctcatgcctataatcccagcactttgggaggccaagatgggcagattgtttgagtctaggagttcaagactagctgggcaacatggtgaaactctgtcgctacaagcaatacaaaaattagctgggcgtggtgatctgcacatgttgttccagctacttggtaggctgaggatggaggatcacttgagcctgggaggcataggttgcagtgagccaagattgtgtcactgcattccagcctgggtgacagagcgagaccctgtctcaaaaaaaatataaaatgaaaaataaaataaaataaaggtaaataagaaaaacaaagaagtgggctgtgtgcggtggctcctacctgtaatcccagtgctttgggattacactgggtaatcctccaggatcgctcgaggccaggaattccasactagcctggacaacctggtgagaccttgtctttacaaaaaattataaaaagtggctgggcgcggtggctcacgtctgtaatcccagcactttgggaggccaaggcaggcagatcacctgaattcaggagttcgaaaccagcctgaccaacacggtgaaaccctgtgtctactaaaaatacaaaaattagctgggagtggtggcacccatctgtagtcccaactattttggaggctgaggtaggagaatcacttgagcccgggaggtggaggttgcagtgagcccagattgtgccacygcactccagcctgggcgacagagcaagactctgtctcaaaaaaaaaaattaatacaagttattaaatagctgagcatagtkgtgtgaatctgtagtgccagctaactcgggtggctgaactgggagaatcacttgagtccaggagttcaaggctgcagtgagccataatggtgccaccgtactccagcctgacacatggagagcctgtctcttaaaaaacccccaaaaccggctgggcgtggtggctcacgcctgtaatcccagcactttgggaggctgaggcaggtggatcacgaggtcaggagatcgagaccatcctggctaacacgatgaaaccccgtctctactaaaaatacaaaaaattagccaggcgtggtggcggacgcctgtagtcccagctactcgggaggctgaggcaggagaatggcgtgaacccgggaggtggagcttgcagtgagccgagatcaggccactgcactccagcctgggcgacagtgtgagactccatctcaaaacgacaacaacaacaacaacaacaaaactaccccaaaacccaaaaaacaaaaaagcaaaaacaaaaccataccacagtctatctctaataaatcatatacgtgtgaggtgtcagggcaaagaatggacattgtgaaataatggacaactccaaaattgtgcacacttatttggaatgcacacccatagactgtggggtgcaagtgcacacacacacgtgtacctgcacacatgcacacacagtcaccctccccgcccccttcataactgccttctgctgccctctaatgaccccatatatgttcatcttatcttcctcctaggagattccactcctcaagggcaatggactccaagaaacttggtgttttctacagccttagcctaagtggtcaagaaagcacgtgctgcacggctgtccacttgggcagaattaaaaagggactctacctgtggctaagtgatcacagcagccccttgaatatgcaggaatcccccacccctcgctcagccacattggacgtttttagaagctcagcagggagggttgaggcagcaatgcaggagatccaggcatcctgttttcttggtaataaaacctatttaaggattgaatctcaaaagcagctcctaagggcttcagaaattgcatcttaagggtttatcaggactttctgagaacactgttgttttatttcagattgtcaatagtagaaagggcagagcctcttctgccatctggagggttgagcgtctcccagctccctggaactttgggatggtttcgggcccctgtgccccatggcacgtggatgcttcaaggctagtggggacagtctcttctgcttttgtggtgactcaaacgacactgtgttcttaggggaaggaatggggactcggggccgtttaatgccccctccgaagtgggcatagggcctggacatccacccgttaattaatccattaaagggcaaatcaaccgacagcctccttattatacaaaaaaggggaacagttttgttaattcattagctggttattaagtgaaaagtcccgagtcctgttggcatttaacatcacagaaggaaatccccagaaatgctgatttctttgggatttccacatgccaaatgattttctgagcatcagcagaaaaggccctcaggtccatgcccttcctcctccatgactctggcccctgcctcaagcccctcccccaccttggacctgtttttcaaaaccaccagctgtccctagagtgtggcttcccgctcttccttgacaagggggcccaccctgggacttagggagtttttacttgggtctttagttggctttagtgtttcacccaagaccctcgacgtagtacttggttatcactgctggtcattcagtttacttgactttagacccttcatctggtagcaatgctgaatgctaatgcttgattggagttttttaagcagcaggcaaatctctgaatgggaaaaggagccggtagaaggcatgactcctgggtcacagagctagctgggcctctgttccttttgaggtctgggaccgtgcattgcacctacgcgggcaatacagggcttgataagcaggagtgtatcgggcatcaggatgagcagcggcccagcatgtttgaaatcagacatttcttagttttctttttttgagactgagtctcgctcttgtcacccagactggagtgcagtgttgcaatcttggcgcactgcaacctctgcctcctgggttcaagcgattctcctgcctcagcctcccgagtagctgggattacaggcgcccgccaccacacccagctaatttttgtatttttagtagagacggcgtttcaccatgttggccaagcttgtctcgaactcccaacctcaggtgatctacctgcctcggcctcccaaagtgctgggattacgggtgtgagctaccgtgcccggcctgaaatcagacctttcaaacaaatcaatcttccatggtgtcatgtactacacattgaaatcctaacccttaatggggtggtattaggaggtggggccattaggaggaaattaggtttagataagatcatgagagtgaagcccccatgttgggattagtgtttgtattaaaagaagagaaagagactctggtgtgctctctcctggccatgtgaggatacagtgggaagacacttgtctgttaataagccaagaatcagccccttaccagacagtggacttcccagcctctagaactgggagacgtaaagtcaggcgtggtggctcatgcctgtaatcccaacactttgggaggccaagggtaggagattgcttgagctcaggcgttcaagaccagtctgcacaacatagtgagaccacccccatctctacaaaaaacacaacaaaacaaacaaacaaacaaacaaataggtccttctgcagtctagaacctggaaaaagaaaaaaaaggccaggcacggtggctcacgcctgtaatcccagcactttgggaggccgaggtgggtagatcacatgcagtcagaagaagttcgagatcagcctggccaacatggtgaaaccccatctctattaaagatacaaaaattagccggtcatggtggcacatgcctgtaatcccagctacttgagaggctgaggtaggagaatgcttgaacccaggagacggaggttgcagtgagccgagatcatgccattacactccagcctgggcaacaagagcgaaactctcagaaagaaccatgacaacaacaaacaaacaaaaacaacaacaacaacaaaacccaaaaaacagaattgggagaagtcgatggttgtatactaagccaccccagggagtggtattttgttatagcgtccctagcaggctaagacacaggacacgcatcttttggaactaggtcctcaggatgcagagatgaaagacatgttccagccttcatgagctcatgcctgggatctgcagaattctccgttttccttgactcactatccgtcttcattgctggcccccatgcttgcctaagtgcccctgctgtggtgctgccccctcctcatcttgcctctcacccggctcccacccgacaccaacctatgtcagggatccaggttcagatccaaagaccatactcacccccaacccctctttctcctttctcctgtttgaatgcagagacggatctctagtgagtgagagaataaactaatgactagcgaggcaatcatatcgaacgtctcccccagggctatgttctctgccttgtgtggtcaccacacaccgtcctccaggtcccactgtctcagggatctttccctcccctccacaccccaaaccccatttggttcccctgttacaccttccacagcaacttgtatttctcttccatctctcctacgggctgagtattccgtatctggaatgcttgggaccagaagtatttcagattttggatttttaaagagtttggactatttgcattatacttaaccgrctgagcatccctaatcctcccatgagtatttcctttgagtgtcaggtcagngctcaaacagtttcggagtttggagtattttggattttcagatttgggatgcgctgcctatactaactttttaaataatcatcttatttatattttagttgcctttttctctttcctggtctcaattagatgttaaactccaagagggtggaaatcatatctattgtgctcattcctctgtccccagtgcccagttagagcttaataaatatttaatgaatgaatgaatgaatgagtgagttacttatccagctccagtgatgtgctggtgctgtgccagggattcaaacgtgaattagacatgtccagtctctgagtgattcccaagctagtggggaaacagatatgtaaaaacatggctttaatgcaggttgtttgtatcttattaataccgcaagaagcagggaaaagggctatggcagggatgggggcagagaggaggcagccaaccatgacctgggagcaaaggaggaggactattggtggctttggaattggatcttaagaactgattaagtgttttggggcaagataacagggagaatactgctgagagaggaataacatagatgaggcacaggaagtargtgaggtgcttgggacactggcatatagaaagagtctttgacagggaaggaaggtcaggctggaagggacggagatagggaaagctgcaaagactgggtgaggagtttggattgaccctgcaggctgcaatgagccctagtacgtttcttttgtttctttcttctttcttttttgagatggagttttgctctcgttgcccaggctggagtgcaatggcgcgatctcggctcaccgcaacctctgcctcccaggttcaagcaattctcctgcctcagcctcccgagtagctgggattacaggcatgcaccaccatgcccagctaattttgtatttttagtagagatggggtttcttcatgttggtcaggctggtctcgaactcctgaccttaggtgatccaactgcctcggcctcccaaagtgctgggattacaggcgtgagccatcgtgcctggccgagccctagtacgtttctaaatagagatctgccagatcaagtctgggttagagaaggttgtctgtgatgccagggtctagtggaagatggcaaaatggtggggcgggggacaagtggttattgcagcagtccatttcagasagaccccttgcccatccatccccagggagccaccaccagagaggccagtgggctgagagctgcaggtgttcatttccccctgcatgagggaagccctgccttcacctccaggcctgcctccctccacccaggcaccatctggggacacttcttgagagatgggtgcctctcacctgccctcttccatttcggatcagatgattttccccagccttaacggtccctgcaccataatcttctccacaccctgtctccacaccctgccccatcctcttgctctcctggaatgtcccctctgtcatcttacttgtttttttccttctctactcaccattccacttgttttcccacaaaaatagcatgtgttccctttagtaatctcggaaaactgagacaagcaaacaaaaaaaaatcaccctgaattccatcccagagataacctgttttttgttgttgttgttgttgttttgttttttgtttatttgagacagagtcttgctctgttgcctaggctggagtgcagtggcacaatctgggctcactgcaacctccgcctcctgggttcaagccattctcttgctggctgggattacaggcacgcgtcaccatgccyggctaatttttgtatttttagtagagacagggtttcaccatgttggccaggctggtcttgaactcctgacctcaggtgatccacccacctcggccttccaaaagttctgggattacaagtgtgaggataacctgttttaatacctccgagtatgttcttctagcctcattctatgctggtgcataaacatatgtttccctggttttattaaggtatagttgaaatgaatgtgttttagaaaacaaaagtggagtcacactgtgatataatcagtatttttttaaagcatcaggtgtccccccactctattttccattcagcacaggtgcataatgaagaggtggcttgcgggacagatgcccccaagggactagtctgtgtgggctctgcctgatgccatgttttggaatctagcctggcatcaggatgcagggagagaggtacatccttgggcatcatttatgcttactactgctggcatgtattcaacattcttaacaaggaagcggtcgggcgcagtggctcatgcctgtaaccccagcactttgggaggctaaggcaggcagatcacttgaagtcaggagttcgagaccagcctggccaacatggcaaaacctcatctctactaaaaatacaaaaattagccaggtgtggtggcgtgcatgcctgtagtcccagctactcgggaggctgaggcaggagaattgcttgaacctgggaggcggaggttgtagtgagccaagatcgcgccactgcactccagcttgggagacagagcgagactccgtctcagaaacaaaaaacaacaacaaaataagctaccatttattagatgcttagtgtgggaagttacacaactttgttggggaggtctgattgtccccattttatagatgacagaggttaagttaattgtccagggctacacagtcatgaaataacaaatctggaggtttggatgcaggattctcaagcctgtgctcttcatcagcctgtgctctgccatctctcataactgcctgtctctgtaagcctctggctcagggtgctaatgtgactttgataatgggtgagagtttggaagatgatgatggatgatgaagggtggacagcaggaccacccctcgcccatacacatggtgagctgatttctaagaaaacagctgcagtctgtagcatttgccaattcctgaggtgtaaatactcaatctcaccatggctgatttccagctatggagatgtcaccgaatatggcattgaaaaatgatgggcagtagcaagccattgtgtgttatttccaccacacagatacaatagatgtaaataaccccatgagcctacatcatagcagaatgtagtagttgggaagtgataaatggtgagaatgtactactttcaaaaaatattattgatttatttaatttattttttttttgagacagagtctcgctctgtcgcccaggctggagtgcagtgcacaatcttggctcactgcaacctctgcctcctggtttcaagtggttctccctgcctcagcctcccgagtagctgggattacaggcacctgccaccacgcctggctaatttttgtatttgttagtagaggcagggttttgccatcttggcccagctggtctcaaactcctgacctcaaatgatccgcctgcctcggcctcccaaagtgctgggattacaggtgtgakccactacgcctggcaaaaaaataaaataraataaaatttatttaattgtggacttttataattgaatttttagcaatggccatgtttaacaactggtttgcaaaatacttgaaatttgagccagatctaggcaccactgcaatatggaatctacctgaaaattaaaaaaagccacccccactggccaggcactgccctgtgcagggtaaccagccagtagattgtaagctggaaataaggacccattcactcagcaggatgtcctgatgcaggccacaacctgcacaactgtacatgaccatccctgggagagttggcatcaggcactgcaaatcattgctgtacgaaaaaactaggcaagaatggagatgttttctatctgcactgtccaagctgctagcctctagccacctgctgctgctgagcatttgaaatgtggctaggaatttatgtatgtgtgtgtgtgtgtgtgtgtgtgtgtgtattttattgtgggtatgtatatatacagatatatataatcataaaatgttaccatcttaaccattttaaatgtaaagttctgtcgcattaaacattcactttgttttgcaacaattaccactatccatcttcagaactgtttcattttttctaactgaaactgtacccatgaaacataaactgcccagtttttcttccccgcagtgccccgccactcaccatcctaccttctctctatgaatttgactattatgggtacctcacacaagtggaatcatacaattatttgtttcttggtgactggattatttcacttagcataatattttccgggtccacccatgtgctagcgtgtgggccatggaacttttaatatgatttaattttcattaatttaaatctaaataggtacatgtgacttgtggctgctgccctgaacaacacaactctagcaatgttgcagagaaagtgtggattaaaatggggaaggcagacgcccctgtcttgggacttgtgtccagggttttatgcatagcaaagagaactgagtgcaagcacagtcccaggcggcagacccngggagccagggtgcaggggggatttgagggcacagttggctatagagcaaggctgtaaggtggtgtaaaccagggtgagctaaggagaaccctggggccaactgaatctctgcgtgaactagtatgaaagggccatgcatctacccccaccagaatgttgttgactctgtactctcccaatacccttgtttggtgtcctctgaaagaccccccatggatggatctgtgggagaggggccccctgaaggtccctgccaccgttgtgattctgcagctgctcttggctgggagtaggactgggacctttgcttggaagccacgccagctccctccaagcctttcattctgcactttccagggaaatcaggatgagtacagaggcagccgaacaacaaggcctctgacagatccctgatctagatgttacctggtggtcatatgtgtccttgaaattcctgtgatcaacttgagacaaccatttatctcttagaaaggaacaaggctggccaggcacagtggctcacgcctgtaatcccakcactttgggaggccgaggagggcagctcacccgaggtcaggagtttgaggccaacctagccaacgtagcaaaaccccatctctactaaaaatacaaaattagacgggcatgggggtgggcacctgtaattccagctactcaggaggctgaggcgggagtatcgcttgaacccaggaggcggaagttgcagtgtgacaatatcgcgccactgcactccagcctgggcgacaagagtgcgactctgtctccaaaaaaaagaaagaaaggaatgagaggctgagaatggacaggatagtctggatgctgcaaaataaaatttaaaggtgtgtgtgtgtgccttagactttacagtgtggcagttaagagcaagattcggacatgtaactaatcgcatatcctgggcaagtcctttaatctctaagcttctgattcttcatctgaaaaacggggctatgatgaggacgaacctagacaatgtgattcccatataataagctctcagtaaatgataagggatagtaactgttattacaattctcatttttaattggctaaccagattgctttcacatttccttggaagattctggataaatgtgtccttcttgagcccgtggggcagaaggagctttggggattttcctggaggagagggaggatccctgaggcaccagatgagccaggagagccttctgcagagtcacctcttggttctcctgtttcagcascagcgggaggcccttcctgctctatgtggctctggcccacatgcacgtgcccttaccygtgactcagctaccagcagcgccacggggcagaagcctgtatggtgcagggctcygggagatggacagtctggtgggccagatcaaggacaaagttgaccacacagtgaaggaaaacacattcctctggtttacaggtaaagtagtaaaagccagccagcctaactgccatttaatagacaaccttgcacattacctgtgaagagcagagtctggccccgtgatcccctttcataggtcaggaggcttgctttgaacttgtggcccagataaggcttgctggcctgaatgctgagcacctgtccattggggcctccaaggccaagtccctggaaaggtttgcacacacagagcagccaccttgctggcccgttgtgtgtcgattcaggctatctgggtattgctcktaattgccattgaatgacattgacattgtgagcctgtgttgtccctgtgcagttctaagatttccctcttctccatcttccctggtcccaaagattctacttgctgccactccccgtgtcacgtcttttggctgagtggccttagcgagctgaactagtggcctctttaaaggcctcacacatgcattgtgtattttaggtttctgtctggagcgactgcagaggttataagcactgcttttggccaggttgactcacacctataatctaataacagcactttgggaggctgaggcaggcggatcacctgaggtcaggagttcgagaccagcctggccaacatggcaaaaccctgtctccactaaaagtacaaaaattatctgggcatattggcacacgcctgtagtcccagctactctggaggctgaggcaggagaatcgcttaaacctgggaggcggaggttgcagtgagctgagatcgtgtcactgcactccagcctgggagacagagcaagactctgtctcaaaaaaaaaaaagcactgctttcgggtcaagtagagacttatactctctaccgtgcagtgaaggtgttataaactcctacagggtttgaatctatactctactattgggggaattcccttaatctctcagtctccttttcctcatctgcaaaattaagctaataaccgaatctactccatagcatgttggaggattatgagatgatgtatgtgaaacactgggtgcataatagatgctcaataaacagttgctgggctgaagctgatgacggtggcaatgagattgctgaaaccttacaaaaaggcaagagaggaaagaggaaggaagaggaggaaaggcaaggaaggcaagaggctcacgatgggactgggttggggcaggaaaaggccacctgtctctgaaagcccagtagagacacatctcatatcaagggttgttcttcacggatgggaatcatatttgtctttatttatttatatttatttatttttttagatggagtcttgctccgtcacccaggctggagtgcagtggcaggatctcgcgtcactgcaacctccgcctcctgggttcaagcgttttttgcacctcagcctacagagtagctgggattataggtgcccaccaccatgcccggctaatttttgtatttttagtagagaaggggtttcaccatgtcggccaggctggtctggaactcctgacctcaagtgatctgcttgcctccgcctcccaaagtgctggattacaagcgtgagccactgcactaggcccatgtttgtctttataagtcctttttctatctagttcctgctctgcgcaagggatatagggccagagtgggagggtcagcgaaagtgtccaaccagcctggtgaccattaatgctttttctggtttctaggagacaatggcccgtgggctcagaagtgtgagctagcgggcagtgtgggtcccttcactggattttggcaaactcgtcaaggtaaggggctcagctggggttggtggatcccattgcaatgctgagcccaggctggggtgtgggattctgcctcygggtgggggacaacttatatctgggccttagggtcatcattgtgaaacagggacacatttgctcaccagccaccagcacccagacaagaaggaacaagtagtggtggagaaaacgactgctcagtttggaccatccctgtctctcctttcctcctagaacttcccaaaggcgaccagccctccacccaacgagccagtctacctacaaacattccaacaaatgagctttgtctttactttcatcctgttcccttgctcttcctccttcctttttaaaacttcatccctccatccatctaaccattaatttatttcatccattcaaaaaatatttagtgtacaactgtacaaggtttttaatgtacattgtctccagttcttacaagagtgagagggtggcagtcatagctccatttacagatgaagaaaaagagaggctaggccgggcgcggtggctcacgcctgtaatcccagcactttgggaagcccaggccggcggatcacgaggtcaggagatggagaccatcctggctaacacggtgaaaccccatctctactaaaaatacaaaaaattagccgggcgtggtggcgggcgcctgtagtcccagctactcgggaggctgaggcaggagaatggcgtgaacctgggaggcggagcttgcagagacagagcygagatctgcactccagcctgggcgagagtgtgagactccgtctcaaaaaaaaaaaaaaaaaaaaagaaggagagaggctcagagagggtaagtaatttgcccatgtcacacagtttgtgaggagggagccaggttttccactgaagttaaagttggtgctcgccctgttgtaccataatgcttctcacagctgcctctgtctctatttcaacatcttccaacttccaactcagctcccatctgctctgggagagctttgccacaaggacctcactttctgagactgcagccatgttggggacaatttgacatatggaccaaatgcttgaaaaatacgcatatcatttgatgcatcaattcctcctgtaagaatttgtcttaaggaaataattaggcacatgctcaatgacatacgaaaaaggatgctcattgcagtgaatttttttcatagttggacataacccaagtgtctagtaagaagatagtgcttaaagaaattattatacctccattaaaaggaataacaaagaaccactaaaataattcatatttattgacttggaaacatttacatgaaatatttttaaatgaataaagcaggttccagtatggaacaatatgtaaagtatgattttattatataaaaataatcacatgtagactcaaaaaaatcttgaaagagtcaataaagggtaacaaaacattagcartaattacctctgggcagcggagggagagttgaaggggtgaatttccccccacaataaactggtattgtttgtttcatataaattaaatgtttaggaggtatttgtgtccaagaggttcagaggtggacctggcaagtttaccctcattgagggatgtgtggggcagaattttagatctgggactgtgtattagtccacagactaatacacacaatcgcaccattcttgaattagagggaaccaaaaaggtctatctgtctgtctgtctgccagttctatctawctgtcatctatctatctatctatcaattgatcgatcgatcgatcgaaacaccaatactccaagagataaaataaactcacattgctataaagaactacctgagacagggtaatttataaagaaaagaggtttaattgactcacagttctgtaggctgtacaggaagcatggctaggraggcctcaggaaacttacaatcatggcagaaggcgaaggggaagcgtgtatgtcctacatgtttggagcaggaggaagagagtgaaggggaaggcgccacacacttttaaacagccaaggctaatgagaattcactcaccatcatgagaacagcaaagggaaaatccgctctcatgacccagtcgccttccaccaggcccctcctccaacactggggattacrattcgtcatgagatttgggtggggacacagagccaaaccgtatcaggctgttttccctgctgtcaaactcaatcctgacctatgaccctcagctgtctccaggaggtctccactakcactcccgtcatcgtattagtctggcaggataattgtagttacctagaaactgaagcattgtgcgcctcaattctggtgcagagaaggaaatgctgatttttttttttttttttttttttgagacagagtcccactctgtcacccaggctggagtgcagtggcacgatcttggctcactgcagcctccacttcctgggctcaagcgattctcctacctcagtctcccaagtagctgggattacaggtgtgtgccaccacgctcagctaattttttgtttgtttttttttgtttttgtatttttagtagagacggggtttcaccatgttggccaggttggttttgaattcctgacctcaagtgatccacctgcctcggcctcccaaagtgctgggattacaggcatgagccaccgtgcccggccatgatcatttttatttttcaattttttttttttgagatggagtttcactcttgttccctgggctggagtgcaatggcatgatctcggctcactgcaacctccgcctcctgggttcaagtgattctcctgcctcagccttcctagtagctgtgattacaggcacccaccaccacacctggctgattttgtatttttagttgagatggggtttctccatgttggccaggctggtcttgaactcctgacctcaggtgatccacccatcttggccttccaaagtgctgggattacaggcgtgagccaccatgcctggcctacttttcaattttaacctattgtcccttggatcagatatcttgagaactttaggagcaagtggctgcaggactgtggccatatcttgtgtctggaaatttgagtcggggtcaggagagctgagtaccacctcccactaaccttttcagtgaccagattattttatctcttggagtattggtgtttctcactctcactctctctctctctatatatatgtatagatctttttggtcctcttcagttcaaaaatgctgtgatttagttgtgatttctggagagttgggtcaaaagaagatgctaaggaggactggaggtggatgggggtgtgtcaagaaacaggagccagccaggcgcggtggctcacacctgtaatcccagcactttgggaggccgaggcgggcggatcatgaggtcaggagatcgagaccatcctgactaacacggtgaaaccccgtctctactaaaaatacaaaaaattagccgggcatggtggcgggcacctgtagtcccagctactcgggaggctgaggcaggagaatggtgtgaaccagggaggcggagcttgcagtgagctgagatcgcaccactggactccagcctgggtgacagagcgagactctgtctccaaaaaaaaaaaaaaaaaagaaacaagagcctagagaaatacagcataaatgggagtggtttgttgcattagctgattacaattcctcctttctgtacctgggacactcttgggccaggctgtcatcttcagtgttcagttagaaagcctggaatagcctggtgtcagaagccccaaggctaaaagtccagaaggtgcagaaggtgtggagaccatggatgcagggggaaggatctgtaagtaagtggcttctccgtggggagaagaatttacctactgatctcctatctgaggacttgccttattgatctcttctctctttatgaggcagttttgaaatagtgagtcaggcttaaggatgtggactgggaccccattcttcgagggaatgatgagaaatacatttactagctggccaggtgcagtggctcatgcctgtagtcctagcactttgggaggctgaggcaagaagatagcttgaggtcaggagttcaagaccagtctggccaacatggtgaaaccccgtctctattaaaaatacaaaaattaaccaggtatggtggcgggcacctgtaatcccagctactcgggaggctgaggcaggagaatcacttgaacctgggaggtggaggaggttgcagtgagctgagattgcaccactgcactccagcctgggcaacagagtgagactcagaaaaaaaaaaaaaagaaaagagaaagaaaacagaaaaataaaaataaatttactagctgggcaaccaccatctctcctttccttccttcctcctgtaagcattcgttgagtgcctactgttttctattcctcctatttgttgagcacctactgtgtgccaggaactatgcttagtgctggtgccacaaagatcaacaaagccccarccgcaaggaataatagtctagaatagtgtttctttgattttaatatgcagacagtcccctggggatcttgctaacmtacagttctgacccaagagggctgggttgctgatgggagttttgcatttctaaggttctcctaggtgacgctgatgtggttggtccagggaccaaactttgagaaccaccagtccagaacatctacatctagaccatgagtctagaatcatctgagtgtagaactttcaactttagaccaatggttatcaaagtgtggtccctaaccagcatcattagcaccacctgagaaattgttaacagtacaaattttagggcttcaccccgggccaaaagaatcagaagcactcnggatgggtcccaggaatctgtgtttaaacaagtcctttgggcgataatgcaggttaaaatttgagaactacctgtctagagctacacagtctggtatgtcaggcactagctacatatagctatttaaattaaaattaatacaatttaattaaaattcaattccttggtcacaccagccacacttccagggctcagtagccatatgtggctagtggctaccatattgggtagcaaataggcttccctgggggtgatttgtgttttgaagaatgagtaggagacagccaggaattggcaggagaagaggctctgggcgagggcagcagcccgggcaggggtgggaacatcggggagtaggagccgctccctagagctgcccctgtgtctgtgagtctggagtttgtggcgaccaaggagaatagcgagagatggggccagcgttcaacgatcttttcagtttggcttttattttaaggaaatgtggaaccatgggaagattttaagagtgggagggacattatttaatgttaaatatggaggtgaaatttacatcacataaaattaacattttaagttgttcagttaagtagcacttagcaccttcccaatgttgtgcaacgaccacatctgtctagttccaaaacacttttatcacctcaaaagaaaaccctatatcctttaattaattaattaattaatattttagagatacagtcttgctctgtcccccaggctggagtgcaatggcgcgatcatagctcattgcagcctcaaactcctgagctcaagggattccccccacctcattctcctgagtaccttggactacaggagtgtgccactgcgccccctgcrtttttttttttttttttctgagatagggtcttgctctgttgcccaggctggagtgcagtggcatcattacagctcactgcagcctcaacctcctggattcaagcaatcctcccacctcagcctcccaagtagctgggaccacaggcatgcaccaccatacccaactaatttttctttaccttttaaaattttttttgtagagacggggtcttgctatgttgcccaggctggtctgaaactcctgggctcaagcaatcttcccaccttagcctcccaaaatgttgggattacaggtgtgagccactgcacctgtcctatgcctagcttttaaaatatatatatttattttatttaaccccatatcctttaaacagttgctcaccatttcccactccccctccagcatactattcaatttttttttaaaagatccctcttatatcaggggagctgagaacaaggagaagggcaagtaccagcctcatttccactgatccaaaatgaccaatgagagaagccagtgacaaaatctccaggaatatccccaagttcaaagaacgccaaagttggaaaagacctcagtcatctttttttttttttttgagacaaagtcttgctctgtcgcccaggctggagtgcagaggtgcgatctcagctcactgcaaactccaccttccaggttcaagcgattctcctgcttcagcctcctgagtagctgggattacagacgtgcaccaccacacccgccaccatgtctggtatttttagtrgagacggggtttcaccatgtcggccaggctggccttgaactcctgacctccagtgatctgccctcctcagcctcccaaagtgctgggattacaggcgtgagccaccrtgcttggcygacctcagcgatctttattccaaccaccttattggacaaatgaggaaactgaggccaaggagaatggaaggcatccccgaggccagccagcaatggaggggtccacatcctctgaccatcactggctcattctccaagtcacgtgactgctctcacgcacaccttgttatacycgactcctcagccacctggaaaatcctatcttgctctttgaacctagcaattgtcaaggaaaagtctttagcccttgcaacagtctgaatctttctacatcggtgggaggcagagagggtttggaggctcaggctgggcttgaatcttgactcagctcagggctcagcatcctcttctcattaggtggggttgtggaccattctccatggactgttgggagaatcagtgggggtactgcccaggaggctcccagccttgcacctggcctctaatgataacccccattagactaaatttcttcattcctggctgaaacaacctggcggraccccacccatagaagcattagaaggggattggcaaacaccctgaaaaagattcccccacaaaaggatcaggcaacttaaatcgcatacagataactttaaaagtgttcaggaactcttgggaaactttgttctgaagctgaatttcaggcacctcaagataacattcttttttggggcaaggccttcccagtaactctgatgtgggatcggtgggtgacagcacttgaattcatgatcgggctggggctggatgccattgccctcttttcttgggagtctgaaagtgaactttgcctgaaaggctgctgcctgggggtaaatacttcttcttcctcagtctccaaagcggcttcctgtcaactaactattccacagcctccttcttcctctctgcctggaatgctgctggagctctgggaagccaggcagcgccctgctcagcaggtggccatgtcctgtgagtcaagggggctggggtccctctggtcacctgctcctcttcacccagttccccatcagtgggacatctgcacggctcactgtacaggggccagactcaagagcagatgaaagagagaaggcggtcaatgttttcgcaacggagtaggacaaacagtacccggagtcgtgcaactttctccctgaagccaggctgctgcgtcaggccacgtgctgtcttcccctgttctcagggcccccaggcccccctgcttgtcttccctttcctttcctggccgagccgcccagctcagctgatgggatgaggcagcgtctcctggagtcatcttttcaccccgtgcgtgtggactgagaatgctccacttggcttgtgccctgcaggggtgaggagaaacggaactggggcgggggcagagcaaagcagccctgccttctcccgaagaagaagggcacgagtcagacacccctgctgtctctgagtccacagcctggtccaggaggcctggctctcccagcagccgccttcccttctccatgccagatctgtttcctacccaggacagaaccaacaccttgtttttcccctaactgactgctcctctgtctggaaaatcttttctcgttttatttgaagagcagaactgttccttcctcccccttggtgatgaggaaacattctgttgaatttggcatccaggctcctaggagaccttggttgtttgtaatttgatgctatcaggttgttgcataacctttcccgctgggaagcagtctctgcatcctgggccttctgtccagtttggggtcgggggtggggcggggaaaagtcagaggtgctgtgaggtgacagagcaagggataagggactctggctgttggccctggctggggacagggcctgctgatagggacctagaggaagtcaaactgcgtctctttctgggcctttggccaccaggcttggtggaatgtcctcatcccatactcagggccaccccaggccagccggagtcctgggtctgaatagaggccaggccgccctgtgtttctagaaaacgagtacactgtaggcatccttggcaaggggacatactacacttagaaacaaagcctgcttctttattttatttttgtagagacagggtctcactctgttgccctggctgcagtgcagtggtctgatcatggctcactgcagccttgacctccggggctcaagcaatcctcctgcttcagcctccctagtagcttagtagctgggactgcaggtgtgtgccaccatgcctggaacactacaattttttttttttttttttttttttttttttacagagatggagcagaggggtcttgcttgttgcccaggctggtttcgaactcctggcttcaagtgatcttccttgcatcggcctcccagagtgctggtgttacaagtgcgagccactgcactgggctgaaagcctgcttctttagaaggttattaraatgtgcactcctcaraacaggcactctacccagtcacaaatgctaatgcctttgtgggccaggcaggtgatataaaggaacacatgtttgtttttgtcagttatgggcagtgttaggaattcaatawgctggagagaggaccctgtcgaatgacattcagcattagttaaatgaaaaacactaggcatgcccaaccaaactgtcggaggttgtgatctctgctattttctccctacaggtaatttggttggcacttctctggcaggcattatgcaaaagtaccttgcttgaagctttatgtacactgtcttatataactgttcccacagccctgtgagatacgtacaactgacctttgagcgacacggatttgaactgcatgggtccacgtaatacatgaattttcttctgccactgccacccctgagacagcaagaccaacctctcctcttcctcctcctcttcttccttagcctactcaacgtgaagacaacgaggatgaagccctttatgatgatccacttccacttaatgaatagaaaayatrttttgtctttcttccaattttctttttccttccttccttccttctaccttccttcctccttccttccttcctttctctctttctttctttctttactcttttttttttggacagtcttgctgtgttgcccaggctagagggcagtgatctaatcagagctcactgctgcctcaacctcctgggctcaagcgatcatcccacctcagcctcccaagtaacttggactaccagctaggactcccaagtagctgggactaccacacttagctaattatttatttatttatttatttagtagagacacgggtctcactatgttgcccagtctggtctcggactcctgggcacaagccatcctcctgtcttggcctcccaaagtggtgggattacaggtttgagctactgtgcctggccaggattttcttactaacattttcttttctctagctcattttattrtaagtctacagtatataatacatgtaacatactaaatgtgtcttaattaaatgtttatgttattggtacggcttcctggtcaacataaggctattagtagttaagttttgggagagtcagaggttatgcccagattttcaactgcttgggagtcagtgccctaactcttgtgttattcaagggtcaactgtacaatcgtttccctgcttcctggctgagatgattgagactgagggaggttatgaattctgcccaagaccacttggttggcaggggtggcactggagacctgcctgcccccaaaggcatcatcctaattattccttgaatacttcttcaactctagttttcaaaccactgacatcagaattacctagaatcagagccccaccccagacttattaaattagaattcctgggaataggacccagaaatccatgtcttagatgagatctcatctggtgattctcttgtatggagaaatttgcgaatttccttgtttgctgcattgcctttctgactcagtgaaacatggcccttgggtcccagccaagaaagaccactgttcctccgcgtgggcagtggtgagtcttccccggcctgcccctgtcttcatgcatcataaaatgccacttcacttccgtaaccagagaagcacaaataagcaaattcatgaatcatggttttgttgatattttggttgctgtggctaaatatttattgctttaagaggttctgctttaattagagtcacaagtaaccacaagtgcgtagaaatgcattctcatggccataagacacgcatttctcgacagaaagccgaaggcaactaacagttttaatgtgccagtgcctgatcaaagtatggaggcttatctaaatgaatagtgtttgaaattgaaaagtgattagaagtttcatttatggattgtctattgttcttactatgacttataaggtcatatttatgatgctatggcatagaggtataaagtcgtgggcaacagaaagcctgcagtgacgatgactattagctacatttaactttgaaacgtgctgtgttctcttcccgatcttgccccttgccctccttccctgggaatgagtgctctccmcactaaatccccaggagggttttagaagatattgatgtcagagcttcactgcaggtcgattaaatcacagtctctgggaaagagactttggcatgcgtattttttaaaagctctccagtgattctaatacatattcaaaatggaaccacctccctaggtttagtgagtgagggtgctggctgtgtagtcagaccggcgttcacatcttggctctrtcattttctttctttcctttttttttttttgacagagtctctgtcrtgcaggctggagtgaagtggctcaattttggctcactgcaacctccgcctcccgggttcaagtgattctcctgcctcagcctcctgagtagctgggattacaggcatgcgccaccacgcctggctaatttttgtatttttagtagagatggggtttcaccatgttaggctggtctcgaactcctgacctcrtgatctgcccacctcagcctcccaaagtgctgggattacaggcgtgagccactgcacccggccggctctatcattttctagctatgtgacttgggggcaaattacttagcctctctgagctttggtttccccatctgaaagatggggacaatagtggctaacttgagaggttgtcataaggattcaatgagataatgccaggaagcatgtatcatgctgaggagcacttaacttggtacttagtaagggctcaataaatacgagatgttattgttgttgttattactattatgtttaacttagaataactatccattagtgggagcaggtattactgaagaatattgggggatcaggagtagctatcctagaatttagcctttgctggtgcagataaaacacaacacgcctgtttgatataagcatatgcatctcataattagagtacacaatcctaggggccgatagaatgccagtcagatctttgtaagttttgtccactcctagcagtaccagtgagaagctgagatttatagcaagacagtatctgcgctgttggtgacacataaatattttacaattgcctgttcacactctagacccttttaagataaatccctttagaatacaaggtctgtggacctgtgatcatttgggtggctggcatatataatygtgtcttcctgttagagccagaacccaggatgtagcctgcactaaccaactagtctgtacaacaaaaagaggggattgctccttaagtggccacactgagaggcttctctcagccaatctttttctttctcctaattcctgaatcttttgcaaggagattgtctgctttgttgactacacctgttttataactagctggattcctccaaacccctccagctttcagtcctttgctgaaataagacaagcacattgaaacgtttttctctgaagagcgtattaggaaagtcagtcacctacaagagagcaacacaaaaggttgtggcaaacgagaagaatccctaattcttgaagggatccctaattggtgaagaccaattagcaaatttattaattagaccaatccctaattggtgaagaccaattagcaaatttattaactaaaggtcagtttacccttctggaaacatcctggaggcagagaccaaatcctgtgttcaaccctggtgccattgcccaccccagtgccttctggttgaccgatagagctaatggcttgtttcctggaaccacagccgtgatctttccttagcatctggcctcaaaggttaagcaagactatttgaatagtgtacaccatggacatgcagataaacaggctccccgttttcacccacccataccccaagcttccacaaagatgcccccacgggggtggaagtatctacaaagccctggcacatgcctttgagcggatgcttcctccctgccctttggccctaagctgacgcataagtcatacattccaaagccacgtggaaatgcgttttatgcttgctggagttctggattctttgttccaagtgcgtgaataaattggagggagctatatgtatttatgggagacgtggccctcgataggaaggatgtattagagaaatgctgggctagatcaaagagcgtctcattcagcctgcagagactccagttagatttttcaaccccacacccttaaacataaacagtccataggacataagttattttgtgttttgtttcttacttcaaaacttgagggactccaaagctgattatgaaagagtcctaagaatgctgagcatttcccgtgtggtgtgctgggccagggacatcaaaggttccgtttgcaacagtgctagtacagggcgacagaagccttcatcttcttcctccccacgcttctccccacataattgctttcattattcacaccagccaaacaaagggaaattgcatgaccacagtgtgtgtgagccacacacagcacttgccttggaaaggctgtgcacacgctaactttgtgggatccttggcccttggctcaaccaggatgagggtggggtgtgtgtgggggtggtgggatggccgtggttaatgcaacccaacatgtattcaggatgtttccatcaagcatgacctcatgtcttccagcccgctagctatcattatactggtggtcacttttgacttaatggttacaaaaataattcctttaataaccaaggtggaaattcatagattgcacgtagttgtttcttacctcccccaggaggcaagaggttggaactattactgacactgtctccataacatcagaacaactcatgaattcaaggaaaaacaaagcaaagcaaaacaaaataaagccataaaatccatgccagatcggttcttggatgttgagcagatcaaatagctgcagaagtttccttctttctctcttctttaatagttgtatttcttcatcctaaacagacagtcacattatgatcaccaggaagagaaattcacttactcaacaaagatttgctaagccccactatgtcttaggtgcatgagactgatgaagtctcatggtgttgagacacaaaacaagcaaatcaataaatgaaaaaataatttacagtggggaaggtctcatgaagaaaataaaatgaggtgattcagtagagtgaggcaactttttacatctgaagtccagtaaaataaaaagcatattttgaaagatactagctagttgagggaaatagctggttaccaaaaaagtcattcctttgttggggttattggaaactcagagaggggttctcccagagactagctcttagctgaaaagaagtctcgagttatcaccatggatgaaccagctgcctcccctcctctcacagggggaagtccagccaagcagacgacctgggaaggagggcaccgggtcccagcactggcttactggcctggcagagttccagttaatgtcaccagcactgccttgttaaggtatgagaccaaaactaccttgrgatgttggggcccagagcaagaaaagtcatggaggcatgggtggctagatggaggcatgggtggctagatggaggcatgggtggctagaggcctcaggaaggtcattcaccacttgcctttgccgggtgttcccagacacttccaagactctgactgtagaagtgatgaaagtaatagtgaagtggggccacgtgtggaggctcgcttctgtaatcctagcactttgggaggctgaggcaggaggattgctgaggtcaggagtttgagactatcctggtcaacatagcaagaccctatctctaaaaagaagggaagggaagagaagggaggggaggggagggaagggaaggagaggggaggcgaggggaggggaggggagaggaggggaggggagggagaaacagtgaagtgggactcgagccatcttctgggaataacacctgagtgaagaagggattggttggtttcacatacatcagcattgggtcctggctgtgtctgctggagagagtgcagaaaaggcggcagcagcagcatctccctctcagcctgtgccaagctgaccgaggcaatagatcctttgagacctaattgttccatccttggggttaaggcaggtgtcttaggggtggctgtgagaagccggctagtctctagcaatccgatggccccaagaaaggagtccagatgtccactttccctggaggagggtggagaagaaaggtggcccctccaggccattagggaaataatgaatccttaggtgaagacattcctcctgcctctggccatgatgcttcttaatgagctgagtgtctgcatagctcactgcagacccatcacatcaggtaaatgtgatgtctcaccattaytcttattgccgccttaaggcagatccaggaggccatctccatggcaaagaacttggctgtgcagcgtctatgtgaaaacaacatcttcccagctatggaaccatgacttatcctggggacttttcactaattcagacaggaccttcctctctgtgttctgccctgtgttcactaacaaggggaaccctccgtagaaccctgtgctcattcatgtgctcagaaaactgctggttaaagaccgatttcctaattccaaaggttctttgccattagcctaatgagttctggcgtaaagaacacagctgagtagaggcaggcaagcttcattggcaccctctgacttccctagatccaatggggaggaggggagagactcaaagtccaggggaaaagggtaaacagctttcagggccaaagtatggggtgggtgggcatcacccctggcagcctgtggggcccccagaaattccgggtcagccctgtacagtcaggagggggcagcgtgctgtcagcgggtaccagcaggtgtgacaacaacagcagagcctggaatctgtgatgtcaggctgcctgggaaaagggccaggcaggctgcttttatagggctgacttggtgtagtcaaagtgcttatcaagaggggccaagtgttcacgggccaggctgcacatggacaagtaactcagccgtctctcaagttgcttcacagaaagccaaccagtggcttctcatcagagaatggtgtttgcacctacagtcaaccataataaaactgcctcatctcattcataatgtagggccttagaggagacaactgactgagaggatggtttggtgacccaaggcagtgtctgcctgagggccccagaattgtaccaggataataccaacacaccgtatcggtacctcctaggagatacattaggttggtgcaaaagttgttgcggtttttgccattacttttagtagcaaaaactgcaatgactttcgcaccaacctaatatatagtgtatcacacacacacacacacacacacacacacacacacataccttttattttatttattttgttaagagacagggcatcactctgttgcccagactgtagtgcagtgccaagatcatagctcactgcagccttgaactcctgggtttgtgtaatcctcccatctcagcctcccaagtagctgggactacaggcatgcaccactatgcctggctaattttttaattttttgtaggcatggggactcttaatgttgcccaggctggtgttgaactcctggtcccaagcactcttccctcctgggcctcccaaagcactgggattacaggcatgagccatcacacacagccaaggctagtttttggtgttaaattaggctggatttcagycagccagttttacctctatagatttaccttcttgctgtttcccatatgaatccatgttaagcaaatttgggcggagtttcctactgcctggacaggctgtgtgtgtgtgtttctctttcccttgacacctcagggtcagcttgacagagaatggtactatgatccaaattcaagacattgatgctaatgcttcatgttgttgggagcccagcccggcaccctccgcccagactgcatatcacctactcttgtttcattgcttgaggaatatagatcttccagatcagagataactcccttaagccactaagagctaaagccagagtcccttaaacctatatccttgaggccctgaggaattatgagcatcagagagtggtcaagttgatataaatatgaatacagaaaagtgaaagagaatgtgtgggagagggggcgggggatccattcacatggatcccattggttttagagataaycartgttaatatcggtgtgtacctgggtgatgtcataagatgaaagaagggtcttgcacgtgacctgcctccacagacacaagtacaggatggggaaaatgcatttattccacagatatttattgccatgtccaactaygggtcaatyattactccagggactggggagatggcagtcatgagcagaccaaacagaaagctctttgtttaggggctaccttaccttcaggaggccagggctttggcagcacatgggaaaaggtttcagtagttttaacttaaaactgtgctgcaggctttcccarycgtggcgtggtcggcattttgggctggatcactcttcgttttggaggactgtcctgtgcgctttataggatgtttagcagcagctctggcttctacccattagatgccaatcgtgtccccaccccaccccctaagttgtacaattaaaacgtttccagacwgtgccaaatgtccccggggagaatgaactcactctggctgagaactacggctttagcggaagctctcttagccatatacaagaaggggaagggcctgctctgcctctgagctgggagacccctacctctgctccgaatgaggatcgatccttcagagatgaactggggcaattatgaggtgaccagaatggcaaaaaggacttgaaacaatcttatttgaaaaacagctaaggccggacgcagtggctcacgcctgtaatcccagcactttgggaggccgaggcgggcggtcattgaggtcaggagttcgagaccagcctgaccaacatggtgaaaccccgtctctactaaaaatacaaaaattagccgggcgtggtggcgcgtgcctgtaatcccagctattcaggagcctgaggcaggagaattgcttgaacccaagaggcggaggttgctgtgagccgagatcgcaccactgcattccagcctgggcgacagtgagactctgtctcaaaaaaaaaaaaaaaaagaaaagaaaaacagctaaagctgctgtgtagccagaagaggtaactccctgggctacctcgtggctctgaaagacagtcaggtgtgtggaagagggattcagctggttctggcctgtcccaaggcaccggtcttggaagtaaaagctacgaggaggctgtgctcacatcagtgtcttgtggtttagctgtcacctacaggcagggcctaaccacatgtcgcctttccaagtcctctcctcctccctggatctggcagtgggtagtggtggttggtggaggtggtctcacccccacccccactcttggcagctctctttactctgtaagaagcgcttggtttgctggggggcatcccctgatgctctgggacccctgcaaccccggttctccctgaaatcaatgtggctggggctatgctggcttctaagagggactcgtgtgtggatgagggtgccagggaagctgcccatcaaatgtgagcataggcttgcccctcatgtctccacggctgagaccaggaaggcgtgggcacctcacttttctcggggataatgacagggaagaacaatgcaggaaaaaagttaaaactaaatgcagaaagaaatttacaactcagtgctaagaaagtactgctcccacggcctagggatgatccctactgttccctgtcccttcctcttcttcagaggaagttctcttcttgccttcattcgggagagatgaacacaaagcctctgtctctgtccaggtccaagcgcctccaatccatccccaagcaaacctctcctgcctctcgcttcctgtccttagatcagatccaccttttttccagataaaacgttctcagcttctctgtcccctgccttcatcctgggatgccttccaccccagggctgcccagcacagcacctcagttcccatactatgcatcctgaagtccatgtggttccttctggaacgagccccctgttggccttccactcccctttacctaccccccacctgcacaccttggggtccagcaggccaggcctttctttctttctttctttctttctttttttagatggagtttcactcttgtcacccaggctggagtgcaatgatgtgatctcggctcactgcaacctctgcttcccgggttcaagtgattctcctgcctcagtctccccagtagctgggactacaggcatgcgccaccatgcccggctaatttttgtctttttagtagagacagggttttatcatgttggccaggctggtctcgaactcctgacctcagatgatctgcctggcaggtcaggcctttctgcatcctcctcgccaccactgccccatctccactcctaggatccttcagcagccccttggataagaacacaaatatgcacccttcctacgaacaaccttcagagcctggggtgaccagagccacaggaaagaaaaagcacatattttcataagggcaatgcaacctgcaaagatgtcaccctgcccactctgaggacagccttttgtgccattgtgcagagcaatctcagccttctcctgttatcacgagtgggttcatggctgcccttgtcacaaccaaaaagcccactgaagtggggtttcatcccatcagaggctgggaaccacttctccatcagacccatgaggcatagtgccagagtccatggaattttggaattttttttttaagatggaatttccctcttgtcactcaggctggagtgcaatggcacgatctcrgatcactgcaacctccacctcctgggttcaagtgattctcctgcctcagcctcccgggtagctgggattacaggtgcctgccaccatgcctggctaatttgttttgtatttttagtagagacagggattcaccatgttggccgggctggtctggaactcctgacctcaggtgattcaccctcctcagcctcccaaagtgctgagattacaactgtgagccactgtgcccggtcctttttttttttttttaatgaaggaagagacccacgaaggcagaagtgcccaggtcccatgaaagctgcagtgtggctctgccaaaagccgggcaccgaaacgaacaggggaagctttgaagtataggtttgtatttattttgtctctttctccgaggttttaaagactcccaggcccaatttctttggtggggtttgaggtttggagtagctggggtgcccttggtagccttagtagggtggatgctttcttcaagttctcatgtaggctgggggcccaggcctgggatgactttgggctgcatgtgccagggaccgtctccctcttccagggctaagctcttgggcttggctttttctgttacttaaggaaggactatttgacagcccaagcttgccaaatcgggatggggctgcctcgagtggcctgagtcactggacatgttgaagcttttctcatgggcgagaggctttctttgtgctccaggtggactaggtacctctgaagttcttgccaaagtctgagacattaggattccgtgaacattagacttagtgctctataattgggatgctaaacctcaggagagagtagtggggggaaatcagatggaaaaagaaagtacacaatactttccaaaatcgaacgcagatcctgtttctcttgctgactgatttgacccatctgtgacgctgatctctcttaggggcacaatttagagaaaactcgagcaaacagctccaaaccaccgcggccttttcagactgctttgtggtcctctttgctttccggtatgtggcaggaaccttggactctggacaggtttctggactgttccgtgctctgcgagtgctgactctgcattcttgactttgcatcagagtggggtgccaggtcctggagcttgtttcttaagagataagccaccagctccatggactgtgggagccaaaggcaaacagaaacattctgcactgtagtcaatggagagattctgcctggggttgtaggtagagccctggagaggagaaggagatggccaacaggagacggagcctcagagcaggtcctttctgcagcccccttagagggcggatatccccccagcccctcagatatcagattggggaaagtggggatttgtggccctggaggcttcctgatgaatggtgcatgcgaaagcctgaactctgctgctgcgcccagcctcagggctaccagggcctctttcttgggaaagtccagcttcgcattagctcagccctcctggctccagtaagccccgctgacttccagttggcctggccatcatataaacggctctgttgaaggggcagcctctctgttcttgcggaagacttttttcccccaacatgagcacaacaggctggaggaagatgtgccataggtagagtaaccttgcaccatatgacttaaaaaaaagtcacatgaacaaaatccactaaaatatgaacaatggctgcctttgggtgatggactaagtgtgtgttgttctctcttttatatttccggatgctctcattttttcaaccataaacattcgctatttttatttatttatttatttttggagacagagtcttgctctttcacccaggctggagtgcagtggtgcaatctcggctcactgcaacctccacctcccaggttcaagccattcacctgcctcagcctcccaagtagctgggattacaggcgtgtgccaccacacccagctaatttttatatttttagtagagacagggtttcgccatgttggccaggctggtctcaaacttctgacctcaggtgatccacccacctcagccttccaaagtgttgggattacaggcgtgaggcaccgcacctggccgcattcactaytttgtaatggactaaaagagctaaaataaagccggtggaatgttccacatatcatggcattttgaacaaaaactaratcttttataacacagagacccgcctaatggaaaaggcagtgaatattctcttgtggacacctgtcccacactgtttcctctaagccaatggctgtcaccaagctggtgacaggtagaacgcctcagttcttaggtgggctcacagggattacccttgtraatcattaagacacaaacatccagtgaggactttctgagtgccaggtcttcttctctgtgccttacatgtgtgtttcatgcacacaaccacctgtgagctggcaccaatacagcagtcctcctttatccacggtttcactttctgcagttttagttacctgtgatcaaccatggtctataaatattaaatgaaaaattacagaaatgaatctaagttttaaattgtgcacattctgaggagtgtggtgaagtctggcaccatcccacccacccygtaacgccctggacgagtccgccctttgtccggtggatccacgctgtatacrctacctgcctggtagtcacttagtagccatctcagttatcagattgattgtcgagatatagcagtgcttgtgttccagtcacacttatttttacttactaatggccccaacgtgcaagagcagtgatgtgggyaattcgaatatgccaaagagaagccgaaatgtgcttcctttaagtgaaaggtgaagttcttgacttaataaggaaagaaggctgagtgcagtggctcctgcctgtaatctcagcactttgggaggccgaggcaggtggatcacttgaggtcaggagtttgagaccaacctggccaacacrgcgaaaccccatctctactaaaaatacaaaaattagctgggtgtgttggcatgcacctgtagacccaactacttaggaggctgatgcaggagaatcgcttgaaccctggaggcagaggctgcagtgagccaaggttgcaacactgcacctccagcctgggcaacagaacaagactccatctcaaaaaaaaaaaaaagrgaaagaaaaagaaattatatgctgaggttgttaagatctatggtgagaatgaatcttctatttttttgttttttctttttgttttttttggtagagatgggattttgccctattgcccaggctggtctcaaaccggccattgttcacatggccattgttcagcctttattcacattttggtggattttgttcatgtcagaacaaaatcaactgatccacccaccttgacctcccaaagtgctgagattacaggcataagccaccaagaatgaatttcctatccatgaaattgtaaagaaggaaaaagaaatttgtgctaattttgctgttgcacctcaaactgcaaaagttatggccacagttcatggtaagtacttagttaagatggaaaagtcattacatttgtgagtggaagacatgaacagaaacgtgttctgatcgggcgcagtggctcatgtctgcaatcccaacactttgggaggctgaggcaggagaatcacctgaagccaggagtttgaaaccagcctaggcaacatcgcaagaccttgtctctacaaaaaaataaataaataaataaataaaaatcaataaaacaacaaagaaatcttgtaggtgtggtggtacatgcttgtagtcccagctactcttggagtcagacgagtattacttcagcccaggagttcaaggttacagtgagttatgatcacacactgcactccagcctggatgacagagcaagactctgtctctaaaaaaattaagaataaacatgtttgatttatggcaatcaggtttggtacaatccaaggttccaggcattcactgaggcccttagaatgtgtctctctctgataaggggggactactatattattaaaatatcatacccatcttagagaattgaaaactgaggcattgagaagctagatatgtggcagagctgggatttgagcccaggcaacagctggctgcagagcctgggtgctgaaccrctgcaccattctgcctcttgtaggagcagaaatccaggtggaactgaaaggaaaaacaagcaggtagagaagttaagccagcccataggagaggctgtgggtgcttgctctgggctggttcaggtgggggttgacacggcagggtcagggagcgagtcagaagagctggggacaactcagtcttgttatttccgcagcgtgctggacatttttccnactgtggtagccctggcccaggccagcttacctcaaggacggcrctttgatggtgtggacgtctccgaggtgctctttggcyggtcacagcctgggcacagggtaagtggaggaggtacttgcccacatgtaggctctttaggaggctggtctgctgcctctcacctctgtgcagacagaaccatcatcagaagatggtcaagaacaggctgcaggtcggatacagtggctcacgcctgtaatcccagcactttaggagaccaaggcgggctgatcacttgaggtcaggagttcgagaccagcctgaccaagatggtgaaacctcacctatactaaagatacaaaaattagctgagcatggtggcatgggcctgtagtcccagctacttgggaggctgaggcagcagaatcgcttgaacccgggaggcagaggttgccgccagcaagtggctggttcagaccccaaaaggtgaagcatttgagatgagcctctttctacccccaacccccagtccagatttatatttaacagtttggcttagggtgggtgtatataggttctcattccctataatgggcaatttcttttcctgaatgtatttaatttaataacatagctacccagtatttttgttagatgagatgactgactagtgtctgcaacttgtttattgtgagcctcaccctctagaatggaagcttcttgagggcaagaatctgagctgttgagttgagctccgagttctcactgcctgcagtcagccagcatttcagtccatgcaaactggatgaaccaatgaaggaacaaatgaacaaatgagtgaaagaccctttggacagcaggtccagcaagggccttacatccaacattctcccagctccagagggctcagcacactcttggcagcctgttttktttktttgtttttttttttgagatggagtcttgctctgtcacccaggctggagtgcagtggtgtgatctcagctcactgcaacctccgcctcctgggttcaagcgattctgctgcctcaccctcccgagtacctgggactacaccctcccgagcccatgccaccatgctcagctaatttttgtatctttagtataggtgaggtttcaccatcttgaccaggctggtcttgaactcctgacctcaagtgatcagcccgccttggtctcccaaagtgctgggattacaggtgtgagccactgtatccgacctgcagcctgttcttgaccaagcagaccttggcaatggctctgggcttccacttcccagcatcacctcctcaatgtcccctgtttgcactctgaagcactcattggcagtgacagccaggaaatgtcaggcctcatggcctttccttgtcttttccctgtgttttcctttcaccaaaaggaagaggaagcaggaggaggcaaggaggcggaaggagcacagagtcccctctgcaacgccctacaaatgcatggcttcttggtgagggacccacacatcaaagggtctatttgtgtctttgctaagggtcacatggaagtgactcaaatgtacagaagtgtcctgtggctggtagttaccaaagctgcccttcccacccagcctcccccagcaaaccagaacatgggtcttctatgggccatcggttcttctgtgcacattaatgcagtttttaggggttgttggatgaagcctgagaggtgttctgaagtcctgcttctccccagaatatctgccccctagagctgcagacccttccaggcctagcccttctccctaagcaggagcagccaggcaggaagatggtttccgccttgaggttggaagttagcagtatgtgaccctggagggttgtcacagacgtcattggagaggtgctccggagtgtttattaccatggctgctaggaataattggggtcatcaggaagtgcttcaaggactgtgstctccttgacgttgtcggtactgcctgtgggagccagctccttcatgtactaacttcctttctcagacgggagagctctgctcttgctctaactggagttttgcgcaggctcgtagagaccccatcctaactagtgcccagcagggttaggcccaggaaccagattggaaaaccagatacaagtcacagcatcgtcacggggaggtatgatggcgtggttaatgcagctggagtcaggactgatttgctccctaaccacaccccatggcccagaaagaaacagccatgcttactgcttgtgggaagcagctgatggtatcttcaaggttaagagcacacggggctggcacctgtgggtcacactcagtctcccagagcatgcctgcagtgtcagtgaagacacttgagataagattctgaagtttgaggacaacatgggtagttgctggacctgaatttgggtttggtcttctctagtcagtcctctctatcaaagcaaagtcatagacctaaggaaataagagtaaattgtctcaaatttggaatagctatgggggaggcttgaaggtaagaatatgaggaattatatatatatacacacacacacaatattctatacatacttacatgtatgcatatgtgtgcatacgtctatacatgtgtgttatacgtgtgcatgcatattctagacgtgtatgcatatgcatgttttgttttaatttaatttaattttattttattttttgagaggagtctcactctgtcgcccaggctggagtgcagcggcacaatcttggctcactgcaacctccacctcctgggttcaagcgattctcctgcctcagcctcccaagtagctggtattacaggcgytcaccaccacgcctagataatttttgtatttttagtagagacagggtttcactgtgttggccaggctggtgtcaaactcctgacctcaggagatctgcctgcctcggtctcccaaagtgctgggattacaggcgtgagccactgtgcctgggctgcatatgcatgtttatgtaccatgtatgtatattcatgtatgcatatccacatctgtatacatacatgcatacatatgtatgcatatgcatgcttataccacacatgcatacacatgttcgcatatgcatgtgtctatataaacatacatatgcatgcttatgtttatacactatacatgtgtacatatgtatgcctatgcatgtctatgcacatatatgtatacacatgcatgcacacacatacatgtatacatatgcatatgtccaggcacataaatagagatatacacacatatttatatgcaggtgtatgcacatgtatacatacgtgtatatatatgcatatatcaatatacacatacatatgtgtacacagatgcatatgtctgtaacatatgcatacatgtgtacatatgtattttaaaataagcacaatttgtgttcaccctcagatacatcctgggcttacaaggattccaatatgagttggtttagaaacactttcagttctagaagctcaaagtaactcctggatattcaactgggaacaatatgccaatgcttctcagcaatccagtccttccctattgcaaaccaagtaaccaagagttaaggagaggagcaagagagttgagaggtgtcatgtgcacaatgagctccagttccacactggatggtcttctcacaacccactccagcaacctctagggacgttgtctctgtgatgttcgaaaccacatcagctgacaccatgctgcatattcttgcatcagctcaacctcctgcttctgatcttgatgggtctgtgtctaggcagtgaggggcaccaggagagagatgagggctgggaaggggagggctgcacagcctagaaccaaaggtcccactttgtgctttcctggctcccagatggaagctgaaggtggtaacatcatcactggtcaggtcgtgtcttagccccaggttgtcatgatcaggtccagaaattgtcaacgaaggaacgtttcccctaacagctctgcatctgcccagcctcacacagtctggggctgctgtgggtcatcaaatgcttgacacgcccctggaggccatacatcgaggaaacaagctgagttttaatgtccagaaagaacgctgatcacttctcttagggaggcccctagtggcgagagatgtcatctggcgtggctggcaaactgaccacccccatccaccccctttggaggctgtagctgtgcatccccacctgaatggagaagaagcccaccttcaggggatgctatatcagcaccctgtgggacttaaggtaaaggaatgctctcgtgcttaaaaaacaaaacaagataaaatagagcaagaaaggccaccaggaaggcaaaacaagtttgcagaagataaagtcatctttgaaatttgaaccaggcatctggagagctgtgattcatgtgtacttttgacagcttccttcctatattgatataaacaagaaagccataatgggtcttctcaaacaaacnaaaaaaatgcatagacaagttctccaaagtccatctatgtttctgagaatgagccatcccacagttttgcttcctcgtggattttggaagttgcctctggtaacgccacataaatagtgggaatatagcagcccaccctcmtggaatttctgtgactgagacgcaagtactgtgactgatctgaagcagcaacttcactcccatcttctgcatgtccgcgtgcatcgtatatcagttgacaatagattttccaagtctcccacttcctgctgtctcaagaaggaaacaaaacagtctcctgtggtgaagaggcttggctttctgcagggatggaagaagtgagggttttcagttacgacttcttttcctgtttggaaggaacctgctatcatcatgcgcgccctgggtttgtgcagggattgtcacgagaacctggaagccgcaggtgtggggaggagccccaccttggcggcatcctctcagagctgtgaaactccgggggacagctgtttactgctccaacagatgtttctcatttttttcttaagtctcgtgtggaaactttgaatcatgtaagtgcctttccagccctatatacggttgtgattcataccaaggcagtctcatgcttttagcccagacccaccaacctaccaaggacactggccttttgttttctttcacatccttccctcgagaaccctgatttaggtgtttccattctgtacggtaattcttttatttgtgacctgatgaggaaagatttcctcagtccaaatatagtcggattgagtcatagctgtgggcgtctgtgaccagagtctgggctgtgcccgattctgcggaaatcaaggatgccttcttttgtaccatccttgctcaagggagagttggaacattgacttgatgctgaagaagcctttcttcaaagacagctgagggtcacctgcatcagaacccttggaaatacttgtaaaacaagtaagtccccagggcccatcctgaccctgaggggttggaactcaggcagggtggccttgtgggcctgtgaccggtgccccccacacacagagccctgcacttggagggaccctgtgcttggtttaaagctctgccgtggtcatcwtgaaattttaagtttgtgaacaaggtatccctgatttgcattttgttgtggactttgcaaattacatagcaggtttcaggcctagaaatctgacctacctagtgagaccttttgcctactcttccagagttgtaacccactcccatcaattaaccagcaaaataacaacttcacaggctccctggagttgactggtgtggactccaggcttgtatctgtcagtgtgtgtttgggcacagggatagggagaccagaccctgaaaaagacagtaatatnttccagggagcatctagcatcatctagcatgttttattttcttttgctgtttcgagacaggatcttgctctatcacccaggctggagtgcagtggtatgatcatagctcactgcagcgttgacctccyaggctcaaacaatcctctcacctcagcttccaagtagctaggaccacaggtgtgcaccaccatgcctggttaacttttgtatttttttgtagggaggggtcttgctgtgttgcccaggctggtttcaaactcctgggctcaagtgatcctcctgcctcgacctcccaaggtattgggattacaggcatgagtcaccgagttctgccaatttttctattagtaagctctgccaccctttctcaggtgctgttccaccccaacagyggggcagctggagagtttggagccctgcagactgtccgcctggagcgttacaaggccttctacattaccggtgagtgaggggccacttagccctgcctcccacagtcacagctgcacggggaccccatggactctcacccaggcctctgggaatgagtgtgagtccctcctttgtggggggttctcagcacctcttgacaagcgtctcctccaaacccagggtccctgcacaggctctctggatccctcatatgcaaataagatctttgtgctgttcacctgaatttctagtgagctgggagctctcagcacgtttattcagctccttttcacatagagagcatttcctattgtcgtgctttaaatgccagtttggatgaacattaaatggaagcctagagatattttaaagtataatttacttgacaatagaccgtttcagaaaatagattttagaggactagttagcaaaccgacagaagtctctctgcttcttggttcactgtgactatctgtctcttagatgtatactttagaaatgtcatactgtatcaggatggtcctcagggtcttccaatggcttcttgctgccaattgaattcagactctcaatcccgagtcctactgtctttccacccttagttttccaagaacaagtctcctcttccttggtctccatattaaaatccttttaagcctttatggcccaagtcaaatgccactttcataaaactctcttatcttcccagctgggtaggaattctggagaactctgttatctctcactttctgccatgcatgcccgtcatttaggtacacgtcttatttcctgtactagttttttttgttgtttgttgttgttgttgtttgtttgtttgttttgagacagagtctcgctctgtcgcccaggatggagtgcagtggcgtcatcttggctcactgcaacctccgcctcttgggttcaagcgattctcctgcctcagccttctgagtagctgggactacaggtgtgcaccaccattcccggctaattttttaatttttagtagagactgtatttcgtcatattggtcaggctggtcttgaactcctgacctcgtgatccgcccgcctttcagcctcccaatcctgtactagttttttgtttttgtttttgttttttgagatggagtctcgctctgtcacccaggctggagtgcagtggcrtgatcttggctcactgcaagctctgcctccctggttcacgccattctcctgcctcagcctcccgagtagctgggactacaggygcccgccacctcgcccgccttatttttttgtatttttagtagagacagggtttcaccgtgttagccaggatggtcttgatctcctgacctcgtgatccacccgcctcggcctcccaaagtgctgggattacaggcatgagccaccttgcccagcctgatcctgtactagttttaagctttctaaatttggaactctttcagcactttaatctttgttgtcttgaagtgcttagcacacttagtaggaacgctacaatttttaagtaaatgaaaaacaaaaaataaaaaaaggagaacctgtgacctaatgcagattccaacttgattcagttatttaatgttggagcttttcaaattatatgataaaaaaattattttccctgagtgtaaataagtgatcctgaagaaaatgtggcataaaaacaaaacatgacttgaggggtattaaaaatgtcacaaaaatctttgattctctaaaacctaaaactcagtcagatatttgttgttttcggttgaaaagtttctagattagagtccttatattacattatctaagaggtatgggacctccaggctgagttaatttcacaagtaaaagtcctgccagaaagcccttggcaccacaatgttggaatcagacatgttactatgaagtaatagggctatttaaatgatcacaatcagataggaactataacacccaggggaggtctgctcttctaaggagtcaccaaactcccaagagagtctgggtagggagcactgaacttttaatccatcagtgaaaactgggaataggatgaaacaggggcatgttctgattccctcttcctcttgcttctaatatttgcattccagttacttacaactgcttttggataagctagatgaattgacatctactacattagattagagaaagatgtgttcgtctatgatgaggatatgatgttatggtcacgcactgggagtggtcttgaaaagacaaccagtctgttttggtatgtggcctagaattaaggtgtaccttattgtttttctttttttttattattatactttaagttctagggtacatgtgcacaacgtgcaggtttgttacctatgtatacatgtgccatgttggtgtgctgcacccattaactcgtcatttacattggttatatctcctaatgctttccctcccccctcaccccaccccacgacaggccccggtgtgtgatgttccccttcctgtgtccatgtgttctcattgttcaattcccacctatgagtgagaacatgtggtgtttgtttttttgttcttgtgatagtttgctgagaatgatggtttccaggttcatccatgtccctaccaaggacgtgaactcatccttttttatggctgcatagtattccatggtgtatatgtgccacattttcttaatccagtctatcattgatggacatttgggttgggtccaagtctttgctattgtgaatagtgccgcaataaacatacgtgtgcatgtgtctttatagcagcatgatttataatcctttgggtgtatacccagtaatgggatggctgggtcaaatggtatttctagttcgagatccttgaggaatcgccacactgtcttcctcaatggttgaactagtttacagtcccaccaacagtgtaaaagtgttcctatttgtccagttaaggcaacctgtacacaaagtgaaaggcccagatctataatgtataatttggtgaggttttataaatgtagataccgtgtatgtacccttttaatggtgtgaattccattgattctttttctttttccattgattgattttcaagtgttaagccaactttacattcctcaataaatcccatttagtaatgatgtatcatactttttatatcttgctgattttgatttgctaagattttgtctataattttcctttcttgtctatgtcaaggtttggtatcaggattttgctggccttataaaatgagttgagaaatattcccttctctattttctgaaagggtttgtggaagatcagtattatttctttcatgtttgattgaattcatctgtgaaatgatttgccaaattcattgttgtgaagattttgtcatatttttaaaaagagtgttagtattttaggtcttatatttagatctctgatccatttccagttaatttttgtatgtggcataagtaagggtccaacttcattgttttacatgttgacatccagttttcccagcaycatttattgaaaacactgtcctttccccattgaatggtcttggcacccttgttaaaaatcatttgatcatacatgtgagggataatttccactgtctattctatttcattagttatatgtctatgtttatgccagtaccacactgttttaattactgtagacttgttgcagttttgaaatcaggagtgtgagtcctacagctttgggctttttttttttttttttttttagactgttttgactatttctgggtcctctgagattccatgtgaattttaggatggctttttctatttctgcaaaaaacatcatcaggattttgataaggattgtactgaacctgtagaccacttggggtagtattgacattttaacaatattaagtcttccaatccatgaacatgggatgtaaccatttgtttatgtcttctttaatgtctttcagctatattttatggttttcattatgcaagtctttcacttttttgtgttaattcctattttactctttttgatgccattgtaaatgaagttgttttcacaatttcgttttcagattgttcactgttagtgtatagaaatataactggctttgtgttctgaatttcaatcctgccattttgctgaattcctttattagttctgtttttatgtggaatatttaggttttctacatataagattatatcatatctgaaggaggtcattttacttcctccattccaatttggatgctttttatttctttttcttgccgaattgctctggctggaatgtccagtactatgtggaacagaaatggcaaaaatggcattgaaacttttattaatatattatgtccttctctttgtctcttataaccctttttaaaatttaaagtctattttgtatgatattagtacaaccactcttgctatcttttggttactatttgcatggaaaatcttttcctaccatttcactttatttattttttatttttccatgggttattgggatacacgtggtgtttggttacatgagtaagttctttagcggtgatttgtgaaattttggtgcacccatcacccaagcagtatacactgcaccctatttgtagtctttcatcccttgccccctcccactttacccccaagtccccaaagtccactgtgtcattcttatgcttttatgtcctcctcataacttagctyccacatatcagtgagaacatacgatgtttggtttttcatttctgagttacttcacttagaataatagcctccagtctcacccaggttgctgcaaatgctgttgattcattcctttttatggctgagcagtattccattatatatatatcacagtttctttatccactcattgattgatggacatttgggctggttccacatttttgcaattgcaaattgtgctgctataaatatgtgtgtgcaagtatctttttcgtacaatgacttcttgtcctctgggtagatacccagtagtgggattgctggatcaaatggtagttcagcttttagttctttaaggaatctgttttccatagcggctatactagtttacattcccatcagcagtgtagaagtgttccctgttcaccgtatccatgccaacatctactgttttttgattttttgattatggctattcttgcaggaatgaggtggtatcatattgtggttttgatttgcatttctctgatcattagtgacattaagcattttttcatgtttgttggccatttgtatacttttgaggcttgtctattcatgtgcttagctcactttttgatggtattgtttctttcttgctgatttgtttgagttccttgtaggttctggatattagtcctttgtcagatgtatagattgtgaagattttctcccactgtgtgggctgtttactctgctgactgttccttttgctgtgcaaaagatctttagtttaattatgtcctagctatttatatttgttcttattgcatttgcttttgggttcttgttcatgaaatccttgcctaagccaatgtctagaagggcttttccaatgttatcttctagaatttttatagtttcaggtcttagatttaagttcttaatccatgttgagttgatttttgtataaggtgagagatgaggatccagtttcattctcctacatgtggctagccaattatcccagcaccgtttgttgaaaagggtgtcctttccccactttatgtttgtgttggctttgtcgaagatcagctggctgtaattatttgggtttatttctgggttctctattctgttccattggtctatgtgcctatttttataccagtactatgctgttttggtgattatggctttatagtatagtttgaaatcaggtagtgtgatgcctccagatttgttctttttgcttagtcttgctttggctatgcaagctcttttttgtttttgtatgaatttttctaattctgtgaagaatgatggtggtattttgatggggattgtgttggatttgtagattgtttttagcagtatggtcattttcacaatattgattctacccatccatgagcatgagatgtgtttccatttgtttgtgtcatctatgatttctttcagcagtgttttgtagttttccttgcagaggtctttcacctccttggttaggtatattcctaagtttttttttttttcagctattgtaaaaggggttgacttcttgatttgactctccgcttggttgctgttggtgtatagaagagctactgatttgtgtacattaatcttgtttctagaaacttagctgaattctgttatcagttctaggagctttctggaggagtctttagggttttcgaggtaaacaatcatattgtcagcaaacagtgagagtttgacttcctctttactgatttgaatgcccttttactgatttgaatgccctttacttctttctcttgtcttgctctggctaggacttccagtagtatgttgaagaggagtggtgacagtgggcatccttttcttgtttcagttctcagagggagtgatatcagcttttccccattcagtattatgttggctgtgggtttcttttttttttttttattggtgcaaattactgtttattaagcattatttattccttatgcaaaacaaatgtgcactagcctttggcattaactaaacactctctacatatttctttttttattattattatactttaagttttagggtacatgcgcacaatgtgcaggttagttacatatgtatacatgtgccatgctggtgtgctgcacccattaactcgtcatctagcattaggcatatctcccaatgctatccctcccccctccccccaccccacaacagtccccagagtgtgatgttccccttcctgtgtccatgtgttctcattgttcaattcccacctatgagtgagaagatgtggtgtttggttttttgttcttgcaatagtttactgagaatgatgatttccaatttcatccatgtccctacaaaggacatgaactcatcattttttatggctgcatagtattccatggtgtatatgggccacattttcttaatccagtctatcattgttggacatttgggttggttccaagtctttgctattgtgaataatgctgcaataaacatacgtgtgcatgtgtctttaaagcagcatgatttatagtcctttgggtatatacgcagtaatgggatggctgggtgaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgattgccattctaactggtgtgagatggtatctcactgtggttttgatttgcatttctctgatggccagtgatggtgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttctcagcaccatttattaaatagggaatcctttccccattgcttgtttttctcaggtttgtcaaagatcagatagttgtagatatgcggcgttattcctgagggctctgttctgttccattgatctatatctctgttttggtaccagtaccatgctgttttggttactgtagccttgtagtatagtttgaagtcaggtagtgtgatgcctccggctttgttcttttggctgaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgttcgtatcctcttttatttccttgagcagcagtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtaatttttgtacattgattttgtatcctgagactttgctgaagttgcttatcagcttaaggagattttgggctgagacaatggggttttctagatatacaatgatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgttctgctggattcggtttgccagtattttattgaggatttttgcatcaatgttcatcaaggatattggtctaaaattctcttttttggttgtgtctctgcctggctttggtatcaggatgatgctggcctcaaaaaataagttagggaggattccctttttttctattgattggaatagtttcagaaggaatggtaccagttcctccttctacctctggtagaattcagctgcgaatccatctggtcctggactctttttggttggtaagctattgattattgccacaatttcagatcctgttattggtctattcagagattcagcttcttcctggtttagtcttgggagagtgtatgtgtcgaggaatttatccatttcttctagattttctagtttatttgcatagaggtgtttgtagtattctctgatggtagtttgtatttctgtgggatcagtggtgatattccctttatcattttttattgcatctatttgattcttctctctttttttctttatttgtcttgctagcggtctatcaattttgttgatcctttcaaaaaaccagctcctggattcactgattttttgaagggtttcttgtgtctctatttccttcagttctgctctgattttagttatttcttgccttctgctagcttttgaatgtgtttgctcttgcttttctggttcttttaattgtgatgttagggtgtcaattttagatcttttctgctttctcttgtgggcatttagtgctataaatttccctctacacactgctttgaatgcatcccagagattctggtatgttgtgtctttgttcttgttggtttcaaagaacatctttatttctgccttcatttcattatgtacccagtagtcattcaggagcaggttattcagtttccatgtagttgagcggttttgagtgagattcttaatcctgggttctagtttgattgcactgtggtctgagagatagtttgttataatttctgttcttttacatttgctgaggagagctttacttccaagtatgtggtctattttggaataggtgtggtgtggtgctgaaaaaaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcaggtgagataggtttcctgaatacagcacactgatgggtcttgactctttatccaatttgccagtctgtgtcttttaattggagcatttagtccatttacatttaaagttaatattgttacatgtgaatttgatcctgtcattatgatgttagctggttattttgctcgttagttgatgcagtttcttcctagtctcgatggcctttacattttggcatgattttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagagtttctgccgaaagatccactgttagtctgatgggcttccctttgagggtaacctgacctttctctctggctgcccttaacattttttccttcatttcaactttggtgaatctgacaattatgtgtcttggagttgctcttcttgaggaatatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggttttttcacatagtcccatatttcttggaggctttgctcatttctttttattcttttttctctaaacttcccttctcgcttcatttcattcatttcatcttccatcgctgataccctttcttccagttgatcgcaccggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagttattctctgtccagctttgttccgttgctggtgaggaactgcgttcctttggaggaggagaggcgctctgctttttagagtttccagtttttctgctctgttttttccccatctttgtggttttatctacgtttggtctttgatgatggtgatgtacagatgggtttttggtgtggatgtcctttctgtttgttagttttccttgtaacagacaggaccctcagctgcaggtctgttggagtactgggccctgtgaggtgtcagtctgcccctgctggggggtgcctcccagttaggctgctcgggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttggttacctaatcaagcctgggcaatggcaggcgcccctcccccagcctcgctgccgccttgcagtttgatctcagactgctgtgctagcaatcagcgagactccgtgggcgtaggaccctccgagccaggtaagggatgtaatctcctggtgcgccgttttttaagcctgtcggaaaagcgcagtattcgggtgggagtgacccgattttccaggtgccgtctgtcacccctttctttgactaggaaagggaactccctgaccccttgagcttcccgagtgaggcaatgcctcgtcctgcttcggctcgcgcacggtgcgcgcacccactgacctgcgcccactgtctggcactccctagtgagatgaacccggtacctcagatggaaatgcagaaatcacccgtcttctgcgtcgctcaacgctgggagctgtagaccggagctgttcctattcggctatcttggctcctccccctggctgtgggtttcttatagatggcttttattacattgaggtatgtcccttgtatgccgattttgctgagttttaatcataaagcgatgctggattttgtcaaatgcttttactgcatctattgagatgaccatgtgatttttgtttttaattctgtttatgtggtgtatcacatttattgacatatcacatttattggtatatgttaaactatccttgcatccctggtatgaaacccccttgattatggtgaattatctttttgatatgttgttggattcagttagctagtattttgttaaggattttagcatctatgttcatgagggatatcagtctgtagttttcttttttggttatgtcctttcctggttgtagtattagggtgattctggcttcatagaatgaattagggagggttccctctttgtcatgtggaatagtgtcaaaagggttggtaccaattcttctttgaatgtctggtggaattctgctgtggatccatctggtcctagacttttgttgttgttgttgttggtaatttaaaaattaccattttaatctcgctgcttgttattggtttgttcagggtatctaattcttcctgatttaagctaggagggttgtatttttccaggaatttatccatctcttctaggttttttagtttaaatgcaaaggtgttcatagtagccttgaatgatcttttgtatttttgtgatgtctgttgtaatatctcctgttttgtttcttattgagtttatttggattttctctcttcttttcttggttaatcttgctaacagcatatcaattttattcatattttcaaagaaccagctttgtgtttcatttatcttttttatttttttgtttcaatttcatttagttctgctctgatcttggttatttccttttgtctgctgggttttgtttgttcttgtttctctagttccttgaggtatgaccttagaatgtcagtttgtgctctttcagtctttttgatgtaggcatttaaggctatgaactttccccttagcccctcctttgctgtatcccagaggttttgataggttgtgtcactattattcagtttgaagaacttttaaatttccatcttgatttcatttttgactcaatgatcatttaggagcaggttatataatttccatgtatttgcatggttctgaaggttcctttggaatggatttccagttttattccactgtggtctgagagagtgcttgatataatttcaattttcttaaatttattgaggctcattttgtggcctattgtatggtctgtcttggagaaagttccatgcactactgaatagaatgtgtattctgcagttgttggttggaatgttctgtatatatctgttaagtccatttgttacaaggtatagtttaaatccattgtttctttgttgactttctttcttgatgacctgtctagtgctgtcagtggagtattgaagtcccccactattattgtgttgccgtctatctcatttcttacgttattagtaattattttataaatttgggagctccagtgttaggagcatatatgtttaggattgtgatgttttcctgttggacacggccttttaccattgtataatgtctctgtcttttttaactgccgttgctttaaagttggttttgtctgatataagatagctacccctgcttacttttggtgttcatttgcatgaaatatctttttctacccctttactttaaatgtatgcgagtccttatatgttagatgagtctcccgaaggcagcagatggttggttggtgatcttatccattctgctgttttgtatttttttaagtggagcatttagaccatttacattcagtgttaatattgagatgtgaagtaccattccattcctcatgctatttgttgcccatgtgccttggtttttttgtttttgcttttcaaattgtatttttgttttataggtcctgtgagctttatgctttaaagaggttccattttgatgtgtttccaggatttgattcaagatttagagctccttttagcagttcttgtagtggtgacttggtagtggtgaattttctcagcatttgtttgtatccttctttcatatatgaygcttatttttgctggatacagaattcttggctgataattgttttgatggaggaggctgaagatatggccccagtcctttctagcttgtagggtatctgctgttaatcctgataggttttcctttataggatacctggtatttttgtctcatgtttttctttataggttacctggtgatgtttttgcaatgaatttcccaggtgttctttgagcttcttgtatttggatgtctaggtttctagcaaggccagggaagttttccttgattattcccccaaatatgttttccaaacttttagatttctcttcttcctcaggaacaccaattattcttagatttggtcgtttaacataatcccagccttcttggaggctttgttcatattttcttattctttttcctttgtctttgttggattgggttaagtcaaagaccttgtcttcgagctctgaatttctttcttctacttgttcaattctattgctgagactttccagagcattttgcattactrgaagtatgtccaatgtttcctgatgttttaactgttttttctttattctatctatttccttgaatatttctcccttcacttcttgtattgatttttggatttccttgcattgggcttcacctttctctggtgcctccctaattagcttaataactaacctcctgaattctttttcaggttaatcagggatttttttcttggtttggatccattgctggtgagctagtgtgattttttggggagtgtcaaagagccttgttttgtcatattaattaccagagttggttttctggttccttctcatttgggtaggttattattaagtcttagtagttttggtgagcctgggcccttggactgtgaacttcacaagtgcttcttagtctatcccttccctccccttaggtggaacagctagagtggctagagctgggtatccccctacccttaggtcagttaggctgtgagaaaaacctaagtaatttaagctctggtaaattagtttctcctgagggcaggccttgttaagaaaactagaatgttttggtatatttaaaaattacttttctcctaccccttttggaaggatgaagagatttttctccaatatttactgtaagaacttggttgagctcctggaggtaaaactcacaaaagtgtgttgtgttttgggtgccgcggtggggggtggcgcttgataactgggccccactggagtttttcatctctcagacttgtccacactgagcctccagcaatttgtcaattacagttcagggcttccctactcctggcactggttcttgcagaggtttctgcttgtgggtttctgctctgttaagttgtgattgtttctatttgcttgtctgtctctctaattttgggggcagtagtttgccctgtgacttcacttctccaaaagacctaataagagttgctgaatttttttttttttttttttttttttttgagatggagtctcacattgttgcctgggctggagtgcagtggcacgatctcggctcccgggttcacgtggttctcctgcctcagcctcccaggtagccgggattacaggtgcccaccaccatgcccagataattttttatatttttagtagagacggggttttaccatgttggccagactggtctcaaactcctgacctcatgatccgcctgcctcaacctcccaaactgctgggattacaggcgtgagccaccacacccggctgagttgttgattttttagtttgttcagctttttacttgttagaatgaagtgatgactgccgacctccttatgtgccagactagaaactgggagtctcctatttagtcgtccttaaaaattgtaagctggacattgttggtgatgcattgtagcaattctgatttctgttacctgagagtgttgatttttgttttcactggcagctaatcagtagtcagttcccttgaacttataaagccttagttttacactttgttaggacgagtctttcagatttttcccttgatcttaggcagatccctcagtcctgggacacagtctctactcctagcatgaactgtttgtcaaagctcatgtcactgccctgtactggcaatgaagaataatcaaattctattccaaactgtaggcaaagacaacaactattaatctctactgatcaacttgactctcagccacaggtggaaaaccagtaataaaaaagggttgtctaaaggctttgagatctacccattctcctaaatatttcaaattttatttctggccagattggaccagaaggctgaatccttaggtggtatggctttgcccctatagacttccttgtattgagttgcatgttggcatctgccctcatcatatagtaaaggatgtgataagaagtcgtcagtggaaccatcctaatctcagttttatttttcataagaatgccagtgagcattccatcctacagggtcccctgtaggagaaggagccactggaagaatttctctcagattttagtgccagaaaaagctctgcttctcctgagcaactgataagtttctatctcattaatgtttggctgctgctaagctcagaagcaaagtcagtgtttaggaactcttgtaattttgagggctatcttttgctttaattccctttgtttatttaattatgtcatatttatttccatcagacccttaactgctttttctatagcaaagccaaaaaaaaaaaaaaaaaaagtcatcggaatcataaagagccaaggaagctgctatcattccaaacatttttgtccttcctcttctggatggctttcacagccagattcgaatccacgtaagactgtcatcttcaacccaaagtgaaatgactcacctgcctttctacttgattcaccaattggtagtcaagaaatcgattttcaaaaaaatcaaatttactcctaaagggcagaggttaaagatactttaaaaaattatatcctggctggtgtggtggctcacgcctgtaatcccagcactttgggaggccgaagtgggcagatcatgaggttaggagttcgagaccagcctggccaacagaccagcctggccaatatggtgaaacgccatctctactaaaaatacaaaaattagccgagcgtggtggcaggtgcctgtgatcccagctactcaggaggctgaggcaggagaattgcttgaacctgggaggcagaggttgcagtgagctgaagattgtgccattgcactccagcctgggtgacagagcgagactccaacttgaaaaaataattatatcctgattttgtgtcaataaagatacttgaatgaatgttctactggccctgaaggcgagttcaaggagaacttccaaatcattttagtgtggctgcagtggttcctgctgataatcccagcattttgggaggctgggacaggaggattgcttgaggccaggagtttgagaccagcttgaggaacatagcgggaccctgtctctggaaaaaaaaaaaaaaagttgggcgtggtggtgcatgcctgtagccccatctacttgggaggctgaagtgggaggatcacttgagcccaaaaaggctgaagctgcagtgagctaggatcacgctactgcattccagcctgggcaacgaagccagaccctgcctcaaaaaacaaaaacagaaatgaaaaaagcaaaacattttggaccacaggatcatcactggaaggagcaaatagattctcaaggtaatatttctttgacagagagagccatcattggaacatttggttatctggtatgtttgaattaatgtagaatcactcgcagctctcgtctttacaacacagggcaactgtcagggttagcgaggcatttgttgtcattccctctctaggtggagccagggcgtgtgatgggagcayggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacaytgccaaygacaacatctccagcgcagattacactcaggacccttcagtaactccctgctgtaatccctaccaaattgcctgccgctgtcaagccgcataacagaccaatttttattccacraggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggakgccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtaatcccagaactttgggaggctgaggtgggtggatcactaggtcaggagtttgagaccagcctggccaacatggtgaaaccccatcgctactaaaaaatacaaaaattagccgggcatgstggcgctcacctgtaatcccagctactcgggaggctgaggcaggagagaatcgcttgaaccggggaggtggaggctgcagtgagccgagatcgcaccactgcactccagcctgggygatggagcaagactccatctcaaaaaaaaaaaagtcagtttaggctgggcgcagtggctcacacctgtaatcccagcactttaggaggctgaggggggtgatcacctgaggtcaggagtttgagaccagcctggccaacatggtgaaatcctgtctctactaaaaatacaaaatttagctgggcatggtagcatgcctgaaaccccagctacttgggaggctgaggcactagaatcacttgaacctaggaggtggaggttgcagtgagtggagatcacgccaacacattctagcctgagggacagagtgagactctatcatctcaaaaaaaaaaaaaaaaaaaaaaagggaaggtcagtttatacccttgggcctgatttcctgactcttgctcacaagattgggactagtctcacaaaatacagagacttgtacaggttggcttgttcctgaaacaaaagcttctcatcctcccgaatgtagcagctttctaaggcaccagaaatgatcaagtctcttttctttcactgctctcagagcaaaagtaaatcccaaggaggcaagcgtgatcctacgcagggaagtgtcagtatgtgttctgaaaagatcactagtgatgacccgcgttcttaaggcagcggctcacagagctcctgtagcagactactcaggcaagcctatgtttgttcgtcactacaagagaggcgattttaaccaagctgagactccaagagccttttgtggtcctagaagattttaaggaatgtgagtaaagatgtgaattctgcacagagatttgcaataggcatgacaattcagaataaggagacagagaggaagttccctagcatccctcgctgaacatttctgccaattcaggcatgactgagatgggccatattgatagagcatcccaggagcatgcatgcctctggtccttacatggtgagatggagaagcctgcctgctactgagacagtgccttagtgggagcactgcccctcatcaccatctacctgcaggctggagggcagactgagaggttggtggctgccacgacacagccctgcacacaggggctgcrtgacactcacaagggtctaacacctgttctagggaccttgttcagtgaccactctcactggcaggaagtatttcttgcgtataaataagaattcctgatgcaatttcaaccaactttcactcatttggtccttaggagggagaagaaacaactggctcatgcccagcttcctggcactgaatgggcacacaggcctcaggacaaactttcttactggttcttcaattaagcacctccccttttcctttttaccccaaataaatgatctgcacaaggtacctattattttatacaggttctttggcaaggaactacctcctagatactaatatccacattaccccaattctgtaactataagaggttgcaaggcttactgcgattacaattaagaatctaataatattttatagtagttacagacttttaccaaaattagtgaaacggaacctagtgagtgtctggatgtggtaaaccctgacagagtagaatggtcacatttgtccccacggtgtctgacctagagtgctctggatcctggaagcctcgacttcaggtaaataaccaccgcctcttgagggtgcagaagaacgccctttaaggccagttggggccatgagaacccaaaggtaaaacaactggtttatagttaggcagcatgccaacagaggttttgaagtttataattagtatttttaagaacaactgctctccgccactgagatataaacttcacttgccagccacgtctctgacaacctgcctattgaaagccagaaatgtaaaagctcacgctgcgaccgacccgcagagccgatgtgggaaatcacaaaacaacagccccagccctgcatgcagggccccaccgcagctttgttttctaagccaaatgtgctcactagagggttccacggatctgcgggagaaagaagccagacctgcactccatccttttacaattggaagctcaatggacacaaaacaatgatcaggagaagtttccataacaaagcctaatggacattgtttcagtgcccaagtggcagctcctctctggctctaggagctgatgctccaagtcttggcccaaacactacttccggccgggtgcggcggttcacgcctgtaatcccagcactttgggaggccgagacgagtggatcacttgaggtcaggagtttgagaccagcgtgaccaacatggtgaaaccccgtctctactaaaaatacaaaatattagttgggcatggtggcgcacatctgtaattgcagctactcgggaggctgaggcaggagaattgcttgaacccaggaggcagaggctgcagcgagccgagatcacaccactgcactccagcctgggtgacagagcaagactccgtctcaaaaacaaaacaaaacaaatcagtacttccatctcgaaatgatttcaggttgactatctgggatgttttgactgaagctcacaagagcggtctatatgttactccagatgggagcctgaagaatcagcagttaaggaagccccagcaggctctcaggagggaatcttgtcttcagttccaggtgatggaagaagccacgcccagcactcagccagccccgagggccctagctgtgggaacagcctgagcaggttgctgggaaacccagctaaaggtgctcgggcaagctcctgccctgcacctgctgccctccacagagcacacaattgcttttcttttctttttgagatagagtctcactctttcacctaggctggagtgcagtggcacaatcatagctcactgcagcctcgacctcccaggctcaggtgatcctcccatctcagcgtcccgaatagctgggactacaggcacgtgacaccacacccggctaattttttcttttctttttttttttttttggtggagatggggttttgctgtgttgcccaggctggtctctaactcctgggctcaagcaatcctccagcctcggcctcccaaagtgctgggattacaggtgtgagccaccgcacccggccacttgtttcttaatgagtgtctgcaactgctggggaggtgcgggtctgccggccagagctgcaggtaagtgagggtcaagctggttcacagagtgcagcaactcagctcagagtcctgaacacacagcccagccctctgaaaccatcccctccagcacaaggaaggcagcattctgcaaacgcatccatgggagcctcaggaaaataagttttagacaagtcacgtgttcctaccttccaggcagcaaagtcagtgctacagaagcaaagtaagggatcgcaggcctctggctggagggaggccaccaagactccctggattagtattcggtgactctaatgccatcagggtttagctcgacacctaaagcctactctgtaggattcgaagcacacagtacaacaaatatcctatggctttccaaatactagagcagagaattagttgttatagattagaaaacagggaaagggactctgcctctcgtatgaggcgaaggtttccttctaagcacacagactgagccgcccagttacgggttcctaatgctcacaggaggaaactcattctcatcatcaagacacactggtcccgtcgcaaactcatgttcaggaataacttctcctcgcagcgccccgccgtcctcagaataacctggaaaccaagaaagagacatgaaacaagcactggggatctgcttttatgccatgacctggcgggtggggagcgggggctcaaataaagggcaaaggaagcaaaggggctgtctgtcttccccctggaggtactgtgcctaggacaagtcataatcctcaccatctgccatctttaagcctgacctgcctttccacttcagatgcctgaggcatcctacctctttgaatttttctttgttgaggtagggtctcagtatgttgcccaggctggtctcgaactcctgagcctaagggatccttctgcctcaatttaacttcctgagtggctaggactacaggctctttggaaattttagtttagtttttattttttgaaacagagtctcactctttcacccaggctggagtgcagtggtatgatctcagctcactgcaatctccgcctctctggttcaagcaattctcctgcctcagcctccggagtagctgggattgcaagtgtgtgccaacatgcccagctaatttttctattttttaagtagagatggggtttcaccatgttggctaggctggtctcaaacccctggcctccagtgatccgctggcctcagcctcccaaagtgctgggattacaggcgtgagccaatgtgcctggcctcattggaatttttgaagaggcaaagggttaacaccacttgttaggaaaaagaccgtatcgtgtgatgccttgccaggttgagggtcccaggtttaaaggctattaccatggcctcacctgtgagaaaataaaaaattcaaggagagcactccacccccaggtaacagtgaagggggaaggggagggagggcactccacccccaggtaacagtgaagggggaaggggagggagcgtgcagggagaaggggagggaggtcactgttggagatgctcccctgttggccccgtgtccacccacctggcaccgtggaggctgaagatgcacttggtctggctacggtcgctgcataagactgaggtaaggaaggtctgaggtcattttctttattctcttctgttgttcctgagccaagcaagctacttgtgacaatcaagaggaggtgaaagaaaaaagaaatcatcatatatctaggacaccttccaaaggaaaagcatgaagaagcctgtgctcagctctgtgggttatttatttatttttgaggcagggtcttgctctattgcccaggctggagtgcagtggcgcaatctcggctcactgcaacctccgcctcctgggttcaagcgattctcctgcctcagcctcccgagtagctgcgactacaggcacccaccacagcgcctggctaatttttgtatttttagtagagactgggtttcaccatgttggccaggctggtctcgaactcctgacctcaggtgatccgcccgccaactctgtgggtttaaattgtagacctacccacacgctgctgggccaggatgagctgaagtgacctgcaactgccaggggcagtcacacaccgtcaaaatggcctctttctcttacattggctagacaaagattagtcctctgctcttcccagtacacacaggtgaggacatgctagcaaggagagcagccatcggtggggggcggtggcagctctggtgccctggccacagcaggagagctcagtctgtgcctgttcacagaaggcatgagtgcttttcttttgttttcttttcttttttgagacagggtctcactctgttgcccaggctgcagtgcagtggtgtgaccacagcttactgcagtcttgaccttcctgggctcaggtgatccccccacctctgcctcccaagtagctgggactacaaggcatgtgccaccatgcctggctaatttttatattttttctttttgtaaggatggggtttcaccatgtttctcaggctggtctcaaactcctgagctcaagccatccgccctccttggcctcccaaagtattgggattacaggcgtgagtcaacatgactggtagagcacttttcaattccatgcagggaataggtttttttttttttttattttgagacagggtctcactctgttgtccaggctggagtgcaatggtgtgatcatggctcactgcctcaacctctccaggctcaggtgattctcccacctcagcctcctgagtagctgggactacaggtgtgtgccaccacaaccggctaatttttgtatttgtttttggtatagatggggtttcaccatgttgcccaggctggtcttgaacacctggactcaagccatccacccgcttcggcctcccaaagtgccgggattacaggtgtgagccgccacacctggtggcagggaatatttttgaacacccactgtgagctcagggctgtgttaggagcataggctgagggggagaccatcttgtgtgttattaatcctggcacttttccagatgattaccacatgctgagggcacctgacacagagcccggtgcagagcacttgcccactagaggtttgccactgagactgccagtgaagaacaaatcaatgcaagggcactgaagcttgtcgttcttggcgaagggacaactctacacgaccagctctcgaaaggctgtcttttgaaaagcagtctcttcacctgtgggttttgattaagacacactctcctccatcctgaggatccaaattgtacatataaaggtgtccactggatgacgcaactagcagccgtggcaacttctggatcctaagggccaaggaaaacataaaccgtgatgacaacgaagatgggcgatggattcgcttccaatgacaaagcccccctcaccctagctgtcaccagattctgcctttgacaaacccttagcccactgatctggtctgggcttctggctattcctttgcattctggccttgggatctactttcaggattatttcttgtctttgaacgtgacagtgtggatgaggcaagtgagtgtagatgctgcgaccctgcgagaagcaatagctagtgaacacattagctccctacatgggacgcagtctccctctgacatgtgtctctgcccttaaccaagacagaaagggggtaaatggaggattggcttactgtctttgctggttagttttgtgaaattttaaaaatgttcaacttttgaataaactcctttaaacttcttaaaacatctgtcagccccataggagtccgaacctagaaaacagatctggaggctttttacataattacataaaaataagaattgtttttaagacagtgtcattataaccagaaggctaaaattcccatgccaacttctggctgccccctgagaatccgtattgaagtcagataggaaaagcaggggtttgattccgctcacccttcctttggggcaagttttctttttcttttttgagatggagtcttgctctgtcgcccaggctggagtgcagtggcatgatctcggctcactgcaacctccgcctcctgggttcaagcgattctcctgccccaacctcccaagtagctgggactacaggcacacaccaccatacccggctaatttttgtatttttagta

SEQ ID NO: 10882 - DNA, 76053 bp, Homo sapiens
  misc_feature (1)...(76053): n = A,T,C or G, or insertion/deletion polymorphism (see Tables 1-2)
gctcctccttttatgaatgggattaaggcccttataaggaggcttcacaaagcatttggttctcttgtccttccagcttttctaccatgggaagatgcagtgtttttcccctacaaggattcagcatcaaggcttcatcttggaagcagagattggaccttcaccagaaaatggaacacggcggcaccttgatcttgaacttcccagcctccagaactgagagaaaataaattttatatcatagcagcacaaacaaagacaggctccttcagcagcttcacagaaccttggatgcctcctggcccaggagccagtggggacacctggccattcctgggaggtggagaaaggatgcatggaggaagagaggcatccacctggctcagagaacactaagcagcaaaatattgaaagagttgtagtgcttctcttaactgcttctattaaaatgcaagaggagagaaatgacttaaagataaaatttataattaaaagagaagcagaatgtaaagatttggaaaattcacagcctgggcatataaagatttaaaaaatgtgttggggagaaaaccgagagtggccaaatgactgttgatatggagattactatggatacaaggaagccaggtgatattcatcaagacaatgggagagtgaccccaaaggcaattcagagatctttgaggctgccatgcccatttcaggcccagagtgccagggccttgagagaagagtagttttgcatggctcaggggttcatggaaccttggggctcactgcccagggctgccttgggtctctgcattccgcattttggggtagcacgcctcagctttcccagctgtagctcaagcaggcccaggtgtggctcaggccaccatcttggaaggcatagccatacacaccttggctgcatccaggtggtgctaattctgcaggcttgcagagtgcaagagctgtggaagcattattggcctccacctagaattcaaaggatatctcagacactgttggggcccaagcagagacttgctctgggggcagggacactgcagagaatccccactagagcaggccttagtgaagccatgggggtagggtctctgccccagagaccccagacctatagaaatgccagcatgcaatgccaacctgtgagagccacaggtacccaacaccaacctgtgacagctgctccatgggctgtgcccagcaaagctgcaggggtggggtaccttggggccttggggaccttaacctctgccccagtgtgttcagaaggcaggacatgaagtaagggaaggttgttcttaggcctcaagatttggtggtgtttgccttgtcgagttttggagttgcttggaatctgtcactcctttctgcttccctatttctctcttttgaaatgggaatgttcatcccatgcctaaatacaccattgtacttttaaagcccttagcttgtttgatttcttagattcaaagctggagggaatttgtctcaggatgaatcatacactgactcttacccatatctgatttaaatgagactctgaattttagacttttgagctgatactggaataagttaagactttcggggctactgggaaggaagacatgtattttgtatgtgagaaggatatgaattttgggggccacagcagaatgctgtggttcgaatgtgtcccttccaaaattcaggtgttggcaatgtgatggtattaagaggtggggcctttaagaggcaattaggccatcaagatgcctccctcattaatgggagtaaagcccttataaaagaggcttcataaagcattctgctcacttgctctttcactctctcttgcccttcagctttctgccatgtgaggacgctaccagaaggccctcatcagaaactcaaacctgcaagagccttgatcttggacttcccagcccccagaagtatgagaaaataaatttccatttttataaattacccggtctcaggtactttgttgtagtggcacaaaacagactaagacatatcaatagaaagaagaatatgagtgtgtgtgggtgctaagcagcgaaggagttggatttaatggacattgcatttgtcttgttttcatatttctctatataggtaccttcctttgaggattgctacagtgtttttcaagtaattatggtggagctgtcatttacaccctgcgtttagccaaaccactggttgggcatgtgactaagtcaattagaatctttctcacaggaatttatttacctatttatttttgagatggagtctcactctgtcacccaggctggaatgcagtgttacaatcttggctcactgcaatctctgtctcctgagtccaagtgattctcctccctcagcctcctgagtagctgggactacaggcatgggacaccatgcctggctaatttttgtgtttttagtagagacgaggtttcaccatgttgaccaggctggtctcaaactccacaccgcaggtgatccgcctgtctcgacctcccaaagtgctggcattacaggtgtgaatcactgtgcccaaccctcccaggaatttaattgttatagtggcagtgaatgcaattgaagttgaattatcacaagaacagttccctgtaatccacagaacaatcatgagatgtgggaggttctaatggcagttaaaattcgatttttctgcataaaagagaatatccagataaatgtcttgaaaaggtttctcacctggaagagatgtctagatgcaggtggttcaagactgatatgacccctttacaacatcattctgccttcccatccttagtatgtgggtctgactttcaggttccaagtgtgaaagaaaataaaatcttgggaccccaaactcactatgccaaaggagatttgagcttggcaactgagttggggcaatactgcctaccattttgtttccaaacagatggttgtaatttcacaattccatgccagagccttatatataagtcagattcccacaataatagaaggccatacaccttcccagatggcctccctcacaaattacaaagaaattccctgcaagcccctaaatacatttctccctataaaccagccctaaaatctgttaaatctcacagtgactggtatgagatggtttctcattgttttgatttgcatttttttgatgattcgtggtgttgagcattttttcatacgtatgttggccgcttgtatgtgttcctttgagaagtgtctgttaatgtcgttttccatcagtcagaatggcaattagtaaaaagtcaaaaaacaacagatgttggcgaggcttcagagaaaagggaatgcttatacgttgttggtggaaatacaaactagttcagccactgtggaaagcagtttggagatttctcaaataacttaaaacagagctaccattcaacccagcaatcccactacctggtatatacccaaatgaaaataattcattctatcaaatagacacatatacccatatgttcatcacagcactattcactatagcaagggcgtggaatcaatcaaagtgcctgtcaacagtggattggatttaaaaaatgtggtacaggctgttctgcctatggagtacattttttttttattccttcactttcttaataaacttgcttcctttttttttctttttttttttctttttcaagacagagtctccctctgttgcccaagctggagtgcagtggtatgatctcagctcactgcagtctctgcctcccaggttcaagtgattctcctgcctcagcctcctgagtagctggaattacaggtgtgcaccaccatgcccggctaatttttgtatttttagtagagacggggttgcaccatgttgccctggatggtctcaaactgttgacctgaggtgatctgcccaccttggcctcccaaagttttgggattacaggtttgagccacctcacctggcctattattctttaaaccatgtatataaaaccaaggttaggtatctgaaatgggaatatgaggcaaaataattaatatgtattgaatcagacaacacatgtgatttctgcccttctttatttatcgccttcatactaaaggacattagccaggtaatatcaataactattttgaaatgagagaaacagaaacaatcatttgaaataaattcagctacaatgcttttgtttatttactgtacaaaatgattaatgttcaccagtattattatttcattctttaggatcatttctgtcttcaaaaagcaaatatttatttgaggacttactaaatgctcaaaatgctggaatacttgaggttcttatagtctgaccgacgagagagataccttaatcattaaaaatatgtataccattatacaattggtaaaagtggtttgtgcatagatcaagaatgcatcatggctgctaagtcatgccaaagtcaattgattcttcttattccaattctacacctgtagggtaatatactgacagtggggatgggaaatacatgtaactcaaatggtatgtcaacaaataatattaattaagcaatcatctctctctctctctcacacacacacacagacagctaccgagtttgcaaaaaccggattttgcagagcaatggtcctatctatctcatattgtctgaaattcctttctttttttttctttctttctttttcttttcttttcttttttcttttttttttttttgaaacggagcctcgctctctcgcccaggctggagtgcagtggcgcgatctcggctcactgcaagctccgcctcccaggttcacgccattctcctgcctcagcctcccgagtagctgggactacaggtgcccaccaccatgcccggctaattttttgtatttttaatagagacggcgtttcaccgtgttagccatgatggtctcgatttcctgacctcgtgatacacccgcctcggactcccaaagtgctgggattacaggcgtcagccactgcgctcggcctattgtctgaaatttctatctagaaatctttccccatagtacttagaggatttttatagagatcttgaattttctttcaaaataattttaaaattagaccaatttaaaatcccatcatggtcatcttggccttatggcttcaaataaaactaaagcaaggaattcaacataaatacatatttagctgttgctatgtttgaagccttgtgctaaagtatggtacaaagttgattctgtcagggagaagcacaaggaaaggcacttttacaacggcatgttggtccagtaaaagttctgcagctactcctctctaatttaaaaacatatatatatatattatatatatatatatatatagctgcattagacacttaggttttgcaaaagatgccttcatttctcatgatggtatatacatacgttctggattacttgttacttaaaaatactgacttttgtcccacgtgttccaattttaggttacataaatgagcacactactccggacccacatctcctgtaattcagtgcctaactttctaccaacaaagatccgtgcctttcatcctgaagtgggcataacggaaagagacgcagaaacctacgtgggtttaaatcctagagggctttggtgaaaagtccctaatctcggttttccacgtcactcaaatgcagggccacattagatagccttttcaaggtccttcgcatctgcagacttctgcgattaaaacgcatctctttttggaagataattcacctgaagctcctctgggaaattagcttgctgagggccagaccaacaaccgggtaggagcgaatctggtttctctttgaaaagccttcctagggttagcatccagggccagcaacggagcgcgcccccgaaccacgtgtctgcgccagctgccggattggctgagcgcattttagcgctgcggtctagacgctcgcggtcccgcccagttgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggtgagccgagaccggggatgcgccaggcgcccacaggaggtggctgacggggcatcccgatacccgcgaagccggccctcctgcctctccaggctgcgagccgagcctctgcagatccagctggagtagccgccgctgcccccactgcctgtttgccttccaaggaagggcgccgaggttcccctggaacccgcgtctctcggcttttgtctgctggttcggctgcccggcggtgccatgcgcctgggacttgaggcgccgcgcaaggctgggggccctgcccgggatgggggagggagggaacgggaaagcatgcccccttctttcctgttccggccatcttgtgaccgagatccacgcaaggggaaaggggtggtcagcggcacgacgccccacgatggagtgtggcggccaacggagatgggtacctcgggcccgcaggcctctgcgcccagatctcagcgggggcgcgcgggccacccccacgttcagctytgaagcccttggcccagatcatgggttaatcgttctaacaggccagaggcagcaaaaataggagggataaagggccaggagctgatgtttccttaactaagcgcctaagtcattcgatcgttcttcattcacgtgtccattcagcaaattctgaacgccttctccgtgcctgtcctctgctaggttctagggacgtatacttgagcaagagagaccacagctcttgttcccgctgatcctgcagcccagtggatggagtccagaatctacagacctgccaggtcggtgtcttgatgctcttaaacagatggaggaagctaagtcttagagctgacaatttgttctagatcagggagcaagtaagtgacagaatcaaactttgaaactatttatgtctttagcactttttatgcctggttgcagggaataaaggccaattaayttggacatatggtttatttgaaaccatatgaagtgcgtgttttatttcctggatgtttttgcwtgggtttatttctagttaacaatatcttgaaagtgctaaatatatttgatattacaactttgcttccagttactctgaattgtattttcctttcttctgttcacatatttggatgttaggaaagaaaaaaaaattcctgatgtctggtccaagcaggaattccccrgtggattggggaatgtctggcttttcctcagcttattgatctctgtggtaaccactggaggcccccagaagacccayagaaatgagaggcctgaggtctacaagtcgctgctagaaatattttagcctctccaaagcccagaaygcagccccgacccaagtttgtaaggtaaataccatggccctgtaaaacttgttggtaaagctgatggctaaaatccccctccatctgtttctaccttcagcattttgagtatgtatccttttggaaagacaggtgaagtattacatattttggggagttctttggttcgtacttttatcaaaatgttatatttaggctgctaacctacaaaggaagaaagactccatttaaaaagcaacttgggtgtcagaaatctagaaagcctgccatcaaatatgattaactgcaaatttcatttaaaaaacaactttattgagatataataaaaatgtacccttaactttaaggacacaattcggtgaatttggccaagtgtatattgctgggtaatcaacaccacaatcaaaatgaaaaacatttctgttatgccaaaagcttcctcatgcccttttgcagcgagtccccctctatcacatttaattatatatattttattgcttaatgttttctaaatcgtgtgtaaaagatgaggatgaatagatactactttttttttctttttctattaatgatggaatgaatagatatttctaatttcaaagcctaaggccagggctacagtgaataaataaccaggggatggcagttaagaccaaaggttcccagggatgtggctccccacgcctgccttagggacatggagtgtccagccccaaacgccagggagggtggcgccctggggagccggtacccaggaggtaccctcttcgggtgaacggctgtgtccactcgggctcgtccaagaggtcttctctggtcccgcagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatggtaagaggcgggaggccggggcgcccccgacggggatgccgggctggggagaaccggggcttccccggacccccagctccccagcctgcccgccccccatccccgcctcccgccgcgctctctttgtgccccccgcagcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagaygctcaaggaagagtgcaaacgccggaagaagatgatctccacccagcagctgatgatcgaggccaaagccaactattaccaggtgggcagctgtgtgtgagcacgatkcataatccagtaaacaactcagttcccatttgataggcctgtcccgtatcaccactctttcttcttaaagatttatattgtatatcagaagacacagtatatttaagcaaaaacagtcatttaaccaacaaatgtcatggttcattaccttctgcagacaatcaggggattaataattaaacaacaaatgtcgtctgtggtgctttatggaagttatctaaatgctggttgttgaaacactttcctcctccgaatcaacctcaacatgaaaaaaccatatacaaattgctgttgaagccagtccccaaacgatgcagaatgtttaaatttgtagggtctttttctcatttttataaattttgaaatactttcaaactgacagaaaagttgccaggagactgtaaggaattttcatgcgcccttcacccagattcccccattattaacattttccacagtccctctatttctgtatacatattattattacttttgaaccatttcacagtgagttgcagatcctaaatatttcgatgtgtatattttctaagaacaagaacattcacttacataacagtatttaaagaataaaatatttttatcttctggtcttaatcttctactgttttgggttagacattgagtccaagataaatattgcaatttttgagtataacataaaccaatgtattttttttttattgactagttggaggaagtgcagaaggtataaacaatgattgagaaagatattgaagtaagcaacagattaacaagattgatgtcatgcccttactttctagtcctttcggctgactatggcttaaaaggcctcactggatttaggaatagtggagctgatgcatgaatgctggagagaactgggtgcagggcagagaaaatggtgcagttaatattgctcaggactgacccagcaggagtgttgagtgttcttaagataggggaacagtggccgggtgcagtggctcacacctgtaatcccagcactttgggaggccgaggcgggcggatcacgaggtcaggagattgagacccgagaccatcctggctaacatggtgaaaccccgtgtctactaaaaataccaaaattcgctgggcttggtggcatgtgcctgtagtcccagctacttgggaggctgaggcaggagaatcgcttaaacccaggaggcggaggttgcagtgagccaagatagcgccactgcactccagcctggcaacagagtgagaatctatctcaaaaaaaaaaaaataaataaaaataaaaaagataagggaacaattaggaatattattagaaggacttagtgtttggtcttgggtagacaaccctgaggtataatcttcaaatgacactgggcattgctaattgcttatttgttttataaatgctgcttaaaaattaaatatttacaaatagtgctaagatggtttttttcttgtgcaacgaatataatggattctatttaaacatttttaaagatttattatagtccagctttagcagccatctagtgaaatgttaaaacctctaacatacagaaattgtatgtttataaacttttttttccttttttggggttactatagaaatggctgttataagagaagattttctttctttctctttctctctctctctctttttttttttttttttgagatggagtctcactctgtcgcccaggctggcgtgcaggggtgcggtcttggctcactgcagcctccttctcccgcgttcaagcgattttcccacctcagcttcttgagtagctgggactacaggtgtgcaccaccatgcccagctaatttttgtatttttagtagagacgaggtttcaccgtgttggccaggctggtctcaaactcctgacctcaagtgatccacccacctcagcctcccaaaatgctgggattacagacgtgagccaccacacctggcctaagagaagattttcaaatgtgaatgataagtaatgattaaaaggtaatgactcaatttatcaaatgagtgacacctactactttttcagctaccagaccttggcaagttgctcaacctccctgtgcctcagtttctactctgtgaaatgggaatattaattgtacctaccatatagcagttgttaatggggattgaatgacttagtgcatagactgtgcttagagcagtgcttggcatgtagttagttattgttttagctaatacctgggaatgagggaaaaacgttttgtggcatgacaaatactaaagctgacttactacaaaatgtgaacaatcatatgactgctatcatgtgagtttttctttcttcccctatacagaaaatccaaagcctagactccttgttctgacacaatgattgggtccaccgcattatcagttttacctttgagaaattgtggtctcattctcattctcataccacttctctttgtctctactccctttgctttaagaaatcataagaactgagtagctgagacaaaaaaaaattaaagatgcctgttcttgaaggcttgaasacacagacagacagacacacacacgcacgcaccctaatgggttttttcccccatggggtgtgcgtgtgtgtgtgtgtgtgtgtgtgtgtgtgttgtgtataaggggggtagtgatggcaatgtgtaaggtctttttcctcaatattttatttaaaaaatttaaaatgcagaaaaattaaaacaacaatatagtgaatacccatatatgggggattttaaaagaaaaatctcatcgattttcaaataaaaattagtactgaaatattataaacatacaaaaaagtgcatagactaatgtaagacataccatatacccacctcttagatttaactcaggttaggctgggcgcagtggctcacacctgtaatcccagcactttgggaggccaaggcaggcagatcatctgagatcaggagttcaagagaagcctggccaacatggtataaccccatctctactaaaaatacaaaaattagccaggtgtggtggcgcatacctgtaatcccagctacttgggaggctgaagcaggagaatcacttaaacccaggaggtggaggttgcaatgagctgggatcacgccattgctctccatcctgggtgacaagagcaaaactccatctcaaaaaaaaaaaaaaaaaaaaagattgaactcaggttagcattttgctatatttccaagatagcaaaatgtttaaagagttttaaacatcttagaaataaataattttcccttcctcgattctcagagaaaatctgtttgactatatccttcctatttatgtttatgaacatataaaatatttttatgaacatatgtattcataagacagtgtttttaagtttgaaaattttctataaatgatattatacttatagatctgtactaatctgccaaggctgccataaaaataacacaggttagatggtttaaacaacagaaatgtattttctcacagttctggaggctggaagttgaagatcaaggtgtcaacagggatggttcctggtgaggcctctcttcctggcttgtaaacagccaccttcttgctatgtcctcatcacatggccttttctgtgtttggagagagagagagagagagagagagagagagatcgctaatgtctctctctttttctttttttaaagtgaaggggtcttgctatgtgcccaggctggccttaaactcctaggctcaaatattctttccgcctcagccttgcaagtagctgggactacaggtgtgagccactgtgccacacttaccctatcagattaggccccccgccttatgatcttatttaaccttaattatctcattaaaggcctcatctccaaacacagtcacagttggagtcagggcttctctcccagtttggagagttacactatccaggttggtaacattcacattctcttactcagccataatgtcttacttgtttttttcattggttttatatttatgtgctcattcaaaatcctttcacctcaacatctccattcttgagtttctcattttgaattatctcttaattcataggattgtcaaaatgatttgtcttacccagaaggcccaagagtgctgcatttcttcaactctatcaagtttgaaagacatattggatgaagaatattcttagtcacactttccctctgaactttttgatgtggttcctttgtcttctggcagtaaatgttgctgtgagaagtttgagggtggcctaaagtttttttcttgtgagtgacttgctttttctgcctgcatgactgaagagtcccttctttctgcttgaagcctagtagctttctagggtatgtcttggtgttgagtgttctgtatcagttttccctggaacctggtgaattcttaatctgcagattcagctttcactgcacttcagagaaacactcttgtattcagtctttaaattttgtttcatttttggcttctctacttctgggaaaccagttacctttatgcagtattgattttgtccattagttctccgtactctttggtttctttctcattgctttaattctttccttctaatctacattcactgtgataaattatgtcagcctttcctttagtgagcaattcagttttcaacagtgtctcttttattccttgctttctcttttctttttttctattttttttttttttttttgagtcaaggtcttgttttgtcaccctggccccgagtgcagtggcgcaatcttgtctcactgcaacctccacctcccaggttcaagcgattctccggcctcagcctcccgagtagctgggatcacaggcatgtgctaccacatctggctaatttttgtatttttagtagagacagggtttcgccaagttggccaggctggtctcaaactcctgacctcaggtgatccacccaccttggcctcccaaagtgctgggattacaggcgtgagccactgcacccggccctattccttgctttttcttatttatttgttctgcaatgatgtttcagatcttttttttttttttgtattttatctttctttttaaactcattctggttttttaaaaaatcatatcatttttatagaatgtatgctactcttatgttctgtgatgtgaatagattgtgaagaacatctttagattcctttcttaatttatagatcccctgcagtaagctttatttttgcatgccatgtttttcctcccttttcctccctccctccctcccttccttccttcttcctaccttccctctttccttccctctttccctccctacctccttacctccctacctttttttcccctcctccctttgacagggtggtgtgtttgcatcctctccatcatcactgtgcatttctctcatcttacacttacatgggcagccctgctgaagcattctacttgccctgatagagtggccgtattgcagtttgaaggctggatggtctctgtctctgttaggaacagtatcgttagaacaccttctggcaacatgtgaactctggggtggggtggggagagagggaggcatagcttcctcttcctttcctttctccagtgctgtacacagcccgagagcctatatgacttacatcagagctggtgtgaggggtccctaaagttctataggtgaaccaaagctgtcatgagcccgggaggttgaagagatgctttagggattctctgagatgcaataccaagaaatataccagaatatgactgggcaccgtgggttacacctgtaattccagcactttgggaggccaaggtgggtggatcatttgaggttgagagttcgtgcccagcctggccaacatggtgaaactccatctctactaaaaatacaaaaattagctgggagtggtggcgggcacctgtaatctcagctactcaggaggctgtggcaggagaatcgcttgaacctgggaggttaaagctgcagtgagccatgattacgccactgtactccagcctgggtgacagagggagacacttaaaaaaaaaaaaaaaaaaggaaatatgcagaatgttagttttagaaaccaaagcctgaagtctggatgcagttacactgattaagagtaaggcagcatggtgaacaaaagaacatgttcagtgacacaatgggcatgaaaagagcaaaatccaaatggagggaaactctgcaggacaagcttcagccccttcagcaaaaggatagcaaggaaaaaaaagaggtggaggggaaacctatagactaaaagagtgttaagagacataaccatcagttacaggatagggatagggtcttatttggatccagttattaataattattccaaaacaaaccgaatgttttttctaagacaatatgtgaaatattagggaaaaataatcaaattaataaaaattaaaaattatccaaatagttgaatatttgttttttaaaaaggatttaatttttatattttataaggtggaataatggtattatgatttgtgttaaagtcctgtcttccttttagagatacattctgaaatatttacaaatgaaatatataatatccaggatttacttcagagtaatccaggggtgagtatatagatggaacaaatgggatttttgcttaaaatttcaatcagtgtaaaagtagaaaaacagaggtatacgtggaattgacttcttttttctcagaaaatttattttaataggttatacttccaagcttttgttcattcatatattaagcctgtgttctggggagaaagctagaggccctgccctcagaaatctaaaacctggagggactgggctagagacaataaacaagtgaagtacacaaacgtgaaaatattagccagtgagatgtatgaggatgaaaagaagactacgtgatgtgacagagactgtgacaggcaggaggatcttgaggattttgttgaggacatgctgtcatcctcagcgtggaagatgcttgatgaatgacatcttgaatgtcaggagaaggtgccagccatgggaggagggtctggataagatcaggcaggggcaacaatgaatgcaaagcctctgagattggcatggctgcaggacagaaagaaggctggtgtggctggagtggcaggggcaggttgttgttgatagagtggaagctgtcagtctaacaagagcagcatcaggggctccagaaagcagcagaagggctcctttaactgtcaagaggtagttttcactgccttgtcttcagtttgggaggaatgccctggttttatttttatttatttacttatatttttactttttgtagagatgggctctcgccatgttgcccaggctggtctcgaactcctggctcaagtgaccccccaactgccttcggcctcgtgctgggattacaggcatgagccactgcacccagcctggtttcatgtctcgtctattagtcatgctttcagtatctcttgctaggatggtatcgttcagcgagaaagcgcccaagaggtagtgcttcaggtacctgaattttttttttttttttttttttttgagatggagtctcgctctgttgtccaggctggagtgcagtggtgcaatctcagctcactgcagcatctgcttcctgggttcaagtgattctcttccctcagtctccctagtagctgggactacaggcacatgccactatacctaattttgtatttttttgtggagatggggtttcatcatgttggccaggctggtctcaaactcctaaccttgggtgatctgcctaccttgacctcctaaagtgctgggattacaggcgtgagccacagtgcctggccaggtacctgaattttaattgcaattaagtgggacgacagtcgttacagacacttggatttgttgctctctccttttcagtgccatttttgtgacaaggcctttatgaaccaagcttttctacaaagtcacattcaacgccgccacackgaagaaaattctcattttggtgagtaatgagttctgtttgaaagctcttttcttcctgctccctttttcttttggcaatgagacttggtccagtgcatttcccagtcctcttaaaagaagcatcacggtccctgtcaattcagtaagtaaatatggagccctcaggaggtgcatacagtgcaccaggtgctggagatacagccacaagctgaacggagaagccccactctctctcgagttttacattctaaagggggttgaggagacacatttaaacagataaatgagtaattaaacagacaaatgagtaattcttctcaaatggtggcaaatgcgatgaagatcatagcgcaggacaatggggtagagagtgactccaggtggggtgaaagtctcagaaaagtgtgtcacaggccaaggaacactgactgtaagggacgtgaggtgtgctgggatgatgtgtttgaggaacagaagggctggtggaatggaatagaataggtgaggtgatggtgtgtggtgaggctgaagtgctgggggcctgatcacaggaagccgtgaaggcgtgggctggaatgtggagtttttatatgcgtaaggtggagccactggaggattttaggtaggggaagggcatgatctaattaatgtgtaccttagcatgacccttctagctgtggatagagactactgttggggcgacagtggaagcagtggatgagtgaggggaggaggctgcaatcgcagccgaggtgagagagacgggggcctggaccagctttgtccccaggcaggtgggcaggtgaagttgtaacagataagttgtggacccagaagctacagaggaccctgggtttctgtcctccatgtttgggtgaatggtgatgctttctgtgatggagggccagggtcgggaggcaatttcaaggaggaagagggctgagagtttgtacttgccatgggtgcgtttacatcacatgtgcaacagacatgcaggtgggggtactgaagggctgcagcttaaggtggagacccaggctggagatttaaatctgggaatcactggagtagagctggtctggctgaggtcacctagatagagaatagaaagtgatgaggtcagccccaaggtcttcccaatgctaggagctcagaaagagcagcagcagagagtgaggaatagtctctagcaaagctggagggaaacctggggagtgtgttgtcatggaaaccaagggaaaagtatttcacagaggaggcagtggtcagtcatatcaaatgccgctgaggtacagagtaagatgaagactgacaatggacggctgttgtcaagacggttgttggtgaccttggcacagcagcttcagtagacagatggggacaaaagtctgattcccctgagctgagctgagtatcatgagggagtggtcctactgtatccagacattggtttcaataacacttattgggaaggaaagcagagacatgaggcttcatctggacagaaatgtgagacccagggacaactttgtttcatttgatgtgggagatactaagatgtgtttgggtgtgcaccaccgacaatatagatggtatgcaaaatgaagacgcaagagaggggaggggactctgaggcttaccaaggagccaggttttctgccattgaagtattctcaaaagcaaagaatgtaagggctctttctccatgggcagatcaaagcttcctgcagattgccacagtaacccacagaaattcttatttttatcgttttttgtttttttttttgagatggaatctccccctgtggcccaagctggagtgcagtggtgccatcttggctcactgcaacctccttctcctgggttcaagtgattccgttgcttcagcctcccaagtagctgggactacgggcactcactaccacacctggctagtttttgtatttcttttttttcttagtagggattggggttttgctgtgttgcccaggctggtctcgaactcctggcctcaagtaattcatcccccttggactaccaaagggctaggaatacaggcgtgagccactgtgcccgacctcattctgatcttaaatgttctcagtatctagacgtgggtacttggcttatatactcagtacctgcatttccctccagtttgggccaggttgtttccattcttgcccatttcagttaaatagattacttaggaaatagctaagcttcgtagaaacaaaaataacagcataataatctcattaataagtcttgaatcactgataaaatttagcaatattttggaaagatgaaatattttaattaatctaccattcttcagcgtgaaactgaccttctttctcttctgtttcagtatcttattctaactcatactcgtttcagagagggtttcagactctgaaacgagtattatttcttcaggtcatctttgagattctgactttctactttggtttccatacctttcatgtctacactcacagacacatgtacatccattcagtcatgtgtacatctgcatgtaagtacatgtacataagtattcttcctttcacttgttgcttccttttacaacttttcagtacctcacttctaccccagttgatagactatggcccaagtttgcattttgaatgccccccaagtcctctgcttgtattagcactgatggggtcctcagaagagttcagcgggcacctaaaggatggtgacyacagagatttcagtatggtggtgcctgcagaggaagctgttgcttgccttctgtgattgagacaggcacctctaagaaaagcccagagtgccactgggtcaaagcaccctgtattattccttgttaccattattgctccctgaagagggctctcatgtatctatgtaggataatccaacctcaacacagcggctgaaagaatctgctaaaaaataattcagtgccccaaaatacactgggctccaaataaactaaagagcaaaaattggctcatgtggcatgaaacaagtaatcgtatcccaagtaagaggacagtttccttcgtgttatcaacaggactgtaccccataagtttccaggtacatttggtaagagatggtgttttaacacgattttctgttgcaacagagtatcagaaaaatgcacagattgagaagctccggagtgagatcgtcgtattgaaggaagagctgcagctcaccaggtctgagctagaggctgcacaccatgccagtgcagtcagattctccaaggtaccaggcagaattctgtggtattttaattacaattaactgtatgtaattcaattatgccatggactctaataaacagaggacacttaagagtttgtgaatttgacaagatgattgcattttttattgccaatctactctttagtatcttactacaaagcacatcactggaaatatatttctctattttttgaaagccttttagaaaattggggtggaattcatataacacacaattaactttctaaaattttgcttagaacagaagtctgacacttctcattctcactgggctaaagtcaaggtgtcaggaggaccatgtgccttggtagaggctatagaacagaatatttcttgcttatttggttgctggcagagttcagttcctggcaggtgtagaccagaggtctacactttcttccaggctgtccattgagggagggctgctcctaatttccttgtgaggctccccatactcctgggctcctgaccctcttcctccatactcaaagccaccaacagagggttgagtctccctcatgcttcygatctgtttccttttttcttttttctcatctatgtgacccttrtgtcagcccattgggtgcttggaatgacttgttcagagatactcggggtgatgaagggcccaagaggaaagaggcccatgattcattgagttctgacttctgtgggtcactgtgggtacaccgtgggtaccacgtatgccattgtttatccaacagagggttgaccttggtgtacctaatggagagagtaaggccatcaaagagcatttatttccttgtgactgttggagtgacagtgtgcttggctcttccttgtttcccccatggggacagcaagtgtgactttctagggataacagcagtcatttcacagaatcattgacagaggcttctgtcttccacatgggctcactctttctctttctttttaaattgtaatatacctataatgtaaaatttatgattttaactatttttaagtgtacagttcggtagtgttgagtatattcacattgttatacagccaatctccagaactgttttgtattgaaaaactgaaactctacccattaaacagtgctccactcccccctccttccagctactttccctctctgtgattttgcctgctctagatacctcatatgaatggaagcatagagtatttgtctttttgtcatcattggcttattttactcagcataatgtcctcaaagtttatctatgttgtagtgtgtgccagaatttccttcctttttcaggctgaatgatagttcatggtatatgtatgtataccacattttgcttattcatctgttattggacacttgggttgcttccacttcttaactattatgactgatgctgctatgaacaagggtataccaacatctcttttagacagtcattttacagtgtacaatccagtagcgtttagtgtattcacaatattgtgcaactaccatctctctagtttcaaaactttcaacaccccagaaaaataacccatacccattaaataatcactcctactaccctcatctcctggtaaccacgaatctttttatgtctatgaattttcctattcagtatatatcttttaaaaaaaaatatgtagaccacgtgtggtggctcacaactgtaatcccagtattttgggaggccaagatgggaggattgctcgagcccaggagttcaagaccagtctgcgcaacatggtgagaccctgtctctacaaaaaattaaaaaattagctaagtgtggtggcatgcgcttgtggtcccagctactcaggaggctgaggagggaggaagatggcttgagtccaggaggtcaaggctgcagtgagctgtgttcacaccgctgcaccccatttggctacagaatgagaccccatctgaaaaaaaaaaagtaatgtgtgaccttttgtgtctggcttttttcacttagcatgatgttcttgaggttcatctaagttgtaacatgtatcagtactttgtcggtcttgctaatattccattgtatgtaggtatgcatagacaatttgtttatccagtcatccattgaatgacatttgattcattttcaccttttggctctaatgaataatgctactataaacattcatgtggcagtttctatgtggacatatgttttcatttttcttgattatatacttaggaatggaattgctgagtcatatggtaattttatgtttaactttctcaggaaccaccaaactgtcttccacagtagctgtaccattttacattttcaccagtaatgttcttatttctccacatcctcaccaatacttgttatacttttctgttttcttaattaaagccatcctattgggtgggtgggaagtggtatctcatcggagtttgatttgtatttccttaacaaccaatgatattgaacatctcttcatgtttattttccatttgtatatatcttatttggagaaatgtctattcaaatcctttgcccattttttaattgggttgtttgcctttttcttgttgagctgtatgagttatttatatacactaatagtttcatcactttagctctattaggtcattggtctattttgagttaatttttgcatgtagattgagagaggggcccaactttatacttttgcatgtggtttatccagttgtcccagtgccaatttttcaagagactattcttttttcattgaatgttcctaacatccttgttgaagatcagttgaccatagatgtttgggtttatctctggattctcaattccattcccctagtctgtatgtctgtctttatgccaatatcacacaactttgattactgtagctttgtagtaggctttgaaatagataagtgtgcatcttccaactttgtttttctttttcaatattgttttggttatttgtggcctcttacagttgcatatgaaattgaggattggcttttccatttctgcaaagaaggttattggaatgggattacattgaatctcttgattgcttaggagagtattgccattttaaccatattaaatctaccaatccatgaacatgggatgtctttccatttatttaagtgttcttcaatttttacaacaaaaattttcagtgtacaagtctttttcaccttttaggttacatttatttctaggtattttattctttgggatgctattataaatggaattgttttcttaatttctttcttggattgttcattgctggtatatagaaatatagctgctttttgcatgttgaccttgtactgtgcaactttgctgaatttgtttattactttagtcgtttcttatggattctatkttatttttttaaaatagttggtagaattcaccagtaaagccatctggtctgggacttttcctttttaggaggttgttgattactaactctatccctttatttattgaaagtctattgaaatttcctttgtattgggtcagtctggtcatttgtgtaggaatttgtctatttcacctagattatccaatttgttgctgtacaattgttcattatattctcttacaatccttttaatttctccaagattggtagtcatgtcctcactttcatttcttatttggggtggctgaaggtttgtcagttttgttgatctttgtaaagaaccaaattttggcttcatctattctctctgttgctttcctgttctttgctttatctttgctctaattttcataatttttttctttctgctgcctttgagtttggtttgttcatctttttctagctaggttatttatttaagatttttcttcttcttctatatttgttttttggagatagactctctctctgttgcccaggctggagtgcagtggcacaatcacagctcactgcagccttgacctcccaggtccaagtggtcctcccacctcagcctcctaagtagctgggattacaggcacgtaccaccatacctggctaatttttttttttttttaatttttggtagagatgaggtctcacaatgtttcccaggatggtctcaaactcctgagatcaagtgatcgttccaccgtggcctcccaaactgttgggactacaggcatagccatcacacctggacctttcttctttttaaatgtaggctcttacagctgtaaatttatttctgagcactgatttggctgcatctcatgaatcttggtatgttgtgttttcattttcattaacctcacartatcttccaatttccctagtgagtttttccttaacccattggttgtttaagagcaygttgtttactttccacgtatttgctacttttccagttcccttctgttactgatttctggcttaattctattgtgatcagagaagaatctttgcatgattttgatctttttaaatctgagaaacactttatggacttaaaaaaaggtcttcctggtaaatattccatgtgcacttgagaagaatgtatattctgctattgttgggtacagagttctgtatatgtgtgttagggctagttggcatatagtgtcgttcaagttctcaatttagattttaaaaaccctgaaggtcattgagaaatcaagtgctgaccttgaatttagctcctgtaaatctgaatttgtattttctgggggtgggatgaagttacactatccaaattgttatggtgccaacaaatgttcttttattgctcaatatatgttttctttaaagtatatttacattttatatattatggcatgacttttatacaagttcatagaacacaaaaagctggaggctttgggcgtctgtgttggtattttaagggatgtaaggacaagaggattctgtgtgctgcctttagtttagaaaaatcattgtgcacagacctgccatgataggaaatgttgttacaagcctcactgaaataagcaatactagctaacatttttgaagtgatgctatgaacttttattttaaatattgcttattttcttcagaccagaacttttaaagatgtgtattaaaataatttcaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatgtaagtattaaacctagaagttcttatggtattgattgccttgagaggtggtgttaggatggcattaaggccaggggatccagcagttactttatgttaccctcgtgcagacattcttctccctgagagtcttgagggaggcatakaggagacagagtgagtcagagatgttttgctgagaatgggagctttggccttaaacttcagtgcagaacactcgtggtgagatatagaagaccctcttctatgatggtccctcttttcttatctggttaggttagccttgaactgtaaactcctccctgagttttggaactttccattgtccagtgggaagggaaagaagcagacccagaaaggctaagaacctttgccaggctccctcctcaacccaggcccaggtggggtctctaaagcaagcaagttatggctaagtgagcccctctcccttgtgggaacagccctggtccatacagccccagcctcatgcatagatgatacctgagctgcttctttagaaagcagccaatcaatcagtgtccttctaagaattctaagctccctggttagacttgacctgagtcttctttggggaaaacggagaaaggaagggagctgagcgaaggtccttgagctccctctaggggccaacaagttttataaacgaaaatagagatttttggaattcacctgagggctttcctaaaactctttaaactctagcgtgagatttggcgaactatggcccatgaaccaagtccagcataccacctgtttttgaatggcctctgacataagaatagtttttacatttttactttttatttttttcaagacagagtctctctctgttgcccagtctggagtgtagtggcacaatctcagctcactgcaacctctgcctcctgggttcaagtgattcttgtgcttcagcctcctgagtagctggcgttacaggcacatgccaccacacccagctaatttttgtatttttagtagagacggtttcaccatgttggccaggatggtgtcgaactcctggcctcaagtgatcctcccacttgggcctcccaaagtgctgggattacatttgtgggccactgtgcccagccagtttttaaatttttaaaacattggaaaaaaagaagactattttgtgacacaggaaaatttcattaaagttcacatttcagtgtcatgagtgaagttttattgaaacacagccatgtttggtaatttatgctctgtctgtggcatttttgtgtgggagcagtagagttgaatgttttgtctgagactttgtgttacgaatctgcatgacttataactgttgctattgaccttggctacctggctgtggtagtgtttgtcaggtttctccactgaagattttctcttttttcctcctttccctgctgtcctttctgaaatgaagtcactatgagcagcctacactgaggagaggagacgtgcrctcccccatacttttgtttttgaagttaatgtgttaccttctgtggttttctgagggtttttgccatgagtaacattgggaataatatgaaaagaaaagggtaaaattaaaaacgttatgtccccagtggatttactgatgtggtccctggacagtgttggcctctcactaaactagcttaagaaccaggtgcattcagttcttctgtttctggtacctattaagtgcccataaaaaattttaagccccagctgggcctggtggctcacacctgtaatcccagcactttgggaggctgaggtaggcagattgttgtgtgagcccaggagtttgagaccagcctgggcaacatggcaaaaccctgtctctacaaaaaaaatacaaaaattatctgggtgtggtggtgcacgcctgtagtcccagctacctaggaggctgaggtggaaggattgcttgaacccagggggttgaggctgcagtgagccatgatcatatcactgcactctagcctgggcaacagaatgagaccctgtctccaaaaaaaaaaaaaaaattagactcgtttaagattagaaagttagattttccttccccttttttcaccctgtacatattctgataggaagaccagcaagcagtagaaacaaaccagtaaaaccacagggaagcagaagcaggagaagcgtccaagagcgtccaggagcgtccaagagggcagtcagatttaaaacacagctatgtgctccctgattttattctctgtttccatcttatgaaagtctaactgtagtactgagcttgaattttatcttatagcaactgtcagaaatccagaagtccaatatgcagatcaagtccaacataggcacattaaaagatgcacacgagtttaaagaagaccgttctccatatccccaggatttccataatgtcatgcagcttcttgatagtcaggtacgtgcaagtgggtgacagctgcagtggatgccttcctttttcttagtgaagtaatttacagtgagtgtcatctgcagaaaaagtgtttgtcttttttagtaaccctgaaggtgactagctgttatttttctcctacagcatgcctaaatcataagaggtgtttgttacatgcttgctgttggcaaatagcatacacaacagttggcagaactgttttgtttcttctctccataaagtcaatttgaattggttagtataacctagctattcatttttcatctttcagatgtagctctcaatttcaaaaggtgtagaagggcatattgaagcaccagatttaattttagagtttaaatatactgctaactgtatttttagtagaaacggggtttcaccatattggccaggctgatcttgaactcctgacctcaggtgatccgcccacctcggctcaattaactgggcgtggtagcagatgcctgtaatcccagcttctcggagggctgaggcaggagaattgcttgaacccaagaggcagaggttgcagtgagctgagatcacgccattgcactccagtctgggcaacaagagtgatactcagtctcaaaaaataaataaataaatacacacacacacacacacacacacacacacacacacacacacacacacacacacactgctaactggtcagctgatgatctgttacatttatcaaacataatcactttcatttggaagtgacagcggtttaggggaacaatttttttaaactaggaagcaaatagagatgagagcttatgaattcaggattcttttttaaaagcctgggtcattctaaaaaaggtaagtagactttggaaacagggaccactgcttcttgcttcagtgctcacatgtttcctccctgacccaaatctacctgctccactgcagtcaggctgaccatgtccctgtcctgtctgaagtccttcagtgacccttattccggacttcctaccagcacgcagggtccttcggattctgggccctgggccatctttctctgttctttgctttcctggcactccagcggcccagcagcccatgcctctcagaacatgcccttctgtctttttcctcggttctggctgctttcctgcctgtcctgcagctcccagttttcgggacctgtcttttactcattctttagtattcagccagsggggcaggtaccgctttcagaaagttctcctgagcctctaggctatagcatttctgtagtccctaagtrggatctgatgacatacacattatatgtggattctccatggctgtgtctactcgcctcccgtgcagagcagggcctgtctttttatcttcttttagcctgccagtggccatccagtgaggtgcctggtatatggtaggaaaccaggagctgtgtcctgaactgaactgttgacagttgcttccagcaggctgtagactacagctggtcgctcatgaactgaaggatgtggctctaaaatcctaaggtcccacctaaatttcttctgtttctgtcctgtgagttgtgttgtcagttcagaacccatggcctcagaaaccttggtgtttccttttggcctcttaggttggcaaactagcacctccttttgcaaataaagtgttactggctatgtcccagtaacattttatgagtgctagttcatttacatcttatccatggctgttgtcccaatacagttgtggaatgacacagctgtattgtgttgtgttgtgaccaagttgtctggcccccagagcctatgatatttactgttagctccttactaaaaaatttttcctgacccctgccttatggtaaaagattaaaaccagatgcaaatgtatttaagcatttttgactgtgtatattctaaaaaataccagctgtattagtctgttctaatactactgtaaagaattacctaagactgggtaatttataaagaaaagaggtttaattgactcacagttccataggctgtacaggaggcatggctggagaggcctcaggaaacttataatcattggcagaaggacaaaggggaaccaagcacgtcttaagatgatggagcaggaaagagtgaagagggaagtgctacacacttctaaacaaccagatcttgtgagaactcactatcatgagaacagcaagggggaagtccacccccatgattcaatcatctcccaccaggcccttccttcaacacatgagatttgagtggggaccgagagccaaactgtttcactagctaaaattttaccagatagatagttgggtttcataggtattcactaaaaaggaagctcccatattgcatagatctcattgttacagttgtacataaattattcttttattcttttgtaggaaagcaaatggacagctcgagttcaagctattcatcaagaacacaagaaagagaagggtcgggtaaggttaagaaaccagtggcctaaagtgggccattttttaaagaaatatttgctttcctttttaataaacataatatttgtccacttaataacatttggggagaaatgtgtagcaaaattaaaattacctataattctaacaccaaaataaccactgctactactttcttataatttgttttcttttttttttttctcatgaaacttttttaatgggtctcaaaattctgtgacaaatttttggtcaagttgtttccattaaaaagtactgattttaaaaactaataacttaaaactgccacacacaaaaaagaaaaccaaagtggtccacaaaacattctcctttccttctgaaggttttacgatgcattggtatcattaaccagtcttttactactaaacttaaatggccaattgaaacaagcagttctgagaccattcttccaccactgattaagagtaggttggcaggtattagggataatattcatttagccttcagagctttctgggcagacttggtgaccttgccagctccagcagccttcttgtccactgcttcagttttcttgtatgcatttctgtaagtgtagaacctcatatatayatagttttacaacattcgaattatgttttgtaggtttgtacacttttcactttatatatcatagacctttcctaagttttaaagtattcttcaaaatcatgacttttaatgactttcatgatgatcttattggatgtatcataagtgacttaatcatttcttcattgtcaaatacatgtttctgatttttttgtatcacagaactgcaatgtaagtaattttttaaaaaggcaagaactgtttacattaaaatcgctttaatgaaaacaaactttaattatgacactgattctctttcacctgagtacatcagaaatttaagtgttaaaatgtgtttacactagtgcaaaacatctaaagtagatgtatttgagaaggtcttaaaataggaaaacttctgtttattttttcacttgaaattgtgttttgtaccttagtatttcttgtaaatcttttctgaatggaaaaaatgtttcctcttttgcacattttctaatattacctttcttagtagaatattaaacgacaaaagatcatataatatgtatgtgtataattgcaaggatgaagtgtgttcagatgatcaaaaaatttatcagcttatatttctccaaagtggaacaaatactgaggaagacggggagagaaaaagaaactgggaacaatactagagccaaactaaagcaaacaaaaaataaaaatatttcacaaaacacctgcagttcttgaggaacttcgatgggaaagttagatattaatctacctttaagattgtatcattgctagaaaaggaagtaggaagcactatttttcctctattccatttaaaatatcatttcatcatgcaaatactttatagtgataatacacagacatacacccaatacacatatctatagatatacacatatacagtagtttatattgaaaattgtatcactgatgtggcagttcaatttaggagatatttactgagcatctgctatgtactacactttataaggctaaaaagagatgtggaacaatgccggccctcagaccgcttacagtacagaagggagtaggagtgaggctacagctatgggaatcaggatgggataaatgcagagtgccctagggactgaacagagagagtttcttgaagtgggattagggctgtgtgtggatcatgcccatgtttacatcttcagcctaaacaactcttctgagttccagatcaggtagccagctcagtactcgacatctccatgggcttctcaagtgcgacatgcctaagatgaagttcttgggtttgttccccagacttggcaaatggcaccctcgttcctccagatgctcatcttgattccacctttctctctcaatccccgagtccaggctgtctgcagggcccactctatggaaccagttcttctgtactttcctgttgccctgcattaactaagcctccatttctgaatgggccccagggtgggtctcctcaattccagccttccccttccttagtctgctctccacagagccagcaaaataacctggctgctggccgccattctagcctcagcctgacccccccgccccaccccctgcctttcggaacctcctctttccagctatgatgactttctgctaatttctagaacattctggccttttcctcttttatacctggttttcattgttggcaagcccttygacttgctcttcacatggctacctccttcccctcagtatgagttttctattctgtgtagcaaatgaccacaaattgagtgggtgaagatggcatgtatttmtcttctcaatgtccgtgggataggagtccaggcagggcttggctgggctcagggactcacaggctgcattgagagtgtcatctgggctgtgttcctgtctgaggttccttgtggttatttgaagggctgagactatcaggttccagaggctactccttctccatagcagtgcacagcatggctgttgacttcaaggccagctagagtgtgtctctcttgctttcattctcccgcttcaggaagggcctgggacttcttatttcttttttttttggggtgagacagagtctcactctgttgcacgggctggagtgcagtgatgccatcttggctcactgcaacctccgcttcctgggttcaagcgattctcctgccttagcctcccgagtagctgggattacgtgccaccatgctgagctaatttttgtattcttagtagagatggggtttcactgtgttggcctggctggtcttgaactcctgacctcaggtgatctacccgcctcggcctcccaaagtgcaaggattacaggcgtgagccaccatgcctggcctggaacttctttcaggggactcacctgaataagacaggcccacacaggataatcttccttttcataacctcaaagtccacagatttgggactgctattgcgtctccagagtcccttcacctttgccgtattctgtggttgagaagcacaatggaggttctcctcagaccaagggacagcatcacacagggggtgtacaccaggggtacaaccttgagggccccctgagaaccctgcctaccccactgcctctggcctctgggtcctggtcacctgatgtcactctatccaagtaggtagtcccttttctttattattcccataatatctcaaacagagttctgagcactattttaaatagtttacttgcttatttgtttccttgtttattgtctatctctccaatcacgtcattggccctctgagtgaagggctctgtctatttagctctccattgtctgcccagcatccactcatgtgtctgaaatgtggttggcactcactacacacttgcagaatgaatgtggaaggtagctagctagggcatcattcagccttgttttcatagatggagaaaggctgattgtagggttcagaagagcagggttaccagagttgtctggaggtctaagcaccatctgctgtagggaggacactagtccasgtttccaccctgcacccagggagcttcccccgtggcaatgactatgtagttaggacgatggcgttcacctcccagcatattttatctatggcagctaagatgcaggatcccaggagcagtggatggtagtttctctgcaccacaggtggctccactgtgcaaggagtgttctcctttgtccccctacattacactgaagcaaaagtggcctgttcttacagttcatgtcctggtgtcctggagctgactcatatcggctctcagctgtgcacatttctcctcatcagggtgttttttttgaaagctgatttaaccagcacaactttggtttcatgggaacatttagaaataaatggatatttgtagttgccatatacttaagccttctaagagttctgtgaagtagatgctgtcactcattttacaggtgaggacacaggggcttagacagatgctgtgttgcccacggtcactggtatttgaatgcaggccctgtgtactccagggcatactacactgctggcctgtctagctccaggcactcacctgtgaagctcccagccgggaaggaaaacaggcagtgacagcttcaagtggttgcttttctgtaaggacgcaggatcttttctttggatgctctgacatggtaatccctaaccagggatgcacctcagaattacctgagactcttttccaaagtacacgtggccagctccactccctgagatcttgatttagtagataagtctggaacacatggattttggagataaacaaaccaaaagccacccaggctatcctgttttggatctatggtttgaaccactgctcttagatcattaaaatccctactcttattcttcaagccatctttctagcattggtatttagggacagaattcaggtttctttattaatcgggggtgggaaggcatttttaaaatcctggctcctttaaagctgtctgtgtttcagacagttgtgggaatttcagtggcctctggctggaatagaaagcgagttacagtttttatactttgtcattgcgagttgtgatagagagaaagacggacagttgtcatggaggaagaaggtgaggcctttcctggttctgagtggggcgcatgcctcacatactaggtatgtgggggcggatttgtgccaccactaggctgcactccttcctcgtctgttggtttgacttgtttagaagctgcttacctctcccttctttgctcttaaaccctaacagaggggtgaattcaatcaggtttagtaatctctgcctgagacctaactattaattattccacatgattggtgcctgctgttcccacaatgcacatattgtatttctctgtttagggaaagttgcatttgccaactttctattgatttacttagattcttggcaattttttttgttttaaataacattggtaggagttcacaggcagtcacagataagcgatggcatgccctttttacccaacagaagactcttgagagcttgggaggttgtcagatggtcacataatgaaggaagggaggatggggtgatgtgggccagtagggaaaaatgcatagtgcttgaaatgggatcacagaaaatgggctcatgagctgcaaacttcaaaataatttctggctatgtttgcctagaccctctccattcctttctccatgtactcttttccgtgcctttctgattcattcttaactcttctattaagaatgatgttatcccttagatattcccacatctcctttcttcctggggcctggagcaactccccatgtagttgatcaaggccgagatcctaaacctccatccagcagcctggacatttatactggcttttccttctattttccagctcagcatttcccagactgctttggaggccacttttccaggggcctgtaaagatgtagtgaaagctcttgacaatgccctccttgggggaggttcttagtatccactaggaaaggaaagattctttttaggtttcactcggaaaatctttctagattggttccacccagtgtttgtccagcctcataggagcacagagcatttcagaggcaaggctgtgcaggatgctaagacactgctttttttttttttttttttttgagacagggtcttactctgtcaccggggctacagtgcagtggcttgagcatagctcactgcagctccaacctcctggggtcaagcaaccctcccacctcagcctcccgaggaactaggactacaggctaaccccaccacacctagcttaatttttaaaactttttgtagagacagggtcttactgcattgcccacgctgaactccaactcctggactccagtgatcctccctcctcggcctcccgaaagagcactgactttgaaacttgcatgtgaaagtttaagtctgggctctgcccaccttcggctgtctcaattagagccagtgactttacctttctagacttgagttttcctatctgtacgatggggccaaaacatgtgtccataacattgtggtgtggattcaacaaaatgaagtgcatctagtacacaatgagtgttaattttctaaaagcaagcaaatgaggaaatgctggtctaggtgcccttatatactcatctcaggcacggacacttcctgctcctttatttgatcaggataccctgtcaccacttccaggacatagacttggaatgttcttcaccccaattatgaagccttttttttttttgagacggaatctcgctctgtcacccaggctggagtgcaaagacatgatcttggctcactgcagcctctgcctccggggttcaaaaattctcctgcctcagcctcctgagtagatgggattacaggcgcccgccaccacacctagctgatttttgtatttttattagagatggggttttgccatgttggccaggctggtctgaaactcctgacctcaagtgatctgcctgcctcagcctcccaaagtgctgggattacatgcacgagccaccacacctggcctcaagccgccccccctttgtttctttttagccttctgtgtttaaacaactactgaaattgctttaagcgcctttccttcaattattgaaaacaaattcttcttgaattctttttgtccagtctatgatcttccatgacattatctctaaagatgaatatgtctgtgtgtctctgtatctctgtcctctgcatctctccctttctttccctccctccctctttccctctaatccccaccattccccctctttttctcggtaaacatctatcagtaaacatttctcagagaacctgctgagggccagggattgtgctagtttctgggaatataaaataattaagatggggctgggcacggtggctcatacctgtaatcccaacactttgagaggccaaggcgggtggatcgactgagttcaggacttcgagaccagcctggttaacatggtgaaaccccgcctctactaaaaatacaaaatttagccaggtatggttgtgtgggcctgtaatcccagctactcaggagactgaggcaggagaattgcttgaagccaggaggcagaggctgcagtgagccgagattgctccactgcactccagcctgggtgacagagcgagactccatgtcaaaaaaaaacaacaacaaaaacattaagatgtgctctctggcctaggatggcccatgtgggcatcggaaggacaggactgcaggagaaatttagtactaagggtcagagccactctgcaggagaagcctgaatcctttatcgttgctcatcatgtgttatttcgtgttatgtgctgtagttggctaagctgctcccattatcagtgttgtctatttggggacgtgagctcccttgggaacacagatgaagcacctagagcagccagggccaggatataccatgatcaaagatttattcaacgacttgatgcgcacggatagcatcaggctagcaaaacaggcagagcatgtatacctgaaatctggagaatgaagacatttgacatgcagcttacagatggatgcctttcttaactttttttcagctcctgtcacatatagagaaacttcgaacctcaatgatagatgatctaaatgcaagcaatgttttctataagaaaaggatagaagagctagggcagagactccaggagcagaatgagctgattataactcagagacagcaggtatgtctggcggcagtgtggcaccgtgcttctttaagcaaygcagtctatctaagaacatgtgtttttactttagagcatttgtaagtggtataaggtgaggaagatggaatatttttccccttgtgattgcttgtaaaagttagtgcaataaaatacatttttaaaaggtatttaaaagtaatatgttgaagatttatacagttaaagttcaaaattaatttgatttgaaggtaagtaagaatttctttcagtaattactctgagaagcagccaaatacaaatgcaactttaaaaagattttttgttattttattttagattcaaggtgtacatggacaggttttttacatgaatatattgtgtgatggtgaggtttgggtaataacttctgcctctatgcttttaaagaccacatgccctatgtccctggataatttagtgaaaakgttaatttactaacaacattatctgtccattwtcccatgtgtgtgtccctatctaatttcaaatgtatcactagaagactgtatttctttgcagattaaagactttacctgtaatccattaaacagtatcagtgaacccaaaggtaagtggatgggatcccggtactggcggcaaggggaacctccccaattgcactgggcttcagaagaatgtgggccccacttgtttatgtgtgctaagatggcattcttcttgttgtattgatttcgtagatctgtcctctattattttaatttgagagatttgttaccacaacccagaaaggtgaagaatttaaaaaatctaaactatcatgtagttgtttcatttttttaatcagagtacwattaggcacataatacctgcttaggagccatttacctcttgacttatacactgtaaaacagagttatgcatgtaaaagcacaaggtctgtcgacagactgggttcaactcccatctctggcacttcatagctttgtgaatctctgcctcagtttcctcagctttatagcaggaatacgaatagtgtttcagtctattttctctgctataatagcataccacagactggtatttataaagaaacaaggtttctggaggctgggaaatccgagagcatggtgctgacatctggtgagggtcaacctatggtgcaaggcatcacctggccagctaatgcatgagacagagaaaggaaattgggtcaaacgcatctttttaaatcagaaactcactctcaataactaacccactcctgccactgttgccgtgtaattgttacaatggcagttaaatttcaacttgcatttctgaggggacattcaagtcatagcaaatagtaactatatcataggcttgttatgaggattaaatgggataatanacctattaagccctcattaagtttgccattattattgatattaagctcttagtaggccaggcacagttgctcacatttgtaatgcccgcattttgggaggccaaggcaggaagatcacttgaggccaggagttcgagactagcctgggcaacatagcgagtcccccttctctaaaaataaaaaatgagctgtgcatggcagcaggcacctgtagtcacagctactcaggaggctgggatggaagaatcactcgagcccagaaattcaaggctgcagtgagctatgattgcaccactgcactcaagcctgggtgacagagtgagacccacatctcttaaaaaaaaaaaaccaaaaaactcttaattattctaaagtgctataaaggcttgctgcgttattctcaactgtggctgtttgggggttacaggtttgttctaagtttaatgggaatatgcacaacctactgactgcggcagtgatagcctgcctgtctccatatcattcaagaactctctgtctgtctctgtctctctctctctgtctctctctctcwcwcwcwcwcacacacacacacacacacacacacacacacacacacacacacactaaaccagtcaagaccagggcaagagctgactttgcaaaagaaataaaaaaagagaccagaagggagactgggagccataggttcagggtcttacttctgcctagttttcttcccagtgattccagtcctggttcctgcacgtctcaggttgttgaggaatctttgtctatttgagagatgccaactaggggtggtactggggtgtatgagctgggtttcctccctcttgttttgagataaagagttcgggaaagagggttgttgttccctttaactcctcttcaaataacaagagctcaggttagggaggaatatttgcaaaattaactagatatcataaatatttgactgaaaagtaattctggggaaaatttagcttcaaaaagatgtatgttacacatatttattctcctggtgatgtgctatatattggtacatttcatttatgttttttatgggggctcaaattagtataagggctacaaaaatttaatccatagcttgtgatgttttttgttcatttatttttctgtcatttcaggaaatcctttagcctggcaggcttttgaatctcagccagctgctccagctgtgcctagtaagttcctataatagatgcagggctccaaaggtatctttaaaatgctaaaccaaaacataacttttacttactatttttagaggcttttctttgaaaaccaatgtatttagagatcacataatgatttattttgattcttagttttgacctagttctaaaacccaagactacaaatatccacatgatgttgtggtgattttgattagctatagctattatttcacaatttgtctaaaaagggatgactaaaaattccttggcatcaccttagtttatacttgtagacttctcaaagtgatacactatgcgactgtgtgactgtgtgtggtgtcaccacactttgaaactgctgacacttttactgctgcaggctttgacaggtggcctgtctgtccccacttgtggtcagcctggccatctgctctatctcccggagctgtcaagattctgcagtaaaacaaaaggacataatctttacagttgagaaactgagagatggttgtttaaaaatactagctaaatagctgagatagttttgcttccattcaggaaggagtaagggcaggtacctgtgccatgtgcacagggatctgactgtgagaggagtatgggctgaggctgagcacagagagacagcaccacgctcatgggcccagggattgcgagagcactgtgtagtgaccaaaggacgttcttgagcgtgttttggaatttggcactattggctggaaaatgctgatggttttaacctctcagtcttcttggaggcttcttgaagctgaagaagttaagcagtagttaaggagaggagaggagtttaagtgcccagagtagggttgagagaggaagagatgctgaacttacatcttatgaaatgaaggaaaaaaacacatttcagagaaggacagaaaggtcaagtactaaattattcaaacaaacaaacagtcttcagcagctgaccaaactcaaatatctatgcaggaaaaaaaaccaaaaaaaaaaaaaacccaagtctatatttagttagggtggttttctccaaatggagtatgcaaaattatctattggaatgtgggaaaaaattattagaggttctttttatatattaataaatctcatccttttaattttttcattttttgttttaaaatgtacacatttgtattatagtatatataaaattcatttaaataaatatgtgtatttctgggggaacttttactgattggggaatgtggtcaaaaaaatatggatgccactggctctagaaaattccaaaaataatttaaaaaaataggcccatagccccataggtagcggtcccttccgagtgaggccctggcttgtcccattcctcttcccagcatacaaaaggatctaaaagccaaggttctaatgatggcagggaagttttcatcacttaaaagaaaacatacattctaaagtttaagatcagaaagtaaatcacaaggtgaaagtcagcttaggagatatgcaataaataaatcagacctatagccagtaaaatgaagatttgtaatgtctaatataaagcagatatggtcaaacctgttgattccacctgtctatacccttggtgatttagacactagtcagtcatttactgatttactaccctttcataataagggaatgaattctgtagtttagagaaaagaccaaattgtgatcaattttaatagcatcagatcttttgattctgtaagctggaaaaatatctagatcaggaatagttagtattctgtatttttttttttcttgtaaaaagtcagacagtgatttacattaggcttcacaggctagatgatctattttgcaactactcacctctgccattgtagtgcaaaatcagccatagacaacacgtaagtgaaggagcttggctgtattccaataaaaacaggcagtggactgggtatgtctcatgggctatagtttgccaaaacttgatctagattatacaagttgcaaatgggtacaaaggcagtatttccagagtttgttagcaatttacaaataggaattgaacactttcactagaagccattgtgaagataaaaaatgcatacctatagaagtagctgatggccgggtatggtggctcatgcctgtaatcctagcactttgggagaccaaggcaggtggatcacttgaggtcaccagtttgagaccagcctagccaacatggtgaaaccctgtctctactaaaaatacaaaaattagctgagcatggtgccgcatgcctgtagtcccagttactcaggaggctgaggcaggagagttgcttgagcccaggaggcaaaggttgtagtgagctgagatcatgccactgcactccaccctgggcgacgggagtaaaactgtgttttttaaaaaaaaawaaaaaagtagctgaggtttgtggccagtattttttagggtaagattagaattaaaagtctgtcttgataaaagaaagaagcggtaaactaatagaccatactgtttagtgaaaacaaactggataaataaatagtccagagaggactttcagataagaattgtcaaatattggaagaaggccgtggaatctaattttctgtagaaatttaaattagagaggattgagtcttacttaagttaggtaaacctctttccacaggctgtgcctaaattaataccttcacataatgtcttccagcccagtgattagagtactttttaaaactggtttattttgcatgaatgttcattgcagcattattcataacagctaaacagtggaaacaacttatatgtccatcacctaatgaaaaggtaaataaaatgtggtcagtttataacacagaatgttatttgcccataaaaatacatactgatatttatatacatgctacagcatggatgaaccttgataacactgtgctaagtgagcaaaaccagacgcaagggaccacatactgtatgattgcatttactatatgaaatgtcaagaataggcaaattcatagagatggatagtagattaattgttgtctggggatagggaaggggcagaaatgaggtgtgatgggtatggggcatgggtattttgagggaggtgatgaagcaaatgttcgagaattagacagtggttgtggttgcacagccctgtgaatatgctaaaaacccactgaattgtatatttttaaaaggggaacatatctccataaagctgttatgaatataagtttatgttagttgtgtaatatctttgtcacttgaaatatttgttccttatggtctgtatgtaycttgactagtttgcggcatatttrgctaccatcatgttcggatgcttatgctttaattatggaacctctgagtttttcctttttatgctgtttcagtgaatgccccagccctgcacactttggaaactaaatcaagtctgccaatggtgcatggtaagtttcagtaatagtctcagcgttttatgtgcagttgccaccctgagttggataacttattaaccaaaagtgattatgtggaggtaattaataataaaacaggaaacattttagtgattgcaaaacagttattaaaactgcagtcttcatgtgtaatattgttgtaaactggacatacctcccaaagtcttaaagtataaaagktgtatataggtataaaagsttgccagactcacaagtagagattttaactttgggtagtgtcttgattatttatgatttttgtggaaagtagtaggtgttgggtaagaatgagggtgacctgctaccagaccagccaaccagcacatgccacagggcgtatgtggttgtttttataactttcaatgtggcagcaagtcaccttttctaaacaaacagtttgaatgactggttgggaaaatctagaaaagacatgtgatggaaactaaaggaaataggtaggaaccactgggtgaaatcattaccagggttcagttcttggaccagatcaaaagggtgataattgttattaacatgatccaatagatgggctgaatatttgtagccgtatttcactttttatacagttaaagtgcttacagtttttatagtatgttctttaatgtgatgttttcctgtgctctgttggatattacaaatgaattaagacgggagaagggccatctttttccagtctcacatacagttgctctggaatccaaggattatttcactctttcatttttggtcttttaaaaagattacacttaaatccatgatctaactggtcagtatggtggcactttttgtcttcatagatattgtgatctgtataccatgaactttagtaataatcctttttactcatcactgactcttgaagtgtttattgcaccttatttttttcccgaagatcatttcaggtgggtcagttgtcttgagtatgtgatcacaatacgtaatgtgtaaattctccacatattgatcttcttatttacaagtgttcagagcatgcagttttttcctttagaccagtaacagataaaagcacactggacataaataaatttgctttaatattgaatatataagaaaagtatctagcaatcattctgtattcatattattttatgtcaggtctaaaatctctctgttgcgtccctttrtaaagcattgctggccatttctcttttgtacttcaacagtgtattttagtttcttttacttccccacccctccactttgttattgttagctttctgtatgacatcacacaaggttcctagtttctttgtcatatatttttgttgctaactaaaggacaccctggtaggtacattaaagctgtctggggttgattcaagggtccggacaaatcgatcatttctaaagcatgtgttcatggggaccctaccctcactagcccagagctgcatgaatcagtcatgcccccttcctggcatctgctgggattgaaatgctagttttaaatgccagccagacctggcacagggcctacagcccttggatggggatcaaagcttatttgtgagcatctcagtgggcaggagctaggaagagacttggccagggcccgccaacgtcccccaccccgtcaggccagcttccccagggcggcaggggcagggcaggttagtcatggattgcgtaatgtttattcgcctgttcactctctgtcctttgttccatctcgaagcttgatgaggttctttaccatgaaaaatctcacaatttcttaccattgtaggtcgggtcccctgggaaacagactgatgcggaagtttacaggtgggaggtgggggtgcccttggacagcacctgtgagagaagcagggttgggcgaagggaacgttgaacctagacgcagccacagtggaggcctcagccagccctgcttcagagctgcagagctgggatgagtgctctggcttgtcctccactgaggcaggggtgggccattgccccttgcactgatttgtcatctgatgggggctgccccaaagagagggtgagctaaagcagcctggaagggactccactgtgagctgctaggagccaacattgccagcacgtttgtcctgggaggatctaggtaaaatgggaaccctgatggctccctgctttcaactctgctacacaagctaaacggtacaggcagtaggttctgatcctaaggcagttgataggatgaaacacgggttctggagaagataaacaatcatgcttgattcccatccccagtatgcattttttttctggacaaacctcaaataaatttttgtagtattttcaccactggagaccactttgctctttgctcatggagtagtgactaaatggtggtattaggatgcccagaaaataaagtatactttgttgctgttaaactgacccatacaccaattgcttaggttgcctgggctgataatgtggcccacttttagagcgacgagtgcagtgaggatgcaaaataaccgcttttcccaaagtctgtgggcacctgctaggttctatctacatgtaaagccctcctttaatttggtctataaattgtgaggggcttatgtatgcatgactttaattgtatatagctacagtgaggaccacaaaaactggaaactctttttttttttttttttttttttttttttgagactgggcatttctctgtcgcccaggctggaatgtggtgatatgatcatagctcactgcagcctcaactttctgggctcaagtgatcctcccacgtagttgagactgcaggggtgcaccaccatacctgactaattttttgatttattatatagacggcatttcattatgttgcccaggctggtttcaaacacctggactcaaatgatcctcccacctcagccttccaaagtgctaggaccacaggtgtgagcccaccgctcccacttagaaacatttttattagactttacaattattattatgttttgttctcaaagcaagtattctacatcttgaaatactgaaaattaacacaagcaatagtttattgtccaatacatgacaggtggtatgctctagacttctggtgtattgtgtctcttgatggaaagaaagatggcttccccctctggacaccactggcccaaatagtgttgcagaagtgggatggggactgttgaaaggaagtctcagttcagtgggattccaccctctaaaggagagtgggcctgatccctgtcaggtgaccatgcttatgtgcagtcacaaggggaaatgtttggatgtgccaacaggatctcctggacatacatcctggaaaagctcaggagagtcttcagtgaacatgtctttgacaggagttaacatgccacatgtagttatctgtttctccagcggtgttccgccactcttgccttccttccttcactgaccactgggtaatgacaactgtggaccactcctgcatgacagagatatagaaatgaatcagaaacgaagcctgtccccacggaacttacagcttataaaggagaccacatgcttataattatggtgcaaggtgagagccactgagaaatgaaatgggtatccaggcaggggagagatttcctccatttgggagactctgggaagacttcctggcgtagctgacatttggccatttgagccgagtaggaggtgaatatgtcgggatggcatcctaggcaaagcaaacagtaagaaggaaaaggtggcaggaaagcactagatgtgaattagcagtttagagtaattacttggccatgcatagagaagaggagatgtgagggaagtgaggttggttgagggcgttcatggcagctgttgagtgccaggctgcagctgtccagggtcgttcttggggcagtttgtagccgctgagtgttcctgaggctgggtgtgcagaattggagagctgggctatgggaggcttggcctgaccagagcgtctccaaagctccccatctgagatggggagaccagttgtgggtgtgggtgatcctacacttgagattcctccccgggagtctgctttgtggtgatgagactggagaaagagtggacagaccagcggtttggtggagttggcagaaaggctgagcaggtgactggggaccagggccaggaccaaggaaagtcagagcacagtgaactctgataatgggtggacagcggtggcatttggagaagtcagaaagacaagcccagtgagtgccagtaggcaggcatcatcactttgtggacaagtccccagactttggaagcaggcagtccggattcacagcccacccctaagctgtgggcttaggggctttgcctgccaagtgcagagaacagctgtggctactgcagtggcctttgtgatggtccagaaaggtacaagccactgagtaagctctggccagtgttggcttctaaggtaggcacgatgaagtccagccaaagtcagctaggggcaaaagggcagggctagttagaggaccaagatcctttcttctggagacaatggcaggaaactgacaaggatttttttgaaagcctcccacaagttcatgggagactcagacctctgagtgttttgactgtcaccctgcatctcagctcaggacaggatctgggacgtttgaagtctagactggtggcttacaaagcacaagcagggcaggtccttccctcctgatgtgggacatcagcctgcttgttttgggagctggggtttggccagcctcacttccccagcccttgttatgggagccacgttcaggagtctccccttctaccagaactcttcctctgtacacagagggaaacacatcagaacctggcagtttatcctgactctagagaaataagtcataggagtatccctgttataaaataataaatatgtgtgagattattwcatgaaagttttattaaaagtttccttgtgaccttattttgatcacaagtaaataaaatacagtgtgactttttaaaatctgaaattagttatcctccttaaatctgttttcagcagttcaaactagtaatatagcctatttgtataatttttaaaaatcttgatgctctataacaaatttgaaaagcatatttttggtggtcagcagttgtggtacctgctggacttaaatgcttcttcatggctatgtccacacttcagcagttaggtgattttactcagtcataggctgtattccagaagttaacttgaaagtagtttaagatgcgtttctcccatacagccaatgttacatacattgactaggttgctggctaagctgtaagaacctatttatatatacctaagcctgtctgtctgtctgtctgtctgtctrtctrtctatctatctatctatctatctatctatctatctatctatctatcatctatctatctatctctatcatctctctctctctctatcatttgtctatctgaaatagagtactagaaatactttaatgaataaaaaaccagaccctttaaagtaagaagcattaaatctgagataccacacatgtggatccctgcccagcctcctggtgagcactcggtaactgttggccatttttaccctggctcatcacccactcccaggtctggtggtagaatgaaatgacctcccccttggaggtaaaagtggagagctggtggggggaagtgcactgtatcagtctccaagatgaaggtgagtgaaccatgcaccaactttgctggttgcatttcatcccatatctaatgcctgaccaccatcattaaaccttcacctaaaacctgaccttcaccatgaaggaaatttccttcagttggtaggatagggcttggttttatacctgctgctggcaggcttccttgtgtatgcatataacatttctctgggaatagtcacccaaagacctcatctcccctgagtgcggttgccattctggggtgagattgggaagagtccttcctcatctgcccagctgtggggctagggcattctccagccccagaactaggtcgtgaaatgcatccatgcaggtgtcgaagaatggctctcattcttgctgctgacctctcgcctgtcgttccccttttatattctgggtcttaccacttgaaaaccgtggggttagcacccagaacaagtgggaatcccaggaccttgggaatttttaatgtttttgtagttgaaatattttcattaattttctgtttagccacttgattgaaatactttataagtaatgaagatcttttgcagttgtgcccttgtgtcttaaaaggctaccgtgtactaggttgatgaatgagaaactttaacttaattatttaaaactataatttctgtagagtgtagttaatggaaagtacatagaaatcgaagatatgatgaaaaggtgaccatctatgactgattgcctcaacgttttttcctcagtaaattcttgctattcaggcatgactaaaataccatggaatgatatctttcaaaatcatttgaaaggaaactaatgtaactttgctgttgtcctgtttgtactgttcttatttttccttgttaatagaacaggcattctcgtcgcacatactggaaccaatagaagaactttcagaggaagaaaaaggtaacaaagggcttgatcaggtttacctgcacagattatatttatatgccaaaatctaggcctggaaaatatgagccagtggtttttattccackacatcaaaattaggaaagacatttagatttggattttactttcaacccacatagagtatcctgttatcctattcccctaatattctgttctgttttcccctgctttgtggtattcttatgcaagcagataaaataagaaattttttgtgtcagagaacttgaaaaaaaatttgtctttattttaatgcagatttttctgatgagatgatatatagacacacacgtgttgtgtaccagaagatctgaaaatatttgtatcatagtggtgatttatcatacccttaatctgaaatgaattggtgaagtgcttatttccaaattatttttaatagcaagaaaagcatcatgtctaagttctggatgtggaatatttatgtgcaaaacagtatttttatggtggaatttgggagctgttacaggtgttgggagataattattactgcttactcatttcatttgatagtcctaaaaattattttctgtcaattagtttttaaagtctatgaagaaaggtttaattatgaggaacattttctaatgctagatttgtagattttgaaaacaattatatttgaatcaatctatcataattttttcctattaataataataataattcaccatatatcacttctttaggagaaagcaaattgtcaatacttatatgggttctggttttgtcatttttgtcaggaaaagaagtcaaatgatatatatcctaatatataaattcagtatttattataactcttcccttgttctctagacatttaccattttatttttatttttataaggctacaaattgagaattgactacatcaggcatattcataatacctatatgatatacactttcaagtcttattttgctatgctaatgatcagtaactttttgatatttttatagggtttgtttattttgcttccatgtatctttgtaatttgtcttgatgttgtatattttagacagaccatttagtttaggattgcatatcttcctgtcccaatagttgttcatgtttggcactgattttgaagagtttggttttagttgcttcatttcctccttatttctttgtaattgctgttccaatgtttagaaacctgcttctttcagaaacaagagtgactataggtacattaaattacataaagccataaaaacttgttgagggaaattttggggtactctgatgagcataactttaaaagatattgttaccttcttatggggtcctcagccttgttccattgctaaacaaataaattgctggaggggtcattcccagacacttccagcaccttaaagaccaccacagcccaggcatcaaacgagatcctgcaggctgaatcgattccacagacgctgacttgttcaagctgcactattagcaactattgtacagtaggttgccaatatttaattgtagtgcaatctctacacaatttaattatctatcactaggtgataaagtcccttccaactcagaaattctggttgttgtttttttaaaattatttgctttgtgccacaatacaataccctggaaaccctgggcgcatggtctacttagcaacatttagcagggctgagccgccatcactggctatggaagcaacctccggtttgccataatccccctcaactcttttgccccacattgccttctttgctttatgtaggcgtttaagcttctgagccctataggttgaagagaaatagtgcttaaaaaatattgtctttaagtgattttcaaccatccctattggttttccagaaacggaagaacaaatcttaccctatttgagttctgaataatgacacatcattttgcttgcaagtaacatgcttccgctctcctacatacatatcatttactgatgtccaagatataaaatcccatattccttgaagaatctgtgagacatgtcaggaggttcatagaaaacgtcgcgtactttcaaaactagaacttcaggtcatgtagttcacactcatttgaaaaacgactcagtgagggttcctataggaatcatgattgtccaccatcacccagagtggtcttgtaacttccagttccagatttcactcactgcatccctctgcctgtgcttttagagttcttccagtcaatgtaagatggtagtttggaatcactgacagcaaacaccaccattgggtgctgccacatttagggggctggactggaaaagaaaataactcttgtcatgctccatgtgttcagctctgatggtagacaggagagtgctgaggaccatagaaaacaccccagggtccacgtgcaccactgcagaaaccagtgactgcctccttccagcacctctgtggagttaacatactggcagcagattaattgccatcaataaattcctcagcttgtgctaacattttgcagataagtgcctgagaagctcaattttggcagtggtttgcaaaaacactgtggcttttactaagaagtaattcatgcatatttctgtgtacctgctttttgagcaaaggcatagttgatcttgcagttttatagatgctagaatgtgagggccagaagggatcttagagggcattttattttccagaaagaaaacatagggggattaagagcctgcttcaggttgttgagtttaattagtgacaacatccaggttttctactgtccatagtttagtgcagagagcaaatggagaaagggaagctgatgtggcctctacaggaccatctggatggcctttggggaagttactgctgtttctagtatactcatgtcaaaaatctatcattactaggtggtagataaattcccttccaactcagaaattcaaggatttttaaaaatcatttgcttcctgctacaattatttgtttaccataaatgggatgktgtatgtctgataaaactgatcccatgtatggactgttgtgcattagcctgggcrtctgcttgtttgtgtttgaaaatttgtatttgaaggaaatgctagtctttagaaagttttgtcttggtcttggtgagcaatatgtgctttaactaaaatcctcagctgtgattgattttcaagtgattaattccacttctacataaaaactttatttttccctgcttactctacattctttctcttgcttccattggccagccccacccttgtaagaatctttaccaagggtgctctaattattcataaatggtttcccaaagcaagcaccagtatataaggtgaatttgaggacagggggaaatgcgtaatctgcagtagtttggggaactcagtcatcaaaatgaacctgtcatcagagctgaggatgatcacagacacatcagcaaatgaattcaacaactaacggcaaaggctttacagctcttctaactgcaaccaagtcattccaggcatcgcttgcccctgtatgtggccccaagtcccagagaaaacagggcccagagcctctttttaggcaacgcttctgtgtacgtccttcattatctgagatattggccaaaagagtcttcacataattggggtagggggtatgtctatttcaatggtagcaccaagacttccaggctctctcggtgcctctttttatttttggccctagacagttgcacacttgatggccacctagaagccaaagccagtgacatagtggctgcagctatgattttgatggattgttcatagaagtgctttttttggtggtttcagaatatttgtaaacattggtggttaaacagcagcatgattgctgataatataagatttaagattagttctgacttttaatatataattatatgcagttttatcacttcagcttagcaagctgcaatagcaaaacatagaatagtatttttgtgcaggattttgttctctatttaatgtacacaaaagtaatttgactaattttgctttcaataaaaccatctatttatttaatagaaatattttttaatgtgggaattgaactggtgtttagaaaacatcttaaacaaaaaggcattttsttcaagatctcctgcaaatccaagtagtatgggtattaagaatcctgtctgctgagatgggtgaggcagcagcagaagggagagtctctcgggtggcctggagccctacacctaggaaatggcatttgatgccaccctttggtgggcaaaatgcccctgttaggagattagactccaaaatggtagtatagttgtcacatttctcccagatcaggcttttgacagtcagtaagggtctgaactgccaaacgtcgcatctctttaatgaagtcttctgttcctttgtacataaggactcagatttttaaaggttatgccatcattcttctccaaactgtcttgaacttgacttttttttttaagtggggaataaaaaagggatagggatggaagtgaggagaatatgtcctattgtttttggtttctttgtttttaattataggttgttttaaacaaaatacacttttgmtaagacttttgttatcctttttcattttggtaaatattttgaaggggataatgattttcacatcttgaaattttatatgtacttagcttctagtaactaaaaaactttgaaaaaaaatttttatatttaaaataaattgaaatgggatctcgctatgttgttcaggctaatctcaaactcctgggtccaagtgatccactcaccttaacctccgaaagtgctgggattacaggtgtgagccactgagcctggccaaaaagttttaattatttaaagtaaattgggctttttcttcataagatgatacataaattctaactgagtgagcttggagatgaatttttcaggaaatagtgatataattctagtgataaaacattaaactcctaaataaattttttttccatcatgcttctatagatacatatatatctatagttgtcatctgattaagtgatccagtctttgaaaatactgaagttttgaagccgacataaaatagttttaaaagctgcataacttaagcattctgtattgtgctgagtgactaaaatatccaaaaactttaaaacatcacaaatacttacttgctgcttaaaagctgtggtttgccattttctgcttagagatttttgatgtatttgcttaattctttttttaacacatttttaaaaccttatttcaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagtatgttcattcatttttggaatatttgttagttttgctgtgttttgttttctaaattagaaatgatcatggaagagaagaaagcacatcaattctgtccatgtttggagaacagaggctaatgtgacctactttatttatcaaacacttgaatagcattcactgtgtgcctggcacatttctacgaccttaacaaatattaactcatttaaacatagaaacaaatctctgaaataaatgacattagtatcttgacagtttacagaaaaggtaagtaacttgattaatgtctcacagctagtaatgaaggagccagggtttgtatctaggcagtcacagtgctgcttacattctgatattaacctcaaatcattgcctattacaaaaccagcacttcattaatacatgttgaatgaatggatgaatggattggatttcatattgttgccagattgaataattttggtatatcatatatagattctttttgctttttatagttttattgacatacataaaagacacaaatcttaattgaacttcattagtttatatgtttataaaaaagtgcatctacatatgcatatatacacatatatgcaaagcttgtgagcacatatgcatgcatgggcacacacgtggatgtgtatagtgtgtatgtgtgcatgtagctatgtatatatacatgtatgtatccatgtgtgtatgcagatatctgtgtatgtgtatacacatttgtgtatatgatatgtgtatacacatttatgtatatgtatgtatatagatgattgtgtatgttttcagaagtatgtgtgtatgtggctatatttgtgggtatacatgtttgcataattttatgtatatagatggatttgtatgtacatggatgtgtgtgtatgatctataaccagcacccaaatgatgagattgaacatttccaacactctggaagactctcttttactttctgctagtcagtatcaccccctacttcccaatcggagggaaagggtattctgacttagttttgcttgttcttgaacctcataaaagtggagtcatacactgtgtaatattttatatcttcttttgcttaatgattttatctatatgattcatacctgttgtttcatgtagcagtagtttgttcttatttattaccttatagcattctattgtgtgaatatactacagtttatctcttccctgctgatggacatttgtgtgtctattttggggctcttcttggctattaattcttgtacatgtcttttggtgaacatgggcatttctttttcttgaatatatatctagggatgaaattgctgagtcaaagggtaggcatatgtttagtacagtagctgttgccaaatagttttccaaagtccttgtaccaactcacactgtccctaacggtgtttgagagttcagttgctccacatctttcatcaactcagtcagtctttttaaatttccacatagaccctttttaggtgggttttgaccaccctttgggcagtggaaatcaaagacattcatggaatgtgtgtggttcctgtgcagattgtttcttaaaattgtagttttccatattggttgtttgcaagtggttttttgagttttaattttaattgggacattttcatttatcctaagattattaaaacattcttttttttctctaatgcttggagaggttttcctagttttttgtttgttgttttgcttattttgtttttgtctatctgggctttaagagttaggttttgaaacagtgatttggagagctaacttaatttccagttggatcaggtgtcccaatatcatttgttgaataatccatagtttctccatttatttaaaaggacatttttgtcatataagaaatccctatatacatttggatttgtttttggactttcaactgttttaccttgtttttttgtgtgttccttttcccataccatactaatttaattgtagtagctttgtcctgtgttttaatatcttttataggccatgccttcttcattagtcttatttcaaaaatttattggtaattcttccatgttttgttttccaatgaactttaggaataacttttcaacttccagaataacccttgttgggattctgattgaaattgttttaaattttgtatattaagtaggaaggattgacatttgtacagtattaggtcttatcctccagctacatggtataggaagacaggcatgaaacaaatgatttcccagacaaatgggagctctctaatttagattatatgaggtgaaataaaggaaaagtagaggagggggttgattgaataactgaggtcagagaaaacttcttcttggaggtggtacttaatttgatgatggagatttctgtcctgggcaactgggtgggtggtatggccactccctgggactgggaaggctgagggaagcaagggggatgggaacaaagatgggaggtagctgtgtgtgtgagacactgttattcaacaaatatccctttaactagttttcttctgtctagattctcatcaaatctagatgacttttctcaaattgtctctttaattatgctattttcatagttaaatgtcacctctagctgggcacggtggctcatgcctgtaatcccagcactttgggaggccaaggcaggtggatcacgaggtcaggagttcgagactagcctggccaacacggtgaaaccccatctctactaaaaatacaaaaattagctgggcgtggtggcgggtgcctgtaatcccagctactcggaaggctgaggcaagagaatcatttgaacctgggaggtggaggttgcagtgaactgagattgcgccattgcactccagcctgggcaacagggcgagactctgtctcaggaaaaaaaaaaaaaaaaaaaaagaagtcacctctgatgctctgatgacctattgttccttgtagaataacctttcagccttttgggttggcatttagtctcttctgctggtttcatcacccaggtctttttaagcattagcctgtgggacgtgccttacctgtttctgcctcgacagcttcctttctcacaggtgtccctatctcatgcctacccatctggaaatttctccttgtttttacttgtttgactccacctgtccttcaggccacagctcagcctcccctttcagccttctctggccactggggccttcgatggcctccctccctggaattcttctagcctttgtagactcattgggtccttatgacacacagcctcgtcggtcagccagtcataaacatatgcatgccttatrtgcccaactgaacacatggcccctttggggacagtgtgttacttgttggggcacccttaccctctacacacaactggagccctgtaaggatggattgaaatgttggcacagttaatgctgatatatgcccatgaaaygaaacctcccaggataactggccaacttaacatcttattctttcaggatatacgtggcatttcaagtgatcagttgcatagagtactaaaaagtgtggaatcagaaagacataagcaagaaagagaaatacctaactttcatcaaattcgagaattccttgaacatcaagtcagctgkaaaattgaggagaaagcactactctcttcaggtaagcttgttacccactgcaaatggragcttaatttaacaactttttctttttttcttcttttttcaccacaagatatcattaaacaaattattataattttaaatggttaacaaacttcgccacttcactggcaactcttttactgtttgtactattaaatgctgggtcttggattttgtttttacagtaaaaacaaaacaacaaccctagagtctggctttaaaccctagagatgggattgttcattgccacagcagcatagggggtattataccgtttacctttgcttttcacttactgatcataaaggtaatggagactcatgaatgacactatattccagatcagtgcagtgtttctcaaatggataccctttcaactggagaagtacccaaaatgatacaacttccttccaaaaacagacaactgattagacaaraagctgtttctactgataggacatctgttccaaagtgagtatttcagccctcagatttattttatcagtgtttgtcttagctcaggctgctttaacaaaataccatagactgggtggcttcacagaaatttattttctccccattttggaggctgaaagtccaagatcaggatgccagtatagtcaggttccggtgaaggctgtctgccttgcagacgactgccttcttgccatgcctccagatggtggagatacmtctgaaggagatacatcgcttcctcttcttataaggcaccaatcccatcatgggggcccccatccacatgacctcatctaaacttaatcacctcccaaaggccccccagatgccatcatactgtgggtcaggtctttagcatatgtatttggggcagaggggacacagacattgagtccataacagtgtttggtccaactgagaatcacacttgtaattcctaccagtctctaactgacgctgggtgacttttgttgctgctcttcctcrttagtgtatgtcaaaagcaaaaatcaccagttccatagaaatgtatgtgaaattatattattaacttatgcaatttaaaaatatttttctgttgtttttttagaattaagaaaaatgtcwtggaagatccttttcccagaaagtcttcaactattacgtgagtattgacagggatgggagggtcatttaaaaaattattttcactgaacattcctttcattttaaagtagcgtgctcattatggttgaatgaagccgtaattatttaatatcataatttgtcattcctttgtgatatgttatttgtgacatgtctttgtttctttatcagttattacataagtcaatagcccttaaccacatgtggactccattaagaagcaagacacctgagtcattcttatgtccatccccctacaatgttgagtaatttctcaataagtacatttaacttaaatggctgatgttgagtttttatggctaggctcatgacagtgtaagtttgttttaaatgtaataatttagtgtttccagttttttgtggaagttaatactgaccctagtagatattcctgtcttaggttctcttaggatactaaaaaccctagcccagttgttcatcacctgtgtgctactgatttagttgattactgttttaagcctgttttcttwtctgtagtatgggatgttttaagtctcaatttccttatctgtaatatggaataatgctgcctttttcacgagatagttctacaaattaaatgggaatgtatgaagagggcttggctcagtgcttggcacttgtgggtactcaataaattgtaggtatattgttactaattatgagtaagactaattttatcatgaataatttaatcatcattgccttattctggagatattgatgacataaatatcttttcattgaggcactgtgtattagagacaataaacaatgattcacccttcaaaagcacttttcttatacgtaatctcataggaagagcattatttcttgggatgtggtgtgaatgaatcaacatgtacaagactgacacgttgtctggaatttaggtgcccaataaatattatttaaatgaacgaacactgctttgaacttctatttcaccttaaaatgggggtaataattcatgtgataatacaaatgagattgtgtatgtaaaagctctttgcaagaaggtgcagtataaagaagctgtaagtaatgacacaattttaaaacatggagtggttttactgaggaaatgtttttcttaggtgtgtgaaaaccaaaattattaagaatatatacacatttgggtttagaggagacaggccccggcttcagcccattttgataaacatgccccgtggctggcagagatctgggcgtgggaggatgctacagccgtgggtataacctctggcctcgccgccatcttggccatagccccaaaggcacttgtgcccactgagaattacctgagaaaggtgccaccactttaagaggcacatctcttaatattataaatcctaaagcgttacgaaaacagcgcccctatctcggtgttgatttgtgtaggacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctyccaagcccgcaggtgagctgttaccttggaaaactctctggaaactgtatttaggacagttgtcctcacycgtgtgtaccgagcactgggagtctgagctgggagggtgtgcaaggaacagatgcagcggatcccaaaggcacccacggaaaatgggcagggtttagcacattccagttgaaggagaggaaggagttgggaatgatacctggtgtattagtttgctagggctgctataacagtaccataaactgggtggcttaaggaacacaaccttcttgcctcacagttctggaggctggaagtacaagatcaaggtgttggcgctgttggttcctgtgagggctgccagggagggtctgttccgcgcctctgtccttgacttgtcttcttgtgcatcctcacatcatcttccctctgtgtgcatctctgtccagatgtctcgtttgtataaggacattggattagggcccaccctaatgacctcactttaccttgatttcctttgcaaagactgtgcctccaaataaggtcacattctaagcaatggggtttagaaattcaacatgtgaatttagagggacacaagtcaacccaggacactgggtgactatgaraatggctgttctaatacactgtgctgcctcttggagctggagtaatactaaaggaagacaagatcttagcctgtcactgcaaatatttgctgacgagaagtagagctgatgggtcattatttttttaaaaaattcagcttaatgcaattttaaaattatatattttaaacatatcaggtgtaatttattatatttaatatattgtgtgtaatttattatatttaatatattgttggatgtaatttatattgtatataatgggtatatactatgtatttatataattagataaaatataattcatttaaaaattcatattgtttttgtaaatacccatatgaatattccactcatgcaggttatctcactgaaattaatttctgaccacacacttgaatgagatcctctttctttgatttaaaatgtaaactttaggccaggcacagtcgctctcacctgtaatcccagcactttgggaggatgaggcaggaggattgcttgagcccgggagttcaagaccagcctaggcagcatagcaagacctcgtctctattttttttaattaactaaataaaatgaaaatgttatatagctcatagtctgaaggattatgatttttttaaggattgtgtgttaaattttctaaccccaaagtacatcaactgattttattttaataatacataattacttccaaagcttagactctttcaaagtttcctgtaaggttattttggaactaaagatagattaaatttttaaatacttaacttgcctaatttttattgatcttataggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaaggtgaaatcacttttacttgctagatatacataaatttgtctttggacagcaccttaatggtcacactttttgtagtgaaatataaaacagatagttagctggtagagtagaggttgagattttcacctttcttgttctcagtattgcatttctttccattccatagacaaagatattggagtgataactgtaacaatacataataagcatgacactttacaggttttcaagatcctgtcacatgtattatctgatacttgcagatatcaaatgrtttgtacaaagaaatttgtgactggccagaattggggcccttcagatcttcttcactaccctggcatgagaccttaggtacttttgagggtttagctccacttgggagccgaagtgagggtggaggccaagctcctctgtctgcattagagaagaagcccaaacattttcccagtggttctaacagccaggacgccagargtgtttctgtggatggagctctatcattgtatttctgggcacagctcatctgtgttgactggtcctccagtccagggcattttgtcaaattacttttattagttaatactatttgtgttacacaagccaaaaatgacagaaagtcctatgacattcaagagagagcaaaagcatctttctttaggaagggcatggtagaactgtgtgcacctttcagttgggggctattcggttggtctgatgtacccacagttagatgtcattattatcacagaggtaagaagcaagagcaagcctcactcctactctggagcaccctgacttttagagtttcataccgctacagtgtagtatttctggaattttctacattcatgattggtagagtaggaaacatatatttccatggcagaaacgaaaaagagatgattcagatttcaaaataccaacttccaaatctatttcattgccctgcagaaatgactagatttggaagtattaatagttccccacttctttccttatggttcagtgttagatgctcagtctaaccaataaaatgattgagggacaccatttttttctaagcaacattaattattctccatgcctttcttttagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggtttgctgctttcccctctaatacaagctcgatccattttcttattagttgtgtttcatctttataaatatctaattaacttatgctggtatatcatcagacaaaaaagctgtcagtgctttctttatgttatttaaataaggattggatatgcataactcactgattcatatatatttacttgttatttttatttaattataggactaatctttagtctttaaatttttaatttatttttatttttattttttgtttttgaaacggtgttattgtcacccaggccatcatggctcactgcaaccttaaccttctaggctcaaacagccctcccacctcagcctccccagtaactgaggcagtcctcccacttyggcctcccagagtgctgggattacaggcatgggccaccgctcgtggcccccaaattgtttgtattcttttaattttttttttttttttggccaggcgcagtggctcacgcctgtaatcccagcactttgggaggccaaggcgggcagatcacgaggtcaagagattgagaccatcctggccaacatggtgaaacgctgtctctgctaaaaatacaaaaattagttgggcatggtggtgcgtgcctgtagtcctagctacttgggaggctaaggcaggagaattgcttgaacctgggaagtggaggttgcagtgagctgagatcacgccactgcactccagcctggcaaaagagtgagactctgtctcaaaaaaaatttattattattatttttttattttttttaggatatggggtctcactatgttgcctaggctggattcaaactcctgggctcaagcaatccttctgcctcagtctcctgagtagctgtgactacagatgtgcaccaccatgcccagcttttatattatttttaaaaatgtctatacacgtattctcttcatgaagatgccttttaggaattaaaatttctgatcatatacctgaatgagaccactcttctggcagtctctctgtattagtctgtttccctattaaatatttttcttcattttctcccaagggaggtttctcttgtagccttgtagtcagtgggatgaaatactatgagataattacttgaaatgattttcatatcccccaatctagagcctagataagcccaataacttagtaatttttttttaaattagaaaattgtaatttttttgtcaaagtaattcttgcacatgttgaaagctgagttgttcagaaggcttctctatgccatcgcaccaccttcattagtggtagctctgtgcctctcagtaatggccttaaaccactctttgttgattcattgactttagatattaactgttgatgtcctgcaaagacagatggggacttggctcattttcaccacccaccgcacctctcacgccttcttcactgtttttgtactcctacttataattttattactttttttttttttttaagagatggggtctcaccagcttgcccaggctggtgtcaaactcctgggctcaaatgatcctcccaccccagcctcccaaactgttgggattacaggtgtcagccactgcacccagactgtaattttaagttaatacctgcatgtctccacccttgctctttccattttcagcagcctctcgcccctttgtaagataagatgttgctgcctgtctccttcacgctaccttttctctcacattgtccagttataacatagctgttgcataactggcatcagttatctgtgctaagcatcaactctaattattgaaaaccaggagacctgttggcattagagtgactctttacagggccaagaggatgccctaaggacatctcctgtctctttcctccaacatcataaacctgtgcccctggaggaacacatttctagagtcaaacttgagtggaattctctgcactctatttcactggctcaaaatcatggcattttaaaattgacttcgttgttaatcctatctacctagaaaatatgtttttaacactttacttggcttgctaatttcatccttctttctttaccatctattcactcagagtcagtaactacaacacaaatgtactgagcaccttcaacatccaggccctgagctgaatgctggggaaggagtgggaagcaggatgtggtccctgctgtttgtaggctgcagggcagaagcttgcatccaagggtcctgagtgtatcctagagatgcgaccarttcacagttggattttaaagtggcgtcctatacatagctcatgagggttgggagatgaggattcatgaacagatttagacactgagtgattaatgacaatatgaaattatggatttttatagacttgacaatgtgcttgtttaaccattgaggccttctcttctgcctstacccaccacttacaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacgcagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattctcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttatgaatgaaaagaaacataaggagtgggtacaaagacttctatctatgaatgattaaaaaggctagagtacgaatacttcttgaacctttggtactaaatgcttttcatgttctatataaatgtagaaaacattttacaaatcctgtaaataaactgtttattttttatagaaagccacaacagaaaatgattagtatataactaactatgtaagaacacttacatccatacaatcaacagatgcttcaaatgcatattttaaaaatagttttgagtgttaattatgggagggccttgatgggatcattttgtgaacagttcgcttttataacaaactcaagaggcagcttgccagcgagctcttttagacataagcatttttatcaaactgttttgaagggtttgttgttttaaaatcttctccaccatgatactttgtccgagaagacatgacagatgtggccccgttgtatgtgtatctgaaaggtaaaacatagtttggtagattctattctacacatagggcaaacaaaaatgggaagaaactgtttcggcctgtctctgccaatatctaaatgtaaatcttcctctttcttagatagctttcttctctcctcttgccccaagaagtattttcagtgtcatttctgagtgggatggagaatctctgcagaagaaactcatgacttggtcatttgttcagttatcctcttacaaaaccatgttttaaaactcaccctcctggaagctaggagacttagtagaggccatcaacattcctgcctacctagaggaaaattatgatgaggccaacgtgaagaacatgtcctcatattcagacccttatttctacgttagaattttctttggaatatagtaatggtaaaactttaaaaaattaactgtactgctaaccttttccaattccggattttggaagtttctaagaatcatatgaactatctgtaatttgttccacatgtaatgatttatgatagcattctactttttaacaggtcatttttgtctctttttcatacctgggtgttttgttgttgtcagatattgaaaagcaaaatatgacaccaccaattatgcacagtgaggctcctgcccatccaataaacagagcggctcctaattcatacctgtgagaaagcattacacaagtattacagctcacttatttggagagtaaacagtatttaacactgatagtcaacatttactaaatgcttattatgtttttttgctattgaaaattgtaaaggaaataataacaccttgtgtctgtaaaatgctgtaaactcttcccaaagtgtttttatagccattagaccatcccaacatcctgaaaggagatgagggcatccacgggggcaaagtcaaagcaaaagtagtcacagccagggtctcctgactcagccagcacctttcctctgcacgctgccttaaccttgccaagctttccatctatttgttctgttctgcagcgcaaatcatttaggcagactgtagttagttagaaaacaaaaggttgcttttgctttcatgttagttcaatttagtaaatgtttattaagcacgtgctatgtgcaaatcgtcactaatcgctgcagtctagtggggaaatgaatcaatagctatcatttagtgataaattactattaaggatctcccatatggcaggtgacagtgctctgccgatgaccgcagcaggagcagatgcaaagataaacaagacagtacttcccctgggaaggccacgaaacaaaggtatgaacagtgctactgaggacaaaaaacaagatcacttgcagtagcggactagaggaaatcctttcaggggagatatattcacccagagaacaaggaatgagaaaagtacaccaaaatttcagggactatgtgtgttctcatgtttgtttagctttctccagaagaataggttgattttaggtttttgtttgtttgtttttataaagagtaactcttatttggggcccataaacttccattgcaaggcaaaagaaatcttggtgcttttcagtgtaaaataaagccagggtcggagggtctgttttgattgcacagaatccataggggagatgaggcaagaaagtaagaggtccaggagaaggcaagacagggcccagggttagttccttcctcagggtgcaggggagccaagttcaagagctgaggccaggcttcggtatcagatcaaggccacccagtgctgcctgggttcgtcctgagccttgctgcacccctgcctacttgaagtgtcactatctctgaactctggctctgcacatgggcaggctttctggtgtggtctgagtcgcaggcagggtggtgtaatagggtgggcccatcactagccaggggagcaggaagcagggcgtgcttttaatcaagcatgcatggtacctggcactggcatcctattttagtgaacctcagtattttaagacacatatcacattgatcagggacacggggcccacttgtgcattttcatttgggatggagttacgtgcacaagaaatgctgctctgtgaccctttctttactcactcttgtgttgcctttcctgggacatcagggtgactgatggggcaaggaacagctgcaacagaataactagggggaagcccctcctgccctggagcactaactgtgctttggcatctgagaaacttcagcgggttcccttaaggggcaatggcagagacagagggtttgtataagcgaggaaaaacaccctcagtctacacacacacacgaactgagcagcgaagtccacaggtgaaaaaagagctggctaaatcaggagtgctgaccgggagtttcagaaaagatactttcattaaatattgtgttacacacctgaaaaagatgccccggatttctgcaatcagccctgcttttatgttgttttaatgagattatgcacagacaacaagcagcatgcctgccaaactggaggtgcatgtcatttggcccctgaaacacctggaaatcctagaagatggcatcagatctgtctgttggcaccctttttactgcagacaactaaaggaatgagcataactgaaaaattctgcatgaagtacattattataggatgactataattgtataacgctttctatttttctctgtttttttcccagtacaggttaggctatcttctctcctgaaactataccttaatattactcttagtgtaaatatgccctgaaaacatggtctgagatttttctgaaaatattgagcttcactaaaatagaatgccagtgccagataccatggttgattacaaataaataaatatctaattattaatagtggccagttgggggatgaagatgatagaaatcataagcatagcttggcacaatgagttcactgaaaggagcattacaaacacagacacagtattgctacaaatcacaggataaattacccaggcggatgaggaattgggtctatgttaagccatattgaaactttctggagaaatttaggaatcatgagtttggcttatattaatatttaatatctttttaaatatatccttttttatgtatctttttcttttttgagatggaatctcactgtgtcacccaggctggagtgcagtggtgcaatcttagctcactgcaacctccacctcccgggttcaagcgattctcctgcctcagcctcccgagtagctgggattacagg

SEQ ID NO: 10883 - DNA, 18568 bp, Homo sapiens
  misc_feature (1)...(18568): n = A,T,C or G, or insertion/deletion polymorphism (see Tables 1-2)
ccgccaccacgcccggctaatttttgtatttttagtggagatggggtttcactgtgttagccaggatggtctcgatctcctgacctcgtgatctgcccgcctcggcctcccaaagtgctgggattacaggcgtgagccaccgcacccagctcgaggcactgtttcttgacatcccttctcccagcttctgaacacggccagcagcatcccaggaacatgttccttgtttatcaacctatctcagcccacaagacggtgtatgtctcacaagcagaggcccgatcaccactcccagatcaccagatgaaagcacactgaggctggggaatgtgtctacctcagcagcctaaggaactcccagagggcagaaagagcctgtggcagactcattttgtttttaaacaattttaataaaaaatttaaaagtaataccacattacgtgaagtttgaaactagagaatgaaaaagatcaccctaaatcccttcatcctgattcaaggtttttttgttgctgtctttcttccttccttccttccttcctttctttattttttgagacaaagttccactcttgttgcccaggctggagtaaaatggcgccatctctgctctctgcagcctccgcctcccgggttcaagcaattctcccacctcagtcttcctagtaactgggattacaggggcgcgccaccatgcctggctaatttttgcatttttagtagagacggggtttcaccatgttggccaggctggtctcgaactcctgacctcagatgatccacctgcctcggcctcccaaagtgctgggattacaggcgctagccaccatgcccggttgttgttgttttaagagacagggcttgctttattgcccaggctggagtgaaatagcgagatcataactcactgcagcctcgaattcctagcgagatcataactcactgcagcctcgaattccttgggctcaagcgatcctcccgccttagcctcctgagtagctgggactacgggaacatgccaccatgcccggctaatttatttttgttttttatagagatggtggttgggtggggggggggtctcattacgttgccaggctggtcttgaactcctggcctcaagcaatcctcccgcctcagcttcccaaagtgctgggattacaggcttgagccacagtgcccggcccaaggtctgtttttattttgttgaatttccataacctagtaaagtagatgctcaaatatcattcaaatgtggaatgaattaataaaaggcaacacatactgagcacttaattatgtgccaggaattgttttgagtgtttcatttcacatttactgacccatttaatatccacaacatgaggagggtattatcatgatcatcgccatcttcatttactttattttttccgaacaccagtgtcacttgccaattcttttagcaacgaggtaactgaagcacagagaggttcagtaacttgcttaaggttacacagctggtaactagaggagctgcgagttgaaccctggcagtctggtgccagaggatgttaccagtgctgctctattttggcttatcttaatcattaacgtatatgcaggtttagactttttattatgaacagttttaaacattaaaaaagtagagaaaatagcccaggcgtggtggctcatgcctgtaatcccagcactttgggaggccaaggtgggcagatcacttgaagtcaggagttcaaaaccagcctggccaacatggtgaaaccctgtctcaactaaaaatacaaaaattacctggatgtggtggcgtgcacctgtaatcccagccactcgggaggctgaggcaggaaaatctcttgaactagggaggcggaggttgcagtgagccgaaactgcaccactgtgctccagcctgggtgacagagtgagactctgtctcaaaaaaaaaaaaaaaaaaagtatagaaaataatataaggaacttcatgtcctcatcacacagcttccataattatcacctcatggctcatcttattatttccctatggttcccagtccagattatttcgaagcaaatgcaatcactgtatcatttcatccacagatattttagtatgtatgtatgtctgaaaggaggactttttttttttttttttttttgagacgaagtctctctctgtcacccggggtggagtacagtggtatgatctcggctcactgcaacctctgcctcccagtttcaagtaattctcctgcctcagcctcccgagtagctgggattacaggcacgtgccaccatgcctggctaatttttttctatttttagtagagacgggatttcaccatgctggccaggctggtctcaaactcctgaccttgtgatctgcctgcctcacctcccaaagtgctgggattacaggtgtgatccaccgcacccagccaaggaagactttttttttttttgagatgaagtttcactcttgtctcccaggctggagtgcaatggcacgatctcggctcactgcatcctccacctcctgggttcaagcgattctcctgcctcagcctctcaagtagctgggattataggcgcctgtcaccacgcctggctaatttttgtatttttagtagaggcggggtttcaccatgttggccaggctggtctcgaactcctgacctcaggtgatctgtctgcctgagcctcccaaagtgctgggattacaggcatgagctaccacgcccagccatggaggactttttaaattaaaaaaacaaccttaccacaattccatatcacgcctaaacatttagaattccttaatatcgttgaataccttgtcagtattcaaatttgcctgataacttaataaaatctttttttttttttttttttttttgagacagagccttgctcagtcacccaggctggagtgccaatggtgcaatcttggctcactacaacctctgcctcctgggttcaagcaattctcttgcttcagcctcctgagtagctgggattacaggcgcccatcaccacacccagctagtttttgtagttttagtagagacggagtttcaccacgttggccaggctggtgtcaaactcctgacctcaggtgatccgcctaccttggcctcccaaagtactggggttacaggcatgcgtgaccatgcccggccttttttttttttttttttttttttttttaaagtcagtttgcttgaatcaggatccaaataagacttttagttgatatatcatttaatttattttaatctgtaagtctctccccctcttttttttcctttttttttttttttttttttgagacaggatctcactctgctgcccagactggaatgcactggcacgatcacagctcactgcagccttgacctcccgggctcaattgatcctcccacctcagcctcctgagtagctgggactatagacacaccaccatgcccaactaatttttgtattttttgtagaccacggggttttaccatgttgtccaggttggtctcgaactcctggacacaagccttggcctctcaaagtgctgggattacaggcgtgagtcaccatacctggccccagttttatttgttaagggaattgggtgtttgtcctaattttcttcattctagactttgctgactatatccctggggaatgtatgttatgctattttgtgtcctcatcttttcatataacttagcaaacattccccatactgccacagggttttcacaatctgtcctaaatggcttcatactattccatccagtggatatactgtaatttttttcttgggcatttggttgctttcagtttttcactactataaatattgctggaatgaacatcctgacacattgcagcttttcctgtacatgggatgacttccttagaatatgctaccaaaagtgtaattatggctctgaggcaagaagaatttttcagcttcttggcacacagtgacaagtgtttgtccaagggtttgtatgtcccccagcacgaaataagagagctgtcactcactctgaatagtgcttagggctagtcacagctgaagaacgtttggggaagatatgataattatgagggccaagagagaaggagaaagatgacgacagggactcccgctaaataaagcagaaagtgatctgcaatttaccacaaacctagagtgagtcagaactctgttcattcctattgtgaaaaaaaaatcctcgataacaggagttattaatagtgcatgacatgttcagtaatctttctgttagactctgcattagtcagaaccttatttgagacgtggactcagtctgggtcactgaacttcatagagatgtcaggaaactgaccaagatccagagggatcgatcaacttgatggaggatgaagaatcccagagaaaaatcaaaggagtcaagcaggcacacttcggaaaaaacagagacaccttgcttgccttaatgctggggaggtttctgtgaaaagaacaacactgggtttgcttatgtctgcagaaagatgactataaggaaaggcacctccacaaaccaggagaaacttccacaggacataggcagagctatttcagactcagatgattatttcgatcttggaatgagcccttttggggccattggccctggaaatattgaagaagctgcctgttctgctctgggtggttcaaatacccacctgcctggtgaccactaagtgcctctgggggtcccactccagctgtgtgacaactgtttcctggcagccccctggggaaggaaaggtaggtgtagtccgagtaaagtgctccgcagtttccctgggctagccttttccttcctgttccctcactttcagttcagggtgccatgaactgccattcagagtcaggttggcatgccatgacatcatctgaccttgctattccagccctgccctgcatagagtggacttagaaagaagctgggtaaggagttgaaactacccagacaagacctcttggtgacatggagaatgggagtaaccgaggagacctcaagagccatttagttcaacctcctacagtaatattaagtagattcctacaatgcaacaggtgctttacatacattcttttgggttcccacaaccttggaggtggggtttcacaggtgtggaattggagattaagacaagtaatttgcccagggtcacactgccaataaaggagggcctaccccatgtctaccaggcagtaaagtctgtgcccttgcctttagacgatgcagatgtgaaaactgcagaccagagcctctcattcaaagccacacaagctgacctgagacagaaactcaggctccttactactgatggaggaatctatgatacgtagcctcttctcacgtcaggtgcggggcggccaaggatgtggcccggtccggggcagcctgggccaagcgtgactgagaaggagaaggcaggctccgttccgggccctccagaccctcatcccggccaatgttgtgaaaagcgctctcccaggagggcccagcagggcaaagggccgggctagtctgtttctggaggagccaatctggggccagggcggaggcagccaggtgcagtggaaaaatcctgcagttggggtcagaatatttgggtttcgatccagtctaggacccagcaaagacctacagaaagttacttacaagtccgagtctcctcatctgcaaaactggggcacggataaaatacacttgaagggcacagaagcaaaagttggaattgttacgcaccaaaattctatcatccgatctgaccatcacgtcacggtacaacttccaaccgtgcgtccccgaagaggccgggaacggagcccaggaaaaactacaactcccaggaggcgtcgggagggccggcccggagccagcggaagaaactacaactcccagaaggcgtcgggcgtgccggcgcggggcggtgacgtacggggaccggcgcggagcgctgattcggccggagctgccagcggggaggctgcagccgcgggttgttacagctgctggagcagcagcggcccccgctcccgggaaccgttcccgggccgttgatcttcggccccacacggtgagcccggaaggaaccaagaggccccagggctacgggaggggcgggagagaaggtgggggctgctggggaggcgccccgggctggagagacgggggcagagggagtggggggtggagggagtgcatcagccgagggggtgcatcggctggggaggtggccaaggaataaagtgcgagcgggaggccgggggtggaacgtcgggaggagcgcctcggctaggggtgggaggcggggagcggctcggcttcggggataaacgtttggctgcctccagggctgggtgaacgcgtggagatggctgtggggtcccggaccggaccgggttccgagtgcgaagacccaggctggggaacagagcgggacccctccccmcggccccgcacccgaggtctcactcagaaaaccccaacaacagtgaggactccgcctcttcgctcctcctctcctgtgcttagtgcgggttcgcctgggcactcgctttccgctcctaccgccctcccccagtcggggtggctgggccaaagttgagaggttatcagctgtggtcctgcagcttggggggtgggcggaatggacatggcattgtgacgtgctgccccggactccccgttggggtccccatccaggcctggatgttttgtgctcctcttccagaagacaggaggtttgctgttgtgagggctgctctttcctgggggagggaatgggaagggctcacctggtggctgccctggtggtgctcagccttggcttgagtgtctggcatactggctgggcccggatatttgtatgtggagccaagagggtggggcgggaaggagggggaaagagctaccagcaaaaaagtggttaacacaacagagttgctgcaggctctggtttgaggcaggttatgaaaccacrtcagggcccagcactaagcagccrcctgccagctatggcagcagaagttttcggctcaactcctgtagacctagtcgacctctgccagcctcttctctctgtttctccccatctagggtaggggccagttggttgttttactaatggaagtgatatgtatccatagtcacacgaaagtctcaagagtgtttcctcattgccagtctttttgttagtttattgatctcttctttttcaggggtctctggtggtttcctgctctcagggcacctagtgtttaggcttcaggaagaagcttctgagggtgttggctaggacctaggtctaggcttttcctaggctcatcaagttttgttggctgccctgtgaaagccagaaaggcgtatggggtcctgtgatctgggattccccaaggcttttggcactcctggacaaatactaggaagggttagtggactttctataccagcacccctgtaggtgcgggttacagagaggtgatggggtggcagtttcaggtcagacttgggaagctctttccctctccttagtcagagttaagtccttcagagccctcacttgtcagccacatgccgccctcccctctcaggtggaggcttttgcgtagcagctgtcccaggggctgctagagtaactgaagccccaaggccctgggaagataaacaatctgagccagctctggctttctagatacttgaatttctgttaggctcaattatccagcctagtgggctgcgctgatgggtcccaggagcatctcttcaatcagaatgcgccccaggctggcgcacgggtgtttgcttgttgggatggcgtgttgtgggtcacattttctctgaggtctctaagcttggagctgtctgagaagaggaaacttgctcctgttatcctggaagtaaataactggcccctgaggactcagtctcctgtgcaggtttggctaggatcctagtcagagatagatagcatctgggtctgacggggttgctgcaggggcgtgagggaggtggccttctgggtacttctagaatatctccatctgggactcttttctgcattcccaggaaagatggggctgttaccatggtgatgaccttacggtctttagcaagcaggaccctatctcagatagggaggtgagccagtacacaggtgccatctgtctccactttctcctggtcacagggccctcagggatctggggacagccaaactctggataaggggcagatcattccaccccttccttctctacttccctctgctcactgtgggttgcggccacctcctggttcctcctgctgcaggactcctaccgttggtgctgggcaggggaaggcatggtgctaatatacacctggaaacaggtgctgagaggggagactgaggtgaggatgggcaggacagagaagaacgggggcaggagggaggccacaggttcgagtctgtgcccttaggagacatatgttgaggtggattccagctctctatgggagttacaggtgttggccacgttctctatcctcgcctctcttgtggggaaaagggccctggtggtttggcagtggagtgggtagcatcacaagggttggcctgagtggctgccaaatggagaaaacatccggatgggttgttttgtgtcacccaggaggggtgccttctaggtctgggcaaaggttgtccctagtctgttgttttctcctttcttcctcccttcctccctccccacttccctctttctacctgatcagtcctcctaagttggggtttggggagatccagaattgaaaaaatcagaggaggtgagtggatgcagtgacctcaaaatagttcatccactgctgcctgtacccacaggcctcacttcctttccctcctgatgggaagagcttaagagyagatgtcccacattaggccttcagtgagacacagtccagcaggggtngtgctgagtgagaattctctccctggggctttgtcggcagagggtcctcatgggagtgccatagggggtgaggctgggggatgggccttgacttctctgccctggggctgcgtgcctcttgatgacctgtcctccgatgccctgccagggccctgtcccaatgggatgatgcatggggcagcctgttgtttatcccagcccagcagcaggaaatgagtagagctaagtccacatggactttctccactttccatgcttcagaatcaaaagagtggaactgcctggagttctcagggaaacaagggcctgcctcccagcgggatccgagggtgagagggggcagggaaagcagtgtgacctgtctgacctgtgctgcttgtttgcagaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatggtgagagcctgtctgctgcctgcccctgcccctgcccctgccctgtgggctgccctttggcagggctgagggataggaggagcctgtcgggcctggcccaggtgtcagggtgatgtactgacgacatctgcctccagagcccaggcctagcccttacctctctgccttgctcccccttctgggttcctgccctgtgtaccatgacaggaatcaaatctgcagatttttccacatctctagggtggggtggctgttggcctggaagatgtgctcctgagagctgaacaaagggctccagagagttcccaggacccgagagtcctggtgcctaggctgatacagaaatgcccctttctcaagttagcttctcgaaccgtcttccacttttgcccttctctgctccctcaccacttgctaccttgcactctttgtcgggtaagcagggcttagtcccatcgcttgcctcctcccaacaggcacagggggctatgagtggcctggaggggggcagcatctcggtgcctatcttgtggccaacttccaccgtgcattctcatgccaggcctagcccgtcccccagggagtccccttgttcttctcctgccatactcccagctgctccatcctgacctccagcccatatccccctgcccagcagagggaggctccagatcactgggagttacttgtgtctgtgactgggtggaggagctgggcaggggggcctttcccttttgtatcctctaacaaagacttcttcctccagggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtgagtgcctgggctacaggaagacaccagcaggcagggcaaggcctggaggaccccagggcccagccatgcttattaaccctgccgtggctcctggtgtrgggatgaacagaggaagttggaatattcctgggtcttacactggactcaggctttgggcctccctggccccatctttcctccattggagcttccttcctgctagtgagataggcctacaggcttggggtgaagctgggaggtgggggcggtactgggccaggaggggcccctttagcctgagagctcttgcttcttacgctggtctgggaacctcttctgtaactccttagctgttgggattctgcctttcccctcccaggaagtgagggaggaaggggtcctcccaacagtcttttatatctctccccacccttcccctcccaggtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaargcaygtgctgcaacactgaagacagaaagaagaagcctctggacactgccagagatgggggttgagcctctggcctaatttcccccctygcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctyttccaggggtccaagggaacnggagaggtcactgggcctgttttctccctcctgacccygcatctcccacccygtgtatcatagggaactttcaccttaaaatctttctaagcaaagtgtgaataggatttttactccctttgtacagtattctgagaaacgcaaataaaagggcaacatgtttctgtttccctgtgtctggccttcgcttcctggaaggctgaggggagggggcaggggtgtgggcagcggctcccgctgaggtgctggtggggcatcagtgcagctctgacggtggcaggaggggcgctgggactgctgggctttctgctggcttcagcagggaaatcccccaagggggctgtgagggaactggcggcggcagcggtagtcagagagcaaaattctctgtgcttttgcctggctgttctccgacaggtcttgcgccttggccccagaggctggggtgacctgtgccatggccaaggagggggacactccagcaatggtttacacgtggagccagggtcccaagtggtgctcagtccttcccagtgaatccccagcccttctccagtttctcacttctctccccaaggcctttccccagtcacctctcccttgggagcgctgcgtttccttctggcctttcagtggaggggacttttcatacttcctcctcccaccataagcctgagtggcaggggaagaggttctggggactttctgaggccaacatggctaggagagagaggagtcctatagcaaggaatccttatctcacgagggcactgaccttccagcgtgttctggggagtatcagctgctattcccaggagaggcacaaagtcccaggtagaagggaggagctgtccccagcagcctggggtctctagccccggtccaccatcacagcacccttggagtgagtgtcagggagtgtgggatatttgcccaagtccagccaccacccctgtccgagtagagcccacacagtattggaaagagaaatatagccactgctttcactcctgggagtaggggtgccctggttgctttcaccagcctgcaagagtatagtcagggtgaggtgctggagaacatcaacaacgatctgggttcaaatcccagctttgccacttattagccatgttgctgtgtcaacttctctgagcttcagtttattccactgttgtgtaaagataatgcctcttagggctgttgtgagcattagcacagtgcctggcatatagtaaatactcaatatatggtagccatattattataattgtaattgttactaccaccactgtcgtctatttatttatttatttatttatttttttgcgactgagtcttgctctgttgcccaggctggagtgcagtggcaccatcttggctcactgcaacctccgcctcccaggttcaagcaattctcatgcctcagcctcctgagtagctgggattacaggtgtgtgccaaaacatctggctaattttttttttttttttttttttggtagagacggggtttcgccatgttggccaggctggtcttgaactcctggcctcaagtgatctgcctgcttcggcctctgaaagtgttgggattacaggcatgaaccaccacgcctggcctgtcatcccttcaaatgttctttcagaactgaggcatgcagaggctggaagacaggctgggctcaccggggtggttatctctgagagaggacatgggtgaggtcagaggcctctccctggagaaggaggtaggtggagaagccagatggcatccagataaggaagaccagcatctccttgagagtgtacacgggagcacgagatggggagggaggctgagtgctccttacaggcccaccctgttgcctccaggtgttagctgctgttgtcctgggtcttcagtgttgaccgtcgcatggcatttgggcagctggttctgctgggttatggtcctcatgtccctggcacagacacagccattgcctgctggcacttgatacctactcatattccatttctctattccaaacacactggattgcatggcccagggcgccacggtgtgcaccattgtctggcccacactcacctagaatacataccaggatctcctacccactccttaggtacaagaagaagaaggggttctggccgggcatggtggctcacacctgtaatcccagcactttgagaggccgaggtgggtgggtcacaaggtcaggagattgagaccatcctggctaacacggtgaaaccccgtctctactaaaaaacacacacaaaaaaattagctgggcgtggtggcaggcacctgtagtcccagctactcgggaggctgaggcaggagaatggcgtgaacttgggaggcggagcttgcagtgagccgagattgcgccattgcactccagcctcggcgatagagcaagactccgtctcaaaaaaaaaaaaaaaaggggggttctggccttaatctgcctccagctcagttataaggtggcttatctaaaggcttgggaggtggggcacccagccctacccacccgtccaggaagttccacacctggacaactttcagtttcattattttagcttcctgagattcagaggccaggaactgtgcagagatctgtggggattctcacaacttccatttctggtgaacagctgaggtcagagaggaggtgggtaccacttgagatgggcctgtggttcccgggtactgtctttccagacacctagaattcccaggttggtagtgaactgagagtcaaccaccatgatggggccagagacagaggaggaagcagtgagtggataagtgcctgtgctgggcagaagggatataggggaaggtggccaaaggtaggatggggaagtggatcccaggaagcttttgtttcttctgaggccaatttaccaccacctcattgggaaattgttggtagggaggcacccatccaattgccttgcagaatacagcaaggcagggagcccaagaatcagagccaagggaagaaacgaccagttgaggttagtaatgtgaagtctggcaaccgtgcccgtcattcctccctggttcctctgttcatcaacgttggggctagtctggctggggcatggtgggcctgcctttccatcccttgggccccttggaacaagggggcaactctgctgtgggagatgtagaaaatgggtctcactttctctatttggggcaatagctgctacttttttcctccagatgggtaccatgaggggcagaggagaatctgggatctgtgatgtttagccctctttactgagtcatggctgcctcacgttctagaagtaaggcaggcaaatcattccaggtactgattgtcctggaacctttggctcttccttgacctcatgtcacgtgcgtccatgtgaagagagtccacgaaacgggctttatatgagcaacaaggctgggtgcaggcaagctgagtccaaaaaaggggtcagcaaagggtggtggcattatcattagttcttatatgtttgggataggcttacaaagtacattctcaagggtggagaaatattacaaagtaccttcttaagggcaggggagaatattacaaagtaccttcttaagggcggcggcggggagactatattgtatcagggtggggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcagtataaggtagatgacaggtggccagccaggaggccttgaccgtttgtactccatctccttctcaattccccattgttatcaaccaatcaacaacgaaactgtgggatttgtacacatccacacaccttaatttaagaaatgcacggaagagctgcatggtgggaggagagtgggagaagtggagatttatttccactggaaaccgttcctaaatggtcttccttttccattttttcccttgtaaaataatctgcttttaatttagcgagctcttctcatgtgtttatcatttaaatgaataagtaaatgagggcagtttgcttactggttaagaaaggatgcaggctttagggctggaagcacctggtttcaaagcctggctctgcctcttatcagctgcgtaacctttggacaagttgttttattgctctaagtttcagtttcctcctgtgtcaactctagaggactgttgtaagaatcaagtgagggatgggtgcggtggctcactcctgtaatcccagcactttgggaggccgaggtgggcggatcacgaggtcaggagatcgagaccatcctggctaacacagtgaaaccccgtctctgcttaaaaaaaaaaaatacaaaaaattagccaggcgtggtggcatgcgcctgtagtcctggctactcaggaggctgaggcaagagaattgcttgaacccgggaggtgcaggttgccgtgagctgagatcacgccactgcactccagcctgggagacaaagcaagcctctgtctcaaaaaaaaaaaaaaaaaaaaaaatcaaatgagaacaaattacgtgaatcatttatcacagtgcctgccacaaaaggagcacccaataaaagttatctcccaggtcggtggtgattcttattatcctttcatgttccttggctatcaagactgaaagggaagtttctgatgagcagaaatccctaaggtattgagggaatttatggaagagtcaattattccaaccccctgcctctgatctcagttattcctggggtacttgggtttcagaagccccagggttaagtgttgaactctcacttggagcccacactggaatatggtgaggagttcattatatttcataatgtgaaaaaatatttcataatatgaacaatagcaaggagctcatagctcagacctctctgatacagtccatttctttttatgaggtctcatgccaagagacggaaaagagctctaacagccctgagcagctttagagtattacagtgtgccaggaactgctttaagtgaccaagagcagtacccagattacttggaggtggtggacctttccacaagcagagtttcgttaagcaagcaaggggcttttggagaaatttcagattcgcatctttcaaagactgagtcaattctctgaaaagtaaattgctaagagccaatttgctaaaagtcagctctcaaaaaaaaaaaaaatcagtttgccaaatgatcaattcactgaaaatggaaaaatactttaacccagaactaggatgttttgccacaataatattactccccagggacagggcaaagtttaagtctgggaaaaaaaaattgactaagtcagtcaacttcctttaaggaaaagctcatctgtgtgcatacaaaattcggaggcagaggtgaaaccaaacttaaaaagaaaatccttacaatgatgggaattggtaatttgaattgatttttagcttggtctgctccctatttaaatgggttattttgtaactgtataatgctgatggtgcagttaaagtgtgcatagggctgggcacagtggctcgcgcctgtaatcccagcactttgggagactgaggcgggtggatcacttgaggtcaggagttcaagtctggcctggccaacatggcgaaaccctgtctctactaaaaatacaaaaattagctgggcatgatggcgcatgcctgtaatcccagcactttgggaggctgaggcgggcggatcacttgaggccaggagttcgagaccagcctggccaacatg

SEQ ID NO: 10884 - DNA, 29745 bp, Homo sapiens
tgtgtccaaatgggttctaaattctacagactcatcaacatgaggcaagaagtcattgaaaaccacttttgtctcctttgggagaatgacatatctttagtatttatgtagcttattcttctatatctacatatgcaaagctttccttaacagtaaagggtacatatgcatagtgggagaagatcagacctttacgagtgaaggaaagcaacttcagaaatgaattattttctttgctttattatttttaccaagacagtgaagtattgtatggggagataatctattttcataatcaatatgtgcctaaattatatttaaattatttcactctgtactatatttttaggaattatagaatgtgttattcattcacttaaaggtacttctgtagaaataacctaaaactgcagaaggatctgaaagatctaaacatgttgtgcttagaaactgcagattttagatctaatgtataaatgatataaagtgttttaaaaaaagaatatttttaaaagaacaagatcatgtccttttcagggacatggatgaagctggaggccattatccttagcaaactaacacaggaacagaaaatgaaatattgttctcacttataagtgggagctaaatgatgagaacacatggacacacagaggggaacaacacacactggggcctatcgaagggtggagggtgggaggagagagagggtcaggaaaaataactaatggatattaggcttaatatgtgggtgatgaaataatctgtacaacaaacccccatgagatgagtttacctatgtaacaaacctacacatgtacccctgaacttaaaacaaaaaataatcttttaaaaatgttcatgttcaattcaaatcctagagtttcatccaaaatagcaggcacagtgtttgtttgtttgtttgttttcccttgggacagggtctcgctctgttgcccagactggagtgcagtggtgcagtcatagctcactgcatccttgaactcctgggctcaagcaattgtcttgcctaagccccccagtaggtgggaccacaggcacatgtaccacacccagctaatatttttattttttgtggaggcagagtctatgttgcccaggctgatcctgagctcccagcctgaagcaatccgctcaccttggcctcccaaagcgctgggtgaaatttttttaaagggaggtacaaaattgaatacagtattatatcaattatataaatgtgcatatgcacagagaaaaaaactagaaagaaatacaaccaaattgaataatttttgcctttttgtggggaagatatcatagattactgtaattttattattaatatgtttctgtattttcaacatcaaatatgtatttatttgataagttttttatctaatacatattcagaaaaatttaaatatataaacaggctgaatctaacttgagtaaatttaacagcccttaatacaaagctctgaatttttgtttttcaaaaaagttacaaggatgatataacttagcagaagcaaagctaagaacttttgtttattcttaaccccagtaagttaactgagcagtatagatgtttacaacaaatgcacaggggatgtgatgaattctccttgttctgtgctacccagcccagtgctgaagtactgatctgtatgggaccctgaaggatccagatatactggcatatgtctagcagaggtgaccaggaagaggagggacctagaaactttggtatgtgagggataattttggctgggagaggagaggaacagatacatggaaagcatgatagacgtctccaggcttttgaagggcacaggcaagaagagctgattgtgttctgcatgaccccggaatgaagaactggagctatagggagaagctacagaaggtagagtcagctccatgtaaggaaaaaacctgttcaaggtgagaagtccaccttttaaggagtgagtcatccatgtgtgtaggtatgcaaagagggtctgcatcagggatatgaaggaaaggaatgggaatgaccagaggagagaacaagagagtgagacaaacacagagggagaaaggaagggaggaaaaagagaagcagagggacaagaaaggaagagaagaggtgagacagaagaagctattctcggccgggcgcggtggctcacgcctgtaataccaacactttgggaggctgaggcaggggatcacgaggtcaggagttcaagagcagcccgaccaacatggtgaagccccatctctactaaaaatacaaaaattagccgggcatggtgatgcacgcctgtaatcccagctactcaggaggctgaggcaggagaattgcttgaatccgggaggcagaggttgcagttagccgagatcgcgccactacactccagcctgggtgacagagcgagactctgtctccaaaaaaaaaaaaaaaaaaaaaaaaagaagccattccccagagtacagggcgagtcactgcaaacagtatggaatctgactcgccttttcaggtctttgttagtgttatcctgaaacaccagcagatggagatattaccccaggaaaggaggactttgcttttctccctctccttttgccctctggaaaaccattttccttctctgaaaaatgatactaaaagagaactccaggtgtctctgaattatttccaaactaaatttccaaaaaaaattatgtggtaaattttgcctgtgattatccacgatttgaatataaaagaggccacctggccaggtgtggtggctcacgcctgtaatcccaacacctagggaggctgaggcaggtggatcacttgaggtcaggggttcgagaccagcctggccaacatggtgaaaccctgtctctaacaaaactacaaaaattagccgggcgtggtggtgggcacctgtaatcctggctactcaggaggctgaggcaggagaactgcttggacccaggaggcggaggttgcagtgagcccagatcacaccactgcactccagcctgggcgacaagagtgagactccgcctcaaaaaaataaataaataattaaataaaataaaaaaataaaagaggccactataggtttttgcattttggttaatgcctatgtagggctccctccatcctgccccatcccacctccatcctgccccatcccagttacacaggcacgtatgtatatgtacatggtgtgtataggtgtgtcttttgaataactgttaaataattaaacaacacaggggtatactatgatccccttcccagctgcctgaccatcaacactttgcttccatggatagaatctccgtcatttggaattcttgcctgtggtaattctaggagtttttgcttcagtgggtgtgttgtactcttcactctttgtcctcgctacaaaacagtcaatccaggggacttgcacataatctgtctgactggcaaatatgtgccttaaaggggaatcagtccggtataacagtgattcctaaacttcaagtgcacatgaatcacctgcagatcctgttgcagaagatttgatagggttggagatcctatatttctaacaagttcccaggtgctgtcgaggctgctgtttccatggaccacactttgagtaacaaggccatacaatgtgttcctatatcatgagtaacaaggccatataatgtgttcctatatcacaagatacttctcttaagaactatacttggctcattgtagccactgttatcttggtcacctttaactttgatttaactgttcatattttcattcaaccaaaaaacatttatagagtctgttatgtgtaaaccctatgctagttgatttcaaccaatattaccaaacatctttgagttccagtccctgtgctaggcttccaagattagtgataattcaggcccattctttgccctgtcattcattaattcattccatatttattgagggtctagtatgttcaggatttggagataaagcagtgatcaaaacaaacataaatttgtttattaacctccaaagtgtttattgtgaaccccaagtaagtttagtgaggaaacaatcaatgggtgagacaatcacacaattaagctcttctttcttcatccttctttcttctttcttcttcttcccttttcctttcctgaacaattcaatccaaaatcatgaggtggggtcaagcaaggtagccttctaagggaggaaaggctatgagagctaaatgcaacacatgattcttgacaggacatttttgctataaaaacatgattgggccagctgcaatggctcacgcctgtaatcccagaactttgggaggccaaggtgggaggatcacttgagcccaggagtctgagaccagccctggcaacacagtgagacctagtctctacaaaaaatttttttaattaagaaaaaacaaaacaaaactgagtgtggtggcacacacttgtattcccaggttgtggtgagaggatcacttgagcctggaaggtcaaggctgcagtgagccctggttgcaacactgcactccagcctgggtgacagagtgagaccctgtctcaaaaaacaaactaacaacaaacgttgggacaatgggtgaacttaaatgggatgtgaggattacatggtggtaatgtaccagtgctaatttcctgattcttttctgtttaatttttttttttttttttgtcgcccaggctagagtgcagtggcaccatcacagctcactgcagcctctgcctcctaggctcaagcaatcctcccacctcagcctcccgagtagctgggacgacacgcgtgcgccaccacacatggctaatattattttttgtagagacagggtcttgttatgttgcccagcctggtctcaaactcctggaatcaagggatagaactgcctctccctcccaaagtgctgggattgcaggcgtgaaccactgcgcccggcaatttgctgattctgatggctgtgttgttatttagggaatgtctgtaggaaatactatagtcttcagggttgaaagggtatcaggttgacaacttactctaaatggttcagggcaaaaacatttcttgcagtgtttctttacgtttgagattgggtaattagaaaagcgtgacaagtgctcaggcaaaggggcatgcaggctttagggttattcctaggatcctgggtgttggaggcgggtgttgagggtgtgtggaaggaaaagagtcttgaaagaaggtgatttggaagacagaggggagtcaaccggagttcttgcccttcaatagtacgcatctttgggcaaagggggcctcggccagcgtccatgcttaaaggccctgctttcgccttctttctgctctgaaaactccccgtgcagaagaagggttgaatccgcagtgaaaaagggacatgtccatcagctcggactccctcttctattccagtccagaatctcctgcccaaaggctccggggttggctgggcttctgttccatcacctcagtgttgattgggccacaggtgtgcacgccacagcccatggcggggagctgtttgtcggactgtggacaaagtttgtacctagagctggatgtccacgtgggtgggtgggaagccctagagaggggcggctattcgccagcggccacatttagttggggctcaagcagttcctgtcagagaattctaaatttgaacttggtccttcaggtcttgggaagatgagtttgtcacggtaggagagagagacgacactctctttagaaggtgctgagccggaagaaggctcatagcaagcttaggctgaagcctttggcgcctcgggctctggacctacaaaacccagagtgcacgcgagcgctgagccaatcaggtgctgcgcctcggccagtcaagcgggtgtgtggcaccttgtgggcggagaccacgcctctctacgcggggggcggggacacgcggctcgcgcgctgtgggcggtgcccggcggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactgggtaaagactgcggagctggagcagtgctcctctaaccctctccccttccgtctcggtacctcagctgtcctctcgccctccgttgggcttctccccagcggggccgggacccctctagtctccaccactcccctgggctctgtcagggctcccctgtccgtctttctgtcactacctcccagccagattgggacatcccactcacccgctccccagagctgtgtccaggaccctgctgaccccctcacccaccaggtctcccacctcccccatttccctctcttcactgggcaggggttccttctgtcactttaggtatgtaccaggcctctgctgtcagcctccttccgcgagacattccctcctgtcacagcccctccccagggttctcccacctccctacctyctcttctcagctggccccggatctcctccagttccctttgggtcaggacccgagcttccttgccatccccattctgrcactccctcccagtgacagtctagtsccaccgtacattgtgtggtacattgtgtggccttctgctctcatctcattcttgggctgcactcttacagtccagttctccaacgggaagctacagagtccaggcaacatgcgctttaccttgtatgagaacaaagattccaccaaccccaggaagaggaatcaacggatcctggtaagtgaagcagttgccagctgtctccactctgcagggctcagaaggcccctgggagtgggtggatgtgggagggagtgaggggagaaaaaggggagtagtagcaaatggasctttgaagaactctgatgcccagcagcctgggatgtggggacaggctccatctttcattcatttgttctttcaacaagcatttatggaacctgcccctctgcatccctgtgctgcaagcttctaggaaaacagccaaatcaggcctagccccactcagagttcatactctagagcagggtttctcaacctcaggactattgactttttgrgccaataattctttgctgtgggggcagcatccctagtctctactcattagatgccagtagcaccagagtggatttccctggattgagaacctctgctctagagagatgagaactggctgtgagggacacttttacacaaagctctgaggccacgtggggaagagtacagggcagagtgagctcagtgggaggagaggtctctgccagaatgccttccttggtgaggtcatgttggagctgagccttgaaggctggaatgagggtttggcagtcaacgtttggtgtttcgagtgaaaaggatagtgaggacaaatgcagagaagcaggaaagcttgcttatgattggggagtgaatcagccatggtcctgagagtatacaaagaacaggccaaagagagattgcttacagaatcactttgttgcatacctttaagtgccagaagcccagggcctctctctcaagtcttgtggcagaattcccccaagagcttttcataccatttagaagctagcaccatctgaggyttctcttccagaagtygtcttgcttcccctgcagggacaccccatattcccttagagatagtggggctggatcatctgccagagatgaactagttctaatccattgtgagtctggattcaaaagcctcagcaaatgtagaaaagagaaatgatgcttaatacctttcaacattggttgtaaatggagtttcccctctctgcattttaggcagctgaaacagataggctctcctatgtgggaaacaatttygggactggagccctcaaatgcaacactttgtgcaggtaatggcaggggaagggacagtgggaagggtgatggggttgggagtggtggcagcactggcactgctgtttyctgtctgttttaagggtagsaggagccatctagagaggtttactaggtgatccctgtgttcctattagacccagagcccttccctgcacgtgtagacgttgctggaaaggaaagataacttgaatttcctaaaaacctcattcatttgtaatcttgtttatttatagctgtcttattccaaaaggcaggtctctccattaatttggaatgtgtgactagtaggtcaaagcttgcgtgaagtttacctgggaactaacgacaggtaaagaacttggtagtgttgaaggctctggactgggaaagaggagcctgggattcccatccagctgtgctgctgattgactgagtggctgggtaactctgcgcatcactgacccccagcctccccctctgtacagtgaagattgtccagcctgaactgtatcactctcgggggctggcatgatgcagacagggccctgtgatggtacccaacaatgaactacaaactaggccctttctgagccccggtggaccatactccaatagaggagaggtcagatgggtgtataggtgctgagaactattaaccctgcactctcccctctcagagatgccctagttccaattggtctcctccccgtttacttgattttgcctccataaaactgttgtgccataaattgtagtgtaattctaggttcgtacaccccaaaagagttttccattacactacmgcagtgagcccaaatgtgatcaactatcagaatcacctagtagcttttttttttttcccagaaccacctcatatcctcccatcccatcctatcctttcctattccctctctatgcagagaattgctgtggggtaggggtaggggagattattgttacccatgagtagatgatgcattcctcaggtgtgtgggcagagagaaggttgagaacttttgaacaggaaacagggccaggtgcagtggctcacgcctgtaatcccagcactttgggaggctgatagggtcagatcacctgaggtcaggagttcgagaccagcctggacaacatggtgaaacccrtctytattaaaaatrcaaaaattagccggggatggtggcgwgcgcctstaatcccagctactcagcaggctgagacaggagaattgcttgaacccgggaggtggaggttgcagtgagccgagatcatgccactccactccagcctgggtgacagcaagactctgtctcaaaaaaaaaaaaaagaaagctgtacraataatgcttttgaataatccattgttatttgtattattycttctttattcaggcactttgtgggaattttgaacaagacctctggccaaatggaagtatatgatgctgaattgttcaayatgcagccactattttcaggtaggtcccagtcatgaaagctgacagaaataatgcatagtttgggtttgctggatgagttggcttgagttttagatttataaaacacattttatagttattttaatttatttattctgttttttctgctttgtctgtgttgagaaaatggttttttatatacacactgttttttgttttttgttttttttgagatgcagtcccactctgtcacccaggctagagtgcagtggtgtgatattggctcgctgcaacttccacctcccgggttcaagtgattctcctacctcagcctcccgagtagctgggattacaggtgcacatcaccacacccggctaatttttgtatttttaatagagacagcgttttaccatgttggccaggctggtctcaaactcttgacctcaggtgatccacctgcctcggcctcccaaagtgctaggattacaggcgctagccactgcgcccggcctagagttttttattcagcacacacttattgataacctaatgtaccaggcaccaagctggggctgtggatgtggcagtaagcaagacagacacagatcctgtccccatagtgtttagagacttgaggtcagaggttcataaaagcaatctgagcaatgatcagagcagaatattagaggacatgtctgatataaaatcttttccataaaagaacttccttcattctttttatttttattttttatttttgtaaattactttatttcttccttgatcatttcaagggactatcttcaaaccagtacaaatatttcatacgtaatacctggccattttctaaacaatcgaggagtttgttgcacaataagctacctcacgtctttcagcaagaaatacattaaatttgaagagtaaagacattacataatgaactaggacataattaaaatttgccttaaatatttctttgggggagagaacaccacacttctactcaatgaagagaaacatttttacagtccagaggtctttcattttttaaacacctgtcacgccatgaattcatagggaataggttccagcagctcaggctgcttcccattggttctcaccaagtgtgcttctctgggtggagcaggctggcgcttcagttgaacccaggtacctttctcttttgcttctgtctttttctaatcatctttcttcacccgtttcatgaagctttctcggctcttagagtgcttaatgtgctcaatacgcacactaattctcttggcaagaatcttgcccttgtttgtttacaacaatgccagcagcatgctaaactgtagacgcttccagtttagccatggtaacacttgaggggcattcctttttgaacagtacccattcccttgatgtctacgatatcacctttcttatagattcacatatatgtggccaaaggaacaactccatgttttctaaaaggtctagagaacatatattgggtgcctctcctctttccctttgtgtttgtcattttgatgaattactgcaagatggcagttctggccgaaagggttctttcttaattcttaactgttatagttggggtaaagaggttttagaatttctggtagacaaaggaaattgcttattaagttgtatagtaactttcaygttgaggacaagtctctacactaatttgaggaagatctattttttttccctaatccagtggaagaatttacattgtttctctgctttgtcatcttagaatgctcagggctagagtgagatcttccaaaataataaataaragggtcacactcaaggggcttctgttccttaaatctcagaacttgaatccttagtgatgcccttaaatactgggaaccatggcaggatagggcgatagacaagaaagaamcattgggagcattgtgaatctgcctgatacctcagaggcattagttccagttttattctctcaaagcagtgcttccatcccttttgagaatctgctaaggacctggacctacttctgagaaacatatatgatacacaaatacatatatwtgggattttttttaatatgggattttatacataatttttttttttttttgagacccagtctcgctttgtcacccaggctggagtgtagtggtgcaatctgggctcacagaagactctgcctcccgggttcwagcgattttcctgcctcagcctcttgagtagctggggttataggtgtgcgctaccacactcggctaatttttgtatttttagtagagatggggtttcaccatgttggccaggctggtctcaaactcgtggcctcaagtgattcacccaccttggtctctcaaagtgctagtattacaggtgtgagccaccgtgcctagccaaattttacacgtaattttaaaggtctcttgagtccggacacccatctgtgaatttcctaggtgtccccctgctttgcaaacatatataactatatttaaatcatcttccaactgttcttgtaaaatccagggaggcaaggaaaattgtaatttaacgtgttgattaaacatatttttgttgttatatgtaagaagtttgtaaatatgagtttattctaggtagcacacacacagagataacatttaagtccttactatatgctagtcactgttctaagcactttccatgcatataccaaccttctggagtaagtactgttgttctttttttaccagtgatgaaactggcacagaggttagatgaccttatcaggggtgatggctgagataacaggcaaggccactccagagcttgtactgttgtgtactaagttatactgcccttatttgagtactttgtagatgattggagagcatcggtaagtaccacatacctcatgtttatgcctgcttttaggtctttcaccaagaaagcaaaattattttctggaaagagccaaggacttgttttctaatcctgtctctgccactacctggtgaactgayctggggcaagtaatttcatctgtgggccttctgttttttaatttctaaaatgaagaggttgggctggatgacygcttgatttggctaatttattttccaagttctttaactgtatactaaagctrcatattaaatattcacagtatacactcatgttaggctcagggaagtcctatagtaaagaaatctattattcttagatagacaaatgaatattwaacactattactatttgtaggcctcccaattgacttttctttctctctgtttttgtgtgttttgatagatgtatcagttgagagtgaactggckctagagagtcagaccaaaacttacagagaaaaggtgagtgtratagaattaagatgtgggaccttaagcaagttccttctacacctcgggtttctccatcagtgaaatgagcttgttgaactcaagggtctccctggctgctccccgctcattcagtctgtttctctggacaattagtttgtacctgcagaagcctccttggtcccacagagaacagtctggctcccatctggggcagctgaacacagctctgtgccaatgtttggagtcggttctctgggctgatacaagtgtagcataatgcttgtttttaggatttagtccaagttttagaatatattggttgtagcctgaaaacattcacgttaaaacaaagtaaacttggggattttcaatgtagaaggtccctacaaaggtcatctcaccccaagatgrcaaactgattgaatctttggtgctgtgtggagcactgtattgagaagggttgtgaggctactttttgsttcagggggaaggagtcagtgatctattagccctgtctgttacgggtgtaagatgggagaattaccattctactattcctgtctgttacgggcataggatgggagaatggtaagccatgtgctacagatttgccagccctaatcctagtcaagtctttatatcttactgatggagaygcygttgattgatcaatctgttaatatcatttggtgcttacagcagtcctgtgaggtaaataggtgcgattcagccttattcacaggtgaggtagtgatcactctgggatgctgagagtatccccatagtgacacagctaggaggggcagcacctacctgtcctgtcccyagtaaccaggtttatctcrtaaacagatggattcttgtattgaagcctttggtaccacyaaacagaagcgagctctgaacaccaggagaatgaacagagttggcaatgaatctttgaatcgtgcagtggctaaagctgcagagactatcattgatacgaagggtgtgactggtaagaagttggaacttgggctaagagtctgcccataatgacagctttctcttctcttgagatcttttacccacccacacatggaatgctgggagctagggctggattcctttcagcctcttgctgaaggccttctcacggacaggttctggaagtagtaagaaacatccgacatggctttgtcttctagtgatccacagtcaagtacagggacaggcatggaatggatacatgcctgccgtgcttatggtgctggggttatggcctgcagggcacagaggagggagaaggcctcaggtctctccttgtgcgttgcagggaagctttggtcaaaaaggctgatgtgttgatggaaatgagcctccagaggtggcatttcactttgggatcagtggctctgtttccggtattcagcagctggagtatttaattgtattattttaaaatgtatttattgttcaaatacattataagaacataagagcaagtttgtgtaagagtagcttttctttttaccgattttggagatgaggtcttgctatgttgcccaggctgatcttgaacccttggcttcaagcagtcctcccgcctcagcctcccaggtagctaggattataggcgcacaccactgtgccctgggcagagcagtttttctattaagaatgaaattctagtaatttttggaaaatctttccataccctatgattatatagatttcaacactttcacaaatttatttattgattgattggagatggggtcttgctctatcacccagactagagtgcagtggtgcagacatggctcactgcagccataacctcctgggctcaagtgatcctcctacttcagcctcccaagtggctgggatcacagatgtgtgccaccatgctcagctaatttttttagttttttggagagacagggtcttgccatgttgcctgggctggtctcaaacttctgggctcaagccatcctcccgccttggccttccaaaatgttgaggttacaggtgtgagccaccacacctggctgcggagttattcttgtggggcagttacagtgttatattctgaaagttttgttccacctacaatgtgtggcaagtttttctagaagttaagccattaaaggctattttggacgtccctcacttttagtttctctcattttatattgtaaatgtttatgtattagcacagctgtcaatcccaactctattgtaagttacctgaggggaatcttgtcacctccaccttctccagtgcctagcttgtgtttgttcatgagtgaacatggcagtcctgaagcagtcagcctgatggggaggcgaggtcactttggcagaagcatttagacttggggtttctggaccattggtggtctgaagtgcacagactgaaaagaatgttggggaactggaaacaaacagggtgatacatrgattgtttctttattgaaaagctctggtcagcgatgctatccacaatsacttgcaagatgactccctctaccttcctccctgctatgatgatgcagccaagcctgaagacgtgtataaatttgaagatcgtatccttcttgcagtagaaaagctgccttatttcacaagttgagatgtttgcacgtgtgtgcagtcaggttctctgagggtgtctgtgttctgtgacattcacaagagctccatccaaacctttgcagttgctcagtgctcttgccaggaggttaacttggcttcctcactagctgagggaccggcccctgggattcaaatccattcctcagcaaaatgccaaatgcccacagcttagacctgtggggctcactctccatggagagtcaaaataagagttgaaccagccaaatgcccaaagtctagggcagaccacttttgttgaaggaagggttggagcttagaatttcaccacccaaggggtccggtcagaaggaaaatgcctgcagtggctttgtgatgagaaaaagcagaaaagcctgggcagggaatgggctctgggctgggagtcggagaactgagtcaccaagctctgcccctatgtgatctgccctgtgtgatctttggctctctgagcctgtttccctgtctgtgaaatgycactgctatgagatgacctagctagttggatgtttctattttggttggattatattcttgacctgtaactagttctttcccctgyggagtatgaagctcttcagagcccatctgaagctttcaggaacgtcacgtcagaagaaatactgaagatgattgaggagaacaggtaccctgacttaagcagatggggattctggggagtgctgttgggacccaacagtagtcagacactgtgcaggtcctctgggcgtcagtcagtgaggaagtgtgtctggagcattggacatgaatgagccagtgttttcttgaatgtttgggctttcaggagctgtgggtcacattcgagggagagggctggtctctgagtccgtgggacctgcgacagggcagagggtggtgaggccttctactctggggctgggaactagagctggcctgtgtcacccagtgtcatgctggtgctgattgtcactggcagggcccaaatgctggcctgggaatgggtgctggccaaagtgatggtttctctgtgatgatatggtaggcaaacttttctaacattaaatttatgtatttaaaatattgtatattttaaataattcagagattatttccttctccctcccctttcccattaaaacagcttcttttatgatagtgagttttttttgcttttgagttttttcttttaataattttattttgataaagagttgtcaatctgaggtttgttcctccagtttttgttttaaaattttactggtcattgaaatccagtgccttggaattattattattatttctttttttttttttttttttgcttcaaagatttatttccaaaaaagagctcattactagttcatagttgtcttaatgtgattgtgactcaggggcaggtgcaggaacgaactctgagcggggagtctgaaaactgagtccccgaactctgcccttatcttcccttcttgaagcctcagtttttctatctgtaaaatgaggcatctatgagatgatcttgaagagcctttttatctctgtgagtccagggtcttgctagcagtagagcagtgcctgaaaataatagttagcattgactgagccttaacatttttgccaagcactgttctaagagctttactggcatcatctcttaatccagaaaaaatgctcaggaggagagtacctgtactatcattggccccaatttatagatggagaaaccagggcaccagataccaagaaacttgccccgctgggcacggtggctcacacctgtaatcccagcactttgggagactgagtcgggcagatcacctgaggtcgggagttcaagaccagcgtgaccaacatggagaaacctcatctctactaaaaatacaaagttagctgggcgtggtggtgcatgcctgtaatcccagctactcaggagactgaggcaggagaatcgcttgaacccaggaagcggaggttgcggtgagccaagattgcgccattgcactccagcctgggccacagagtgagactcagtctcaaacaaacaaacaaacaaacaaaaaaagaaacttgcctaaaccattaaatggcagagaaaggattgaaacccaggcaggctgactacagagtctatgctcctgactataaaaacagaggtcagaggttagcaaactacagcccacatgccaagtctggcctgctgcctgtgagtaagtaaagtataaataaagttttattggagcacagccctgttcatttacgtaagtaatatctgtgcctgctttcgcactacgatggcagagtcaagtagttgcaacagaggttgtatggcctccaaagcctaaaatatttactgtctagccctttattsatccctgcactgaaccatgttctcctattataaggagtgttgagtgtactggcccttcatcagctgcttttgttcgtttgtttttttttgtttctgagacagggtcttgctctgtcacctaggctggagtacagtggcgcagacagctcactggagcctcgacctcctgggctcaagtgatcctcccgcctcagccttccgagtagctgggaccacacacatgtgccaccatgccggctacgtttttgtagagatggggtcttgccttgttgcccagggtttcatcagctgttgagtgcgtcggggtgagaggcgcctgctgttctcgttgtaagagggaagtagttcctgacagagcccatcttacsctgacacaggcctccttttcttttccttgttttagccattgcacctttgtcatagaagcgttgaagtctttgccatcagatgtggagagccgagaccgccaggcccgatgcatatggtttctggataccctcatcaaatttcgagctcatagggtagttaagcggaaaagtaagtctatgataaacattttattctaattgtttccagtatattatttgtctgtaattcttagatgagttctratgagagaagaaaatggatatgtctgtccaagtctttaytgtcaactgtgagattcattctggtactgctgacatgtcgaggggacttgccaggcccctttttctctctggatctcccattttctcatctgaaaattggggccacgttggattatatgatagttcagggtccttccagagctaacatttgctacttctattctgcatgaggcaaagtagaatatccaggtcaaataaaaggaaaactttaagggactgttagaacaaacatcagccacgtgtgtgcgtgtgtgtgtgtatatatagagagagcttatgagttacacagatgtatcttgaaggcttgtggcaggtttgtgttgtgtcagcttatttctaacaggagagagtcaatctgatggtaacccagtgtcacctgtagctaggatcctttgcgggtcacaccctcatacctacccagagttggaaacccagaagatgtctgtggttttaggcacaaggtgtatttagttgttgttactgtgattgggcatccagtagtctatactcctgtttttcagtatagtcatgtgtcgcttaatgatggggatatgttctgagaaatgtatccttaggcaattttgtcattgtacaaacatcatagagtatatttacataaacctagatggtatagcctactacacacctaggctatatgctataagctgctgttcctaggctgcaaacctatacagcatgttactatactgaatattataggcaattgtaacacaatggtatttgtatatctaaatatatctaaacagaaaaggaatagtaaaactatgatattataatcttacgggactggctgggcatggtgggtcatgcctatatctcagcactttgagaggccaaggtgagaggatcacttcagggcaggagtttgagaccagcctgggcaacataccaagacactgtctctacacaaaaataaaaacattagctggggtggtgcacgcctgtattcccagctatttgggaggctgaagcaggaagagtgtttgagcctaggagttcaaggttacaatgagctatgattgcaccactgcctcggtgacagcaagaccctgtgtgaaaaaaatcttatgggaccactgtcacatatgtggcctgtcattgaccaaaacactgtaatgtgggacatgactgtatttgcttagtcatgctttttttgttgtttttttgttttgtttttgttttgttttttttgagacagtatctcgctctgtcacccagactggagtgcagtcccatgatcttggctcactacaacctccatctcctgggttcaagcaattctgcctcagcctcccgagtagctgggattacaggcgggcaccaccacgcccagctaatttttgtgtttttagtagagacggggtttttccatgttggccaggctggtctcgaacacctgacctcaggtgatccaccctccttggcctcccacaatgctggctgggattacaggcgtgagctactgcacccagcttgtatttgcttagttcttttttttttttytttttttgagacagagtctcgctctgtcgcccaggctggagtgcagtggctcgatctcggctccctgcaacctccacctactgggttcaagggattctcctgcctcagcctcctgagtagctgggattataggcgcccgccaccacacccggctaatttttgtatttttagtagagacggggtttcaccatgttggtcaggctggtctcgaactcctcacctcatgatctgcctgccttggtctcctaaagtgcyggggttacaagtgtgagccactatgcccagccagttgttttttgttttgttttgttttgttttgttttgttttgtttttttgagatggagtctcactctattgcccaggctagggtgcagtggcgcaatcttggcccactgcaacctctgcctcctgggttcaagcaattgtcctgcctcagcctcccaagtagctgggattagaggtttgcgccaccatacctggctaatttttgtgtttttagtagagatggggtttcaccatgttggtcaggctggtcttgaaytcctgacctcaggtgttstgcctgcctcggcctcccaaagtgttgggattacaggcgtgagccaccgcgcctggccacttagttcttattttcacattccaattccacctttccccctctctccctgagctttcagcacaatttttgttttctaaggtcatgttaactctgggtccttaggcctcaggctgtgttttcttgtcattgccccatcaccagcatctctcgtgcagggcaaactgcaggctgcagcacaccaagcatgttttcattttgatgtggctgttctgctttgtgtgggccctgcttctcttaccacctggttctggtcattgcagtggcccagctgttggccttttctcttagctcatggttgaggtgtggcctgagggttttgagagaaaatgatcaaactcaactttgtgttgtaggtgctctgggacctggagttccccacatcatcaacaccaaactgstgaagcactttacytgcttgacctacaacaatggcaggtcagggggtggttgctgggatttttcttgtgcaggagaaagtaggtgggggttgggagtgaggagcaggggcttggactcaattccatgtccacggagatgcagtgctgaaaagactgctgccatttggaaggctcctggggccccagtaagtttagcaaatgctaaatatgacatactctgcccttcttagaaaagtattaccttttgggaaccttagaagctctgggaagtcctacaataaagacttgttttacttcacatacttttgaatagcccttcccgatgtctcacagagctggtgttctgcggaaaggcagcattgcagaaaagggcagcccaactcggtgactctggggaaagacccgcaggccctgcccctgggcttccttcctgccatttgcatggmgtgtgttttctgctcttgagtgtgcttggaagaatcagcacagctgatttcgggatgattgttttcccagcagccctgctgggcaggcggggacagactcacagggccctcaccagctcaaagcgctagcagtgcccaggtagagtgtaggcccagstttctctatctgcctcagagggaaacatggactggcacactgctccactgtgtgtgaggcccaggaaccttggaagggcaaagtcacccacattccttttcctttcctgaagttgggaagacattccgtgcatatgagaataggattggatgttcttattttgcttttggagaaattgtctgagagtttaattttgtttctcctttattgccactgattttctagattacggaacttaatttcggattctatgaaggcgaagattacygcatatgtgatcatacttgccttgcacatacatgacttccaaattgacctgacartgttacagagggacttgaagctcagtgagaaaaggtragcacaacagaataaagagctccctgcagggtgtctcgatgtcttatttctggtaccactggaaagcatgaggcaccaccaagggaactgaggatgtttaaatgtgggaacaacttggaactaaaggactattttcaatgaatgaatcattgactgaatgagcaactagacattactgagtgccttctctgtgctagataaattatgtcattatctcactgatttccctagaaaacaattgaagaatcaggctcagaaaagtacgtaacattctcaaggttacacaaccaagaggggagtagttggccttgagacctgagcctttccataacattctgttctgaataaccaggcagcctccattctctgaattgctgtcacaggggagagggattctgtatggttctgaggagtgcagctcagggtggaagttgtaggacaacccaatttgagcttagtaagaagagcttcctcacaatcagatggaagggtttgccaggggaaccgctggttccaaggccaggtgkaactgctgtttggcagggattttatgtttgcacttctctgacccractgggagagctggtggtggaggtgaccttttaggctccatctagccttgtagaggagattcagacagtaggggcagagctgcccaggaacctgaactgtgaggtcagctgatctttgtcagtgatttaggggcatctgacatccagtggcccagagggtgtctaggagagcctgtgaacacacctctgtctggactctctagcagtccgtggagggactgttctgagggctgtccacaaactgtgttcccacaggcagtgaggctgaaaaaaagagaacaggtacttggaacctgtcagattctagcaagtgctcaatcctggttgctaaaagtttggttatgggaggtaaagaaagttgctcacggggctgtagataccctggtttttcatcacccatatggatcttttgaagggcattaaaatgaaattggctgtctgatggttcccagcgggtgaggggaccttgcctgcctctctgccaggggctttgtgcctgctggcaacctttgggattctgtctttatggcctggagcatgaatgtgctgctaccttttgccaaacctccctgaacagtcatgttgaggggtctctccagttcttctgtttrtgtcttccttaggatgatggagatagccaaagccatgaggctgaagatctccaaaagaarggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagcyactggctggtcctattcatttccatttttatgtatgttttgaaaagaaaaggtccggggatggtggctcacacctgaaatcccagcacttkggraggccgaggcaggaagatcattgagctcaggagtttgaaaccagtctggacaacatagggagaccccatctctaccggaggaaaaaaaaaagagtcaggcctggtggtgtgcrcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttcatctctctcctttggtattattgctgtgattataaatggcagatgtttctcatgttggttcacctgtggggatttgggagggtgggtcctccctcccaaagttgactcaccaggctgagtcaaatctaatggatgaaggtttccaaagagaaatgtgaagtggcgtgcttaggtctggaagggccagtggagtacgcagtgaggaaggaggatctggcccagcacgcctgggaaatgacacttcaggctttatcagaagctaactgggtcaccagtgtgatgggggctgccacaggccagtaggatacagcctgttgtaatggggtggagccaagtcagaggaagtggtgacccaatttctctgtctggtggaggccacatagaaggcaggggtcagctatgaaagccacactttgaagaggatgaatcagtcagtgttcagttcagaaaatcaattgctctaggtatcttaagaagaatggattttaatgtatggataaggtgctgtagaattgtgacaagggccagaggactgggaatcggaaggttgccgtcaggactgctgaattcaagaacacactgccggggttgccatcggggactcagaagccacttctgctccataactgctcctggaattcatgcagctgaagattcaacactgggctgctgatttcagctacccatgctttcttctttttctttttatttttttgagacagagtcttgctctgtagcccaggctggagtgcagtggcacgatctcgctcactgctacctccgcctcccatggcctggttcaagcaattctcctgcctcagcctcccgagtagctgggattacaggcatgcgccaccatgcccagctaatttttttgcatttttagtagagacagggtttcactgtgttggccaggctggtcttggactcctgacctcatgatccacccgccttggcctcccaaggtgctgggattacaggtgtgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggagggagacagaactcagctcctctgagaggagaagtttacacagcacctggggccctccatttgggagtcacagtggaaaggagtcttggctgagctttggggcaggtgcaccttattttctttgcggtctgggatgccctcagagctgtgctcctctgctttgtccccatctgcctctggccctgggtaggaggcacttggagcatactttgtcttccttcagcagaggtgtgggcagggaatctacttgtctcttgttttcctttaagccgttgtgaaaatcaagtatgtgactcttccttggaaaaaataatctctcagaaaaggacttctaatacatcctcagggtagaatgtgtttccgtgattactttttttttttgagatggagtttcgctcttgttgcccaggctggagtgcaatggcgtgatcttagctcactgcaacctctgcctcccgggttcaagtgcttctcctgcctcagcctcccgattacaggcatgcaccaccatgcccggctaattttgtatttttagtagagacagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatgcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcggattcaggatttacatttttggcaggaacagcacagaaatgatgctgtgacccacatgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcagccctggagtcagtcttttgttgtggttttgctttttagagacagggtcttgctctgtcgctcaggctggagagcggtggtgcagtcagctcactccactcctgggctcaagccatcctcctgcctcagcctcctgagtagctaggactataggcatgcaccaccacgcccagctttgaatccgtcttttatccaaggagctctggccttttagcggagaatagcggatgacatgaatgatgggcctgaagcaggaagtgaaatgcaatcctgaccaccagacagatgggatcttcagctgcactcaggcaagaactaggctcggggtagaggtgacagctctgtgatggggagctcaggctgcaccaggaggccatgctaggtttgacttcatttaaaaagcacactacacagctgacgggctcaggagctccatgaagggcaccctgcagaggtctggagggtagtgagaaggtaccaatggggcgagcatgcctgtgtcgggaggctgatccgggtaggaataagcccagcatgccccacatgagcccaccatgaggaagcatttggagagaaagcttgctctgtgttgtcagaagggagattgaagaaggtgggcccaggggtgctgttgacagtataggctcatgtgctgttccaaggctcatctctggctcttgcctggtctggccataccatgtccacatccgctgtacttaggacttcctctgggcaccagggcagtggcctcaccaagacctggaggcctagatgatgaaatcatactggtgtttgctgtgcttgtacattcccatcagcagacatccgtgtttgggcctgactggccaacagggaagtccagggaggacacagtataagctgcttgggtagaggtcagctggaacctcttgtgaactctgcaccagagtgaagccttcacccatggcagtattcctgtgggtgggagggaagctactgcagactgaaagcaaatgattccaaggaaacacagtactttagagaattctctttagatccgtgagtgctgcccatggagctgggccattcctcctgagatacaggacaggacgcctcaactctgcttctttgggctctcccagacctacccaggccactggagtgagtctagagaaatgaccagggtggtgaagagacaccctgcaaactggcacatacgagaggaacccaggagggcagcagaccccagggggatgagggtgctgcctgcaaatctctgaagagttgtcacagaacagagtgaagagatgtcctttgggggccccaggaggtagagattctgggaatgaggttgggtttgtttcctcatttgtctgcctgtctgtccgccatccatccaacacttagtgagctttgctctgtgctgggcatagagaatcaacagtgaacaagatgggcaaagtccctgccctcaaccaacagactgaaaagagaggattcagtgccatctgcaggtggcatgtggctgagtgggcacaggagcatggagaaggcgcagttaactgttatttgtagagacaggggaaggtgttccatagaagtagtgactaaggagcttctgaaggaggggtagaatttagcgagggagagagactttggctcaattaagtaaaaagttagatgggctcagttttcttgggcaagtctggcctgttgtgcaaagcacccgcactccctgactcttccccaaacacaagagctaaggtgggtgttctgttcctcccacttctgcctccaaatgacctggagggaatttgtgtcccagctgttcccttccctgccacctttgctccaggtaatagccctcctcacacctctccacatctgatagggaactttcccctgccggatctcaggagcatcagcactcccagcctccaaaatggggacaatgagctcaccaagtcaatgtttaatacattattgacagaacttacgatgattttaggtggctcagggatgtagtaaagtacttgtgttctgctggttaggctaagctgaagtgacaaatggccctcaaatgtctggtttcaacaaaagttcatttgcttttgttgaatgtctggcacatgtctgtcagccagcaggcacctgggaccctgctccgggt

SEQ ID NO: 10885 - DNA, 287340 bp, Homo sapiens
  misc_feature (1)...(287340): n = A,T,C or G, or insertion/deletion polymorphism (see Tables 1-2)
ttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactatccaaggtggcacctcttctgcaatgtttaaccctgctagtaatgaacgatgacttagttcggatatttcagaactttttgtttataccatcaggtatgcatgaatttataatctgaaagaggacttaaaataataattaaaacttaccagcttaagtgctaaactttttattttttaggtatttggggaagaactctttttaaagtatacacctaactgctttttaaaatgagtacacatgacatactttaattccatatgtattcccctactctttgggagacactgtgttgagaccaaggtcaaaaaacgtggtcaccgccctccaaatcgtctccgttccctgaggaagatcatatacctgtgtagtagccacagtacaaaacagactagaacacagcccatagcatgtaaccttttcctgactaactcaaggataggccaacacctatggtattagattctgccctaaaacaataagagttagatgctaagttatatagtcctggaccttaactcaaatagccagaatagccctagtaacctagaatattcctgattaaatatcccctgcttttagatacctgttgtccatttgggtttgttttttacagtctcttttgtaccacagtggatacatttgcttcatgagtgcaggaaccatgttcactgctgcattcttacccctagccctgcaacaaacacacaaaagatacccaataaatatttgttgattcactaaatgaatgaatgatgagtaggcctgcttctagaagtgcactgccaataagaatgtaatgcaagccacatatataattttaaaaattctagtagccatattaaaaataataataggccaagtgcagtggctcatacatgtaataccagcagtttggaagaccaaggtgggcagatcacttgagcccaggagtttgagaccagcctgggcaacatggctaaaccccatctctaccaaaaaaaatataaaaaattaaccaagtgtggtggcatgtgcctgtagtcccagctactcgggaggctaaggtgggaggatcgcttgagcccagaaggttgaggctgcagtgagccatgatcgtgtcactgccctctagcctgggtgacagagtgagaccctgtctcaaaaaataatcagcatcataaaaagaaaccagcaaaattaactttactagtatatttaacccaacatatataaaatattatttcaatatgcttccactataaaaaattattttacagtcttttatttccatattaagtctttaaaaatctgatgtgtagtttgtacttacagcacgttgcagttaggactggccacattttaagtgcacagtagccacagggggccactggctaccatattggatagtgccattctagaagctttcagctttttcaactggatgcctctgatttgtggactcagaatacagataaccaaagaagtgggactagtgtctgaagtaagaatgacagggtatgattgagagccccatgagcttacctaggagagaaacttgtggggttgcagaataaggatttgtcaatattggctctagctgttcacactatttctgggccaactcccagatcatttctcaactccagatagttaagtggggagcatggctgcactttttaaagtgatggcacaaaaaaagatattgaacgttggtcctctgattatatattctaaatatgcagttagaaaagaggccttttaagaatccctaagagtaaagcaaattagtatctttgtttcctgaaaattagagaaacttgatatgccatgatagccctcttcattttatttggaaaactcttctatgaaagcttattagagaaaattttctgattagcttcatgcctcccctccttcagcaaggtcaagggtgcagttgtcactatcacataagaatctcataaaaattaaacatgaatatactgcacagatctgattgggtttgtcatgccacacattgttttaaattccataattctattctataaagagtggtttctatgacaatagatcgttttaaaaacaaacaaacaaacaaaatttagagttgtcattggtaattgtggttgcaagtatgctttcaaagaccagaagcttttgttttgctttgaatgtaatttttttcttttttctttttgatacggagtctcactctgttgcccaggctggagtgcagtggcaccatctcagctcactgcaacctccacctccgtggttcaagcaattctcctgcctcagcctcctgagtagctgggattacaggcgtccaccaccacgcctgactaatttttgtatttttagtagagatggggttttaccatgttggccaggctggtctcaaattcctgacctcaggtgatccacctgcctctgcctcccaaagtgctgggattacaggcgtgagccaagcttcaatattcttaaacccaacctcacacagcctgatttaaaaactaaatttctgctaggcacggtggctcatgcctgtaatcccagcactttgggaggcggaggcgggcggatcacgagctcaggagatcaagaccatcctggctaacacggtgaaaccccgtctctactaaaaatacaaaaataaaaaaattagccgggcgtggtggcgggcgcctgtagtcccagctactcgggaggctgaggcaggagaatggcgcgaacccgggagacggaggttgcagtgaacgcagatcgcgccactacactccagcctgggcaaagagcaagactccgtctcaaaaaaataaataaataaataaataaataaataaaaaactaaatttctggccaggcacagtggctcgtgcctgtaatcccaaccctttgggaggccaaggctggcagttcgcttgagcccaggaggtcgagactagtctgacaaacatgtcaaaaccccgtttctacaaaaaatacaaaaattacctaggtatggtggtgcctgcctgtagtctcagctacttggggggctgaggcatgaatccaggagttcaaggctacagtgagctatgattgtgtcactgcactccagcctgggcaacagagtgagaccctgtctcaaaaaccaaaacaaacaaaaaagaaagcaaaaactaaatttctgataatcactaagtttttaattatgaaattactagaggaaatgcagcatcaccttggttgaaaaccatttggagagccgtgcacattcctgatccctaagtccttgatgttgcacccatcttgaggagcagtgctctctctggaccgatgttactgaatccaacccagttcctacttgatgtttgtggcattagcttggcagctagtttttacgtttactatttttactacatattaggagatggcaaattactgatagccaggataagggaatgattttcaaggcattatagctctaaaaaacaattgagaaatcagctccctcatcacttccttaatgcaatgagagaacacgacacggatgaacaaactgttctgttatccaacaagattatcaagagttattagtgagataataaaaaagtatatgtgactgccaaaagtctccagactaaggaccagaagacctggtttcttgttctttcactttctagtcctgcaattctggcgaagatactatactgctctgagcttcagggtttttttcactgtgaaagagggtgcaagttcctccacattcttccaatctactgaggaaacccaatgagataatgcatgggaacatgttttggaaactcaaaagtgctgcccaaaatgtaaggtaacactgtttacaattgacacttccagaaagtttagccagcacccccacacatggcatccgcttctgacaacgttaatcaaaatcaggccaaaggtgcaggcaggacagaggcctgacttaccagaaaataaacgtctggtctattccacttgtagtgccagtttacattgtctggcgagagccaactaccagggcctccgggtagaagaaagaaagggtatcagtggaactgagagtgtatacagtggcgcctgaaagcgggtagaagaaagaaagggtatcagtggaactgagagtgtatacagtggcgcctgaaagcgggtagaagaaagaaagggtatcagtggaactgagagtgtatacagtggcgcctgaaagcgggtagaagaaagaaagggtatcagtggaactgagagtgtatacagtggcgcctgaaaacccaacctcgccaggcttccctgtctcctgtgtgcagcatgtgtgcagtgcattcccctggaaggtaaattcgcggagtcccgcagcccacctgtgtccacctagcctgtaagtgccccctgagggtatcaaagcacgcggacttccgcctgaagcaaagccaccgggcggcaagtttccccgttaacaacaacgaagacagagaggacttggcagctgtgacggatctgcaataattaaactgacgttgctgtttagaagcctgggggtcgcctgcagcctcccaggctccactccatcggctccagcgctgcaggcgggccgtgcatgtctctagatgcatattaagcaaaaagtttctaaagaggatcgcgtggaacccagcaattgattaagaatctcaacggccctaatcccctgagaattgaactaagggctccccagcaaacacagcgatttacatggggcctagagagagcgagcactgccgggggcggcggcgaagggcagcggtggtgggacgggcggggtagggggagttactgagcatgcgcccgggtaggggcgtgggggagttactgagcatgcgcccaggtaggggcgtgggggagttactgagcatgcgcccgggtaggggcgtgggggagttactgagcatgcgcccgagggtgtttcggggcgtccgaagcgggcgtgctccagcctgctcagcagcgagtggttggaaattagcaaagtgagagggtgcgtggcctgagggactcggggaggctgagggctttttttctcaacactgtgaagctcagggaaaggagtagaactgggaaccaagtaaagtaaaatcgtggcaagtgggcatagacctgaaatctccttcgtgagggaacccagaacgtgcagctcaatgtatgtttggaacgaacaggtgaaaggaagcaggaggaggagggagttctagcgaagacttcggagggaagcaacccatcccctgccacaagaaagcaccgccactccagtgggaacggacacgcgtgcacacagccacgagtgaggtttgaaagaggccccaccctccattacacctgtgctccaccgtggcccccagccaagtttaatctcccattcagcacttacttctggaagcttctttccctttccttcccaccactcattggcctttcaccccctagttttttgtctgtgtgtgggactgtcttccyccactccccttgactgaagttccttgagagcagcagccctctttttatcagggaagagatttgaagctcaggacattcttatccaagtaggtgctagccacctgggtagtcaagacagggccctgcacagttaatgtgaatcttgtcataatgccagggttattgttttgcaaggagccggtcatagaacactagattgcattgtcactgggaaataagctcattctattagcttgtttctcagctagcttatgtagaaatttgccacagttgttactgctgggcacctgccctggatctgatcatcmattatatcatctcttccatctgatggactgcacctcaccccttgctttttcagagctggcgaagctgggccaaggaaagcgatagtgccagctgagtggaatgtgcaggaagggaccgaggaggggcactatgtactggagaaaagagatggggtctccaggacaggggtaaggacactaractgagggcacaaaggaaggaaaccacaaggaagtagagtagggaagtggggagcatgctgaggagagaggtcaagagatggtgaccgctctctgcatgccccaaggagatggtgatgacactcccaagtccatgtgggactccctccttatgcgggcctcagtctgtcatcttccttggagcaggaccaaagtaaataagataaagtcacaatttctcatccttcttcactcaacttttctttgaggtgagttggcatttttgtaaaagaatgcattctctgccagatgcggtggctcacccctgcaatcccagggttctgggaggccaaagtgggaggcttgattgaggccaggggttcgaaacctaggcaacatagcaagacctccatctctgtaaaagaaattagccaggcatggtggtgcatacttgtagtcctagctacttcggaggctgaggcgagagaatcgtttgcacttaggcattggagattacagtgagttaagcgttctcctgtactgccatggtaggtgggtgttgctagccacatgaggatatgtgagccggtcaccagggactgcggctgactccccgagcacaaggacagtaagaataaacctccgattattcccctgcccccaaccccaacttcaattaaagagatatacccttatgtgactgacaaaaaagagccctgctctcccagagtcacatccccatacgccaaaacactcttacatataattattggtgcttcataaatggctgataaaaaaacttttctatcagggaatacaccctaccttattcacagcctcttatagagagctggcctgcccacagtctctgtaaggggcagttgtctcttctgagtgaccagtttccctgacctcccctcaagccatgactgaccaaggaagtcaatgtcaccactgagaagcaaggcgtagcctcagactctgagtttctaactctttccactttcctaagatggggttatgcctcatttctgagagatttccaaccctctgccatatattcctctttttgtgaggtcacttggggaggtgtctgcttcttagcaccagaagagctctctcaggacccagttgctgacccagttgctgcaaatgctgaaagtaggaaatggaggtcaagtgtaggccataaagattttcccactcctcctcttgaatcaggcatggccttgtgaattactttggcccatagaatgcggcaaagtgatactgtrcaagttctagccttggtcttaagcctgccagcttttgctttcactcccttggagccctgagctagtatagaaagagatccagctgcaaggactggttacacaatttgcagsgattagtgtaaaaggaaatgcaggtttccttgttttaaaattattccgaattttaaggcggtgacaacagagccctataccaagcagaggcttgatccgagctggtgcaggcatgacagccaggcttcctgatacatgagtgatgctatcttggatttctggccccaattcagcctcctaatggtcagcatgagagcatgaactaccctaggtgagaccagtagaagaacccagctcagattacaaaactatgagcaaacaaacggttgttattcaagtaaagctcactaaagctcttcatgacaaacgggtatagtcatgggggccgctaaggcctgggttgagattttatatagcaataggtaactgaagcatgaagaataagagtttgcagtgagtggtcacccaccatattccaggccctgtgttggtgcattgcatgtgccagctcacctgatcctcacaacacctttcataattcctttctacaggagagaatacagcagttccaaggacaagggattcgtaccactgctcctcactcagtaaatagcagagacagaatttgaacgtgagtctgactgattccaaaacccatgtaatatccctgcattgaaacagaggaaaatccaaggaaagtgcacacagcttggagactattggataggggtctgattcagtctttcctaaatttcctcataaatttgcagttgaagtatcaggcagagaaatgataaccaggtgaaagacccctaatgggacatcatgacatcacagctctgtgatcatcaaccataatccctagagggtcacctagagttatcctacaatgaggcttacttgggttttctgataggtataatactgagaaaatttgctatggttagctatgggtattcaccacttattttagtgtatatcatcccccaacaaaccacaggcacctgtgatcatctgggtatgtgttcaggaactatcttgcacccagaaagaacaagaattttttttttttttttgagacagagtctctctctgtcaccagggtggaatgcagtggcacaatctcagctcactgcaacctctgcctccatggttcaagtgattctcctgcctcagcctccygagtagctgggactgcaggcatgtgccaccacacctagctaatttttgtatttttagtagagacagggtttcaccatgttggccaggatggtctcgatctcttgaccttgtgatctgcccacctcggcctcccaaagttctgggattataggtgtgagccastgtgccrgccaagaattaatttcaacattagactcagccagagttaatgaagaagctttccccacawgatggctcctcacaagaaatactatctatttataatattcattggctttacttgtctttaccaagccttcctgagtgtcatcagtgggtgagtgagtgtatggataggtacctgcctatctgtctgcccatggtgatgaacacatcactgtaggtcagcaatgacattgagtctaaatgctgttggccataaggaaaatagtgacattccctggctcagaggaaatgctggtaggaaagccatatggactagtatttataagtacaagctcaggggtcaaagatgctgaagttcaatgccttgtcctgtctcttactaattagtgatattggacatattgattaattgcataagtatgtttctcacttatctataaaatgagatgtatgagggctaaatgaaatgatgcatgtgaaaaactgaacaaggtgccaggcctaggacaagggctcaataaatgtcagcgattattttatttgatgaacaaaagaaggcaaatgttctttctttgatgccccctatcttttccctgtgtcgtttctctaaaaaagtatatgtgtgtaatttctatgccttccctccactctcccattatctaccacttcatcatcctctcactacccatggccactttccctcattatcttttctatatttcttccctcctcccctgaaatggggttgagcagggggagatcagaggatgagaaaaggcagggagacattggtggcagggtgacaatggagcaccacaagctgtctaggccatctagactttccctgaggacacttcagtatctctgagaataccattttctcaggactcctcacactgggagaaaccttagcaatcatctgatggtgtacttgttacagtagataggcagacatgtgcagtgcaggagagggccccccaccctgaccaggaatgtcaggtgaccatcaggtgatggtcacatggttgttacaccgtctctctcaaataataactggttgcagccagcaccagggaaaggcagtctccaaatagataggaaaaacctgaaagtgacaatcagcagcttcacaataagatctcaggaattgggcaggtgggctcaagcatgtgcactaagaggcaaagtggcggagtttaattggtaaatgaccttcctgtaggaatgctacgctggtaagggaagaaagcctcaagaaagcatctgtaccattccagcaaatacactgtgcatgctcccctcccaaatgctagcaggccactgcacatatggacagcccaccccaagggaagaattgggagaagtaacccaagaccccgaaagtatgccaacctgtaagaccgcaagtcaaaggtcaaactgtgcacttgatctcacaaggtgcccactcggccctcttccaaatatactctacttcctttcattcctgctctgaagctttttaataaattttcactcctgcttgaggactaagctctgatcttttcttatcttccaaattcctatctagggggtctggggagttatgccctacaaaccaaaaattctcatcagatgggttttatttaaccctatatattgtgactttttagtctgactctggcataatattacatgacaaaatcaaaatattttatcccataacatgtctctttggcatattttgaaatggccctgcaaagccatcctttgtaggggaaaatttgcatctgtaaagaatctctgttaacatagctagatatttttcttccaggcgctcccatctgaagagattaagagtctagcacctttttaaaattatttatttatttatttatttttgaaacagagtctcactctgttgcccaggctggagtgtagcgtcgccatctcagctcactgcaacctctgcctcctgggttcaagccattctcctacctcagcctcccgagtagctgggattacaggtgcctgccaccacacccggctaatttttgtatttttaacagagacaagttttcgccacattgaccaagctagtcttgaactcctggcctcactgtgatccacctgcttcagcactccagcctgggcaacaagagcaaaactccatctcaaaaaaaaaaaaaaaagttagaaaactaaactacaaggtccttaaatgcctgctccacagtattagccaaacatgaacaagatcccaggtgttaggccgggcgtggtggctcacgcctgtaatcccagcactttgggaggccgaggcgggtggatcacctgaggtcagcagttcaagaccagcctggtcaacatagtgaaaccctgtctctactaaaaatacaaacattagccgagcatggtggggtatgcctgtaatcccagctactcgcgaggctgaggcaagagaatcgcttgaacccgggaggcagaggttgcagtgggctgagatcacgccactgcactccagcctgggcaatggaacaaaagactccatctcaaaaacaaaaaaaaaatcccaggtgttctggattcccatccaaaagaaaaggggaaaccaaaccccctgcttccatctcacccaggatctcctgtcttcccaaagcactttaccgtctttcctgcccagctgttgaaatatcaaactgtaccaagattttggccatgatggactctgttctctgcacactaagagatttatcttcctgatcatcagtagaaatattaataaataatattggttgccatttattgagcagtgtgttaaacatccatattatttaatggatgtttttctagctgtgttttaaagttttaaagttgcagcatttgaatgaatgaatgacttctgagccaaagtgagaaaaagcaaacaagacacaaatgagttttctaaactatgtgtctccccgaaattagctctgctactttgcacaagtctcctttcctaagatcccgcttctcatctgttcaatggggatatgaacatctacaagtttatggtaaagtttaaaagcacatttgtctgatactaagagccaataaacaatcgttactttcattaccccagttggcaatttgagcagggcatgacagggagtttgggtgacaggcgataaagtaacggacattatggaaagtctgaaagaatgtaataaggataatatattttagatgtatttttctcttttatattttgtgaatgacttttcccctggttagcctaaggtaattcttatgactcagggaggtttgagattgttacagcaggaatgcaaacagaaaaaaaaaaaaaaaagatctagcttttgatttccaaatttgagttcctagaataactgtctttaaaattcagaggttggagataaagaaaaggattttctagattcctatcacttccattaaaataccaagggtcagaacaatgaacctgaattctaaagctattggtagagagaaatgacctttgatgtaagaggtgtccctactgcacagaaaagatggggtgtttttcctttccaaaccaagggaatgtcaggggaagaaaagatagagattaaaggggaaaagtgagttttatgtatcttggcttctccattcagggctgatatcacaagtagtagataaattgaaagaaaggaatcccaaaagaagaaaaagactgtgttctgctcctcacttaaaactcagcaaaagggacccccaccaagtggcccatgccaatatgtaacacagaaaggaaaaccaacagcatgggcctcttggcttggaggaagccaaagtgcacatttcttcagtcatactacatctgggttcatctagccacctctgccatgctgcccaagttcaaccccaatgagatcagtcatatacctgccaggtgccctggtggaaaactgggtaccatgtctgccctagcccttaagatcaaccctctggacctgtctccaaaataagttggtgatgacattcccaaggccacaggtcaccagaagagtcaaaggattacaatgaaactgaccattcagaacagacaggctcagactgaggtggtactttctgcctctgccgtgagcatcaaagccctcaaggaaccagagacagaaagaagcaaaacaatcaagcacagtggaaatgccatttttcatgacactgtcaagattgcatgacagatgcagcaccaatccttagtcacagaactctctgggacccgtaaagagatcttggagactgcccagtctgtgagctccaatgttgatgggcgccagcctcctgacatcatagatgacatcaaatcaacagtggtgcaagtaaatatccagctagctatgaactacgaaggaaaaaatttcaataaaggatcatttgacaactaaaaataaaaacacagcatggttatgacatagggtctgcatgagtgcctttgtgcctccttgaaaaagccagtttccccatgcacagatgtcagtagtacaagtcaaccaggtatccagagacattgctaaaagatgtcaataccaaatctaatcacagcataaggaccagtgtatacaaatctaaagcccactttctcctgctcactcctaaagctcactttctcacaacactgccaccccaatataccaagaaaccatctagaaaggagggcagacaatagccacttacctttaaaaacaaaaccaaactctttacaccaaaacttcttccatatccaaagagtctaaaatacagttagtgatgaatgtggatgtggagccaatgagtaagatttgatcagttacagaaaacaagtgaagccacatttactttgcacaaccaaatgtagtttgctaagtttttgaccccattatatgaagaagacaaatcatccataactctaccacgctaaacatccattacttttttttttttttttttgagagtttcgctttgtggtccagcctggggcgcagtggtgcaatcttggctcactgcaaccttcgcctcctgggtttcagcaattctcatgttcagcctcctgagtagctgggattacagccacccatagatttttaaaatacttctctttcacttgtcttgcataggcatgattattgcaaataactgcaatgcatatcagtcacaattttatatcgtgctctttgtaaaattcatcaaaattccttttccatgctgctgtgtgttcttcctggttaccaatgttaacagacgcataagctattagtcaaaactcttgtcattgcaagtatcataaagccaattccaactcaactgaagaaaatgggtatttaatggaagaacactggagttgctcattgacctacaagaaccacgcagccctgagggcctaaatgcaggggacgggggcttgaagtcaccagagttcttcactgctcattcttcctacagacatctccacataaatgtattaggcatttggccatgttaggtcattttcattagccacattttccaaatggggacggagggactaagggagttagatgtgactcactgcaggtgattcagctgctaaatggcattgatttgaaaaccagcatcttgattcagattggtggatccatacaaattgcaagggacaaaacttttcaaaaatatgtaagaatagtcacataggataagaatatatttgatttttgtgaggactacagctgaaggagaagagaaacatgcaaatggggttccatttcccacaccagggcagcttctgtcatctcagaatgcccacctggcatcttcctgacccttggctcacccacaaggaagttsatggcaatattgttttcagaagccaatattctcctgtctctacttgcaagaaaataactgagcccccccagtaagtataattggtgcgaacagtgatttattatatgcccagttctccagatggcctttcatatggaaatgatttttcctgaaaacagaaaaatatgggttttttcccttctcagcaggttataacaggtttacaatccactgcatcaaaactagaatcaaaaactttaacggagttcccttaaaacagaaacacaaaaaacacgttccatctggtaaataattgccggagttgcattcctgtgcattcaggcacaagctaactgctgtacagcataaagctgtgaaaatgtctaggcttaatggggaaacatgagataagatctacttaggtctatcatatactcaaattgcaaccttctgggatgctggttcatgccagactcaaatcacccataatctgatgggctagacagatgtgtaagattattccaggatatctgaaaatctcacatgtgagtacaaaaggctaggtggacacgtgcagcccttattctatgtgaatgaaggggaatgtttaccaagaaggtcattttcagatgaccatagttgaagagcaaagtcaaatgtggttctaagtgacatgtcctctgcctaaataacagatgagaaagtatatctaaaaaggcttatatcatcctgtgatggaatacttaagaatggggaaagcatttagcagtaaaaagtaagttaccaaaaggatttaatgcagttagtatgtagcaggttaatttcagtagatgactctaagttatgattttcatccagaaagaattattttcrtcagctttccmccagtggaacatacttcctcctaagctccctgcctctgaaagcataggcaggggagccrtgtattagagacgttgtggggaagatctccacatttggaaagctgaagatctgcagattaggggtgacactcaaattccttaaggggttgggcagataaattgtgtaaaatggtaaggcattagaaagtggaccagactgcagaggactggagaggcacagcccacytaaagacattcaaatttggtacagatgcttcttggcttaccatggggctactgtgtcccaataaacccacctaagtgaaaaaatgcatttagtacacctaacctaccaaacatcacagcctagcctagcctaccttacacatgctcagaacacttacatgagcctacaattgggctacatcatctgacacaatgcctgttttataataaagtgtagaatatctcatgtaatttattgaatactggactggaagtgaaaaacagaatgattacacggtacttgaagtatagtttctgctgaatgtgtatggctttcacgctatcataaagttgagtaattataagtcaaaccattgtaagttggagactatctgtatttaaaaacaaaacaaaacaaaaaaaaacccaaaaacaaaaatagactggtctggccaaatagaccactttggaaggacgtggcctatggatcaagaggatatttgccgctcctggactagcaaatccttaagccttctttgcctgctgagttctgtgatgtgtataaaaataatgcacttttatctaataagagccaaacacattaacctctgtggtaggagaaagtggagttgaacagaagtattgaatgtggtctccatcctcagaaaactcaaaamtactttaaaataagatatgtccatacaaaggcagccaacaacggcgggcaaaaagctyatgacggctcattaggaagcatttctaactttgatctagatgggttcagaaagagccacagaataggcaaggcttgagtggggcttaaaagaacaaataggtctgacatagtggctcacacctcgatctctactcgggagcatcgtttgagcccaggaggttgaggctgcagtgagctatgatcacaccactgcactccagcctgggtgacaaagcaagaccctgtctctaaaaaaaaaaaataaaggatgaacattcagctaaatggagagtgtataggaggatagagttgttagatagtaataggacaaacaagaagcccaggggcgaggaggagggtcatgcttggatccttctgaacctctcaacttcttcctcagatcctaaaattggcttcctgtcacctattctgttctgagcctcctcctcagcctctggacctctcccttcttatgaactaaaaggtttcttagggtcacagttcccacagctgggccctaccacctgcagtcagagcccttagcgctccccttgtattcgcctggtacatatcccagcctcaccgcctgtttgcagacttgtcaacacagtcattgggctacctcttggacaatcacccttgatgctgaatcacccaagcaaattaattgaattttcaagtgacgagtgtaatcctaagcacttaatggtcagaagtgagggggcacaaactattttcggattcgaatttgtctttattatgtggtgtacacctttgttggggtactaagtgccatcagtaaatagctagcagcaattgatggcttacaacgtgccagaatctgtgctgagcccagggcatgcatgccctcccttgccaactcaacctccaaaatggggcacaatattttcccctctctcgagatgggtaaactgaggctcaggggttaaataacacatgcaaagtcatacaactaacgggcatggattcaaacccaagtcttctgtctccaaaaactgactacaatcacatgtggttgacggttatcactgcatgtgattgtaccattcatatggatgtgtaaatgcaccctcaatggcacagaatcacctgctggcctatcattggatgtaagcagctgccatctgccaaacaatacacgcatttgatgtatgaatttgtatcgctgactcttcagacgcagtagtcctcccttatccaaggtccaaatatatgaaacagaaaattccagaaatamttcataaatttcaagttgtccgtgttctgagtagcatgatgaaatcttagccatcctgctctgcctgccggggtgtgaatcatctttttgtccagagtattcacactatagaggctccctgcctgttaatcacttagtagatctgttggttatcaggtcaactgtcgcagcatcacagtgcttgcgtccaagtaacccttattttacttaataatggcccaaagagtaatgaggtcagaatattgttttattatattataagttgttatcctttattgtaccaaatttataagtgaaactttatcatagatatgtatgtataggaaaaaaaaacatagtatatagagggttcagtacaatccatggttttgggcatcctctggggtcttggaacataccccctgtggattagaggggagtatggtaatgcagcattctcaccacatttgaatcatctgggggcactaataaaaaagcactgatgccttagcttcaatccccagagatttagatttaaytggttttggtttgaatcaaacattggaatgctagaggagcttcccagatgatcctaatgtgtagagaacataggcagtgaatagttgctaggagtgagggcttggggtctgatttctgttaccataggccagctatgacacacctatgagtcttagttttctcatctataaaatgggaactacagaactgtgtactttatagcactgatgcaagggttaagttagatggaaacaatggaatgcaaaaatggtaaggttcctggtgccatccctaaaagcctcattgatccataatgaaatggaagtttatagtctcttaggcaaacacccattggttatatgagaaaatgtattctcctggctttctactcagactttctgacacctcagggtagaggagagggctggacaggcactcttsacaaccygctagctctttcagagatgtaaatgcaaaggcctttcagagctagacagctgacatacagatgtgaagtaactgggataagctatcagggctatttaaaaaaagggagacagagcgagcaggtatgatttgaagagaagataccccataaaagggcttaaagttcattaaaaataataattactaccaacaaagtgctagccaaacaaatccgtctgtccccacatgcagcaggtagggtgccagtttgcaccacgagtagttcacaccttcagctttagagattcaggtcagtggctcctccctgcttctgcacttgtgagctgagggcagctacttccccttccattggaagccagggggtttcaaggatatgtcggtgactatgaaggggcttgcagatgacagccagatttgttaaaggcagacaagcagttatttgtttaaaagttcccaccttacagagggcccatctctgtttcaggctagctgtgtggcctcacctaacttctctgaaccattgctcacatgtaaaacacggaaaaaattatccacttctcagggatgttgtgaagattaaaagaacaagagatgtagagtgctcagcacagtgcctctgctctgggaagcactccagatgtgtctgcttttgttgtgattttgccattcttcaacaaagttaaaagagcctcaagcactgtaagcattgtttctccccttgccctggtaaattatttaaatgacatggttcattctaatacattacctcatccctcctttgaagccacagtcaaaagcattgacaaacaagtttgagagagataaggagaggcaagataaaagatataaagtgaccaaaaagaaaaaaggtagataatttgttccttgtctgttctcaaggatcacaggtctggtggcttgctgaatggggtatggagagggaacacggtacacctcccacatctgtggcctgcagtggccccagtgagcactgggcagcacccaggcagagagaaggactttctggatttctctggggatagttactctcagtgtttccaagaataagaatccagcatgggattcatcccaccttcattgcattttgctttgctttgacatctgccatggagaatgcaaaaaaaaaaagttaggcctcataagacataaatgtgtcaatgctttggcctatccaggcccagatttgagttcagagaggccctggaagcctggactagtcctagaccaactttggttcttgggctttaagaaacagcattcattcacctgattttcaactggggaaccaccctccaccctcactgtcagtcactgtgctttggatgaaactgactttatccctgtcttcagggagtgggtgtggtattcaggcctggccaatcagagcatcacattcctctgatccagtgatagatagtgacccattgagaaatgggcatgtgaacccctcagagtcagagtgatacaaggaaactgtttttaagggctttgttaaggtataatttacataccataaaattcacccatttaaagtatacaattcaatgatttttagtaaattttcaaagtaaccacaaaaatctggtttttgaatatttctataatcacaaaaagatctcttgtgccatttgtaggtacaaggaaactttagcagagttattgaggaaaattcacctgttccttttgtctgggtctgtttgcaataatgattacaagagcctggatctacatagaacctgagaataaagcaaaaactgcttagtaaagagataggctgggcacagtggttcacgcctgtaatcccaacactttgagaggccgaggcgggcagatcacttcaggtcaggagttggagaccagcccggccaacatggtggaacctcatctctactaaaaatacaaattagctggatgtggtggcgcatgcctgtaatcccagctactcgggaggctgaggcaggagaatcgcttgaacctgggaggcggaggctgcagtgagccaagatcgtgtcactacactccagcctgggtgacagagtgagaattgtctcaaaaaaaaaaaaaaaaagaaaagaaaaagagagagagagatgtagagaagctgagtccggaggtccctggttgaggctctgatcaagctgaacctgaagtcagagcttcccctagacttcttcagttccatgagctgagaagtttcccgttgtctttagccagtttgacttgtgttttccatctcttgcaatgggatgaatctcgcctgactccaaaaatttttgaccagactctaaagattagaactggaacctttattaattgaatatcagacaggaaagcaaatctccagatttgctgtaatcaaaggattattttacatatgatcatagatgccattttacaaatgaggattcagccctgcaaaagtcaattgcttaaccaggatacataggagaaactggagaagtccgtgtaactctgaatttgattttgtaaccctgaatttgatcctgtctttcctcttgaagtaatcatcatcgtcgtcatgatcatcatcaccattacctcttacaaaatgtttactatgtgtcagacctatgctgagtacgtactgtataaatattaactcatttaatcttcacaactgccttatggggtaggtattattattattctcattttacagatgaggaaactgaagtctgtagaggtcacataacttctccaaggttatatagcctgtgagtagcagaggcaggatttggatgcaggcacactggctacagaggccacactcttaatctgtgcactgtactgccttttataaataaaaattaatctaacataagcttttaatcagtgttccagtggtctttcagctagagatactacctttttctgaacttatatttccgtcattataaaaaaataaaaagcaaaaacctcaaatattttctgtattttaagactcttcaattatataaacaatttttatctgatttcaagtagtcataaacttctgtgcttcttacaactttgttctgctcttctaaacacagtaaaagtaaagtttaatcatggcaaaagtctaatttttatgtcttcttgcagtaaaaaactagatgactgctctgctttattgatatttaatatgatatggtaatgatatttaatgtaatttaatatgaaattttacattttatatcagccaactgacaagaaagtaagacctggaagttatttttatgtagaagaaagatatgctgaattttaggaaattcagccagtggatatatacaagatggttgaggaggggagctgcaggcacggagaacagcttagaaggctgctcctgcaaatacagacagttcccaacttacaatggtttggcttatggtttttcaaatttatgatggtgtgaaagccatacgtgttcagtagaaaccacactgcaagtaccccataaccattctgtttttcactttcagtacagaattcaataaattacatgagaaattcaaactttattataaaataggtttgtgatgatgattctgcccacctgtaggctaaggtaaatgttctgagcgatttaaggtaggctaggctaagctatgatgtttggtaggttagatgtaagtgcattttcaactcacaatgttttccatttacagtgggttcattgggatgtcataacctcatcgtaagttgggtatcagtacctcagatatatttgtttagtatagggagtctgtacaagttacttgggattgacttggctcctggggcaacagaactttgttctaagttctaatgccattgttaaaatcaatgagtcatcaatagggcactagaggtaattgagaagctgccctattgggaggggtagataactagaaaaacagcagcatgaagtgtggattggagtacttaatggtggcacctgggcaaattattctaggcatgtctgcacagacctcaaatgatggaggtgggttagagttcggcttcccaaatcctctgtcagtgatctcttattgcagaaggcagcctggtacccctaagagtctaagacacagcttcagcggccctttccagttttctatttaaaattcttgtagaatttctgcttcactccctaggaaagcctatgtctgccttcgggatatgtgaaaatttgacaagaagtaaacaccttccctgttcaacataggccccaccttcccaagctctcatttctaggtttcttgttctttggtccatattcattctatgaggagatggtcaacatggctacgaactccacatgaactcagtattaactggttaatctactccatgaatccctacaaatacgggagcatgttggggtatggttcttgggtaatgtgtatgcattttgattgaggctgaggtttttgctgcaatcagtggtctagcctcacaatatccagtgtggtgggaatgtgtggctcaaagaggagaggaggatggagcttctggagaaggaaaggctttggagcaagcagggatattagagtctaacaagtaacagcaagtttcttacacttttgtgttcaacactttgttgctcattcatgctggaaaagaagacaagaaacaagccaaaattttcattcatcctcagattgtcttattctaacttggagacaaaatctggatttgaaccttgtttctgccgtttatgagttgtttgaactcgaacacatcaactaatctcaattacctcaactgcaaaggagcagttctgataacatccttcctgtctcattcacagggttactgggggaatgaatcagtcaatgtaatcaaaaatgctgcatacagacagtgtaaactgtgactgtcttgtaagagtcaagtgtcaataatgactgtcactttgatttggggtcaggattcactcttactgctgcctgttatgtacaatctcaagcagtgttgtttattattattctaagaatagcatagcttttgggtctgtattttacaaaccaaatattgtaattttagggataatggaatattaggggcataatggggaaagttgaaaaattatggtcagtggagagatagttaaaaaaaaagtactggaatagaagttagragacttcacctagtacctcagtgatctggagtcatcatggcaccatgctgggcctcagtttcctcgatctgtaaaatgaggatgcttgatccattgtttcttaactaggaggagttttggaatcacctggaaaatccccaaaggtagaatttttgttttgtttcttgctgtgtttccaaggcctggaaaagtacttggtgtggggaagctactcaataaatacacatatattttatgaatgaataaactttttcaaaattcataggcctggttccactctgaaatcctcgtgcagtttggggtagagcctacatgtgtattttggaaaggcctttctgatcgttttgccaagtgctcctggctaattaataaccaccaagagccactaaactcaacartctccaaggtcccttcacatgcagttgccacatttagcaaacaaaaatgcagagcatccagccaaatttgaatttcagataaacaatgaatacttttttagtgtaagtataggtcatgcagtatttggttgctgcaacttaaataaacataaccagataagacttctgcttagactgatagtttgggccagagagtggcaccttgaaactggcccagatttgaaaatcagacagagatagtcttggtttgagtctctgccctgatcttagcagattgcttaacttcactgggctccacaactacagtgtctaccctgtagagttggtgaaagtattagagataatagaggtaagatgcccagcacttagcaggcatttaataaagcttagctattattactattttttatctgctccacggggtttgaagaaaaataatagtatcaatgagactgttattggcaatactgtttactcgtaaattggcacttgaaataaccaagattatagttaacagttctaggtagagcttggcaaagttagattgaatgctgaccttgtattaaacaatacctctatgtctgggggaacaaaaccgtactaagtacagatcatccagaataaataaaggaaggaagtacttttatttcattcattatgaaatgtcatttgcttaactgacttttttgacgttaaagataaatatttgttcaggttttatagggtcactctctggggaaataggctattacttggccagcggaaatacttcaatcctgaccaggtttttctgacttctaagttaaaggcatcttcttcttctagagttttagttgtttctagacattttaaatacatctccactggttaaacaaatagacagtcaggcacagcagttcacacctataatcccagtactttgggagcccaaaaaaggtgggaggattgcttgagctcaggagttcaagaccatcctgggcaacaaagtgatacctcatccctactaaaattaaaaagaaaaaaaagccaggcacagtggtgcacacctgttgtcccagctagctgggagctgaggtggaagaattgcttaagcccaggaggttgaagctgcagtgagccatgattgtgctactgcactccagcctgagaacagagcaagaccttgtctcaaactaataataataataataacaataggcaaacatagcagtaaacataaaatgttcatttaaaaaattatctccagaaagatctatttggacaaaatctttagataatttcattatcaaatttaaaaagagatggctggaaaataaattgccaaagtttcaactgagcaactctgatattggcaaaaatacgttaagctccctatgtttacttcattgctcattcaacacatatttattgttgagcacatattatataccagacagtgtggtaagtgccagggactatgagtaaacagaacaaaattcttgctcttgtggagcttatattctgacacaggaaaacaaatataaacataataaatgaattaattagaatatagatggcaataagtgctacgaaaaaagatgaggagaacaaagatgagactatgtgaagggctaaagtggctttttttttttttttttttgagacagggtctcattctgttgcctaggctggcgtgcagtggtacaaccatggctcactgcagcctcaaactcttgggttcaagggatcctcctgcctcagtctcccaagcacctaggaccacaggcatgtgttaccatgccccatctaatttttaaacattttgtagagatgtgctcttgccatgttttccaggctggtcttgagctcttgggctcaagtaatcctcctacctcggcctcccaaagtgctggaattacacatgtaaaccaccgtgcccactcctggagtgcattttcttttttttttttagacagagtcttgctctgtcaccaggctggtgtgcagtggcatgatctcagctcactgcaacctccgcctcccgggttcaagcaattctcctgcctcagcctcctgagtagctgggactacaggtgtgcatcaccacgcccagctaatttttgtattttttagtagagatgggatttcaccatgttgcccaggatgctctcaatgtcttgacctcgtgatccaccctcctcggccccccaaagtgctgggattacaggtgtgagccactgtgcccggcctggagtgcaattttaaatagcatggtgatagtgggcctctctggggaggtgacatttgtggacaggagagaaagaaggagcatgctgatttggggcgagaaaagggaaacgtcaaacacaaatcacctaaagcaggagtgatatggtttggctgtgtccccacccaaatctcatcttgaattataactcctacaattcccacatttcgtggaaggaacccggtgggaggtaatcaaatcacgggagtgggtctttcccatgctgttcttgtgatagtgattaagtctcacaagatctgatggttttcaaaatgggagtttccctacacaagccctctctttgcctggtgccatccaagtaagacgtgagttacttctccttgccttccgccatgattttgaggcctccacagctacatggaactgtaagtctattgaacttctttcttttgtaaattacccaatcttgggtatgtctttatcaacagtgtgaaaacagactaatgcaaggaacatacctggagtgttccaggaacagccaggaggcaacgtggctggacaggagacagggaagaggagagtagtaggagaaaagacagagtcattattgtcatcataattgtgacagaactccacaaacctaacttccagttttgagtcttagtttatttactctgtgactgtagggaaatccttaactgcttaaatagaatgatagtacttaacttgcaaagcatcgatagttagagatttatttcacaaaactgactagagagaatcagtatagcttagccatgctgtcggtacttacgtggatagctctgggtttatatgctgatttacttactagatgtgtgtccttgggcaggttacttaaacctctctgtgcttcaggtttcctttctgtaaaatgaggcaactaataaatgcatcctttagagctgttaagggttgcctggacaactgtgaggctgtctgtgagagacagtctcacatcacatgcttaacatagtgattggcatatagaaagtactaagtaaatatcattatttattattatttgaaaagtttaagattaaatatattgaaatatgcatttaaatgtatatttgaaatatatatttaataaccaaaacatgcttttgagaaaaaatatcttattgttattaatagttgtggccaggtgcggtgtcatatgcctataatcccagcactttgggaggccgaggcgggyggatcacctgaggtcgggaattcgagaccagcctgaccaacatggagaaatcctgtctctactaaaaatacaaaattagccgggcgtggtgacccttacctgtaatcccagctactcgggaggctgaggcaggagaatcacttgaactcaggaggcagaggttgcggtgagctgagatcgtgccattgcactccagcctgggcggtcaacaagaacaaaactccgtctcaaaaaaaaaaaaaaaaagaaaagaaaaccagctgtggcctggtagccggcctccctgtctctgaatattcacatccttgtacagtcccttcccatattgtaccagggttggtttgtgcgaccatagaatatggcagaagtgatggtatgtcacttctgagattcggttataaaagacattgcagccaccatcttggtcattctttttgtctttctctcyatccccacttggtctggagaaaaccagctgccatgtcatgggacagttcacgtgacaaaccttttgccagcaaccatgtgagttgctgagcctccttagaagagtgaagaagccttctcagaagtggatccaccagccctggtcaaggtttcaaatgacagaagcccccagtgacattctgattgcaaccttatcagagactgtgagccagaaccatccagtgaagcagctcactggatggttctcaggaactatgtgaaatgataaacatttatagtctcatgctgctagttttggggtaatttgcttttttttttttttttttggagatggagtctagctctgtctggagtgcagtggggtgatctcgrctcactgcaacctctacctcccaggctcaagcaattctcctgcctcagcctcccatgtagctgggattacagctacacaccaccacgcctggctaatttttgtattttagtagagacagggtttcaccatgtcggccaggctggtcttgaactcctgacctcaggtgatctgcccacctcagcctcccaaaatgctgggattacaggcatgagccaccgcgcctggccggcaatttatgtagcaataaatactaatagtttacatacatttttttttcttttgagatggagtcttgctttgttgcccaggctggagtgcaatggtgcgatctcggctcaccacaacttacacctcccrggttcaagcgattctcctgcctcagcctcctgagtagctgggattacaggtgcacaccgccatgccccactaatttttgtatttttagtagagatggggtttcactatgttagccaggctggtctggaactcctgacctcgtgatccrcctgccttgacctcccaaagtgctgggattacaggcatgagccaccgcacccagcaatacattttaagttttcataaacttttgaatataaagaatttattgggctcaagcccaattctatcatttttgatctttaaagatcttcactgatccttggtagtttacaagcattcattttttatataattgttatcagtgtatacatcctacttcatatctgatttttcctcttagaattatttcatgtataccaatagagtacaagattcttagcatttatactggcggtatagaattctcccctgttactgtgtaaccacgctacctccaatagtcccttttgtacctggtttggtctgtgtgatgatagaatatagcagaagcaatggtatatcacttctgagattagattataaaaggcattgtgctaccatcttggtcattctaactttctctctctccccacttgctctgggggaaaccagctgccatgtcatgggcagcactatggagcaatacacgtgacaagccttttgccaacaaccatgtgagctgctgagtctccttagaagagccaagaagccttctcagaagtggatctatactggctgtatagcatcctgccccgctactgtatgtcacaccacctcaaacagtcccttttgttggaatttaaattccagtttttcaaaataataactggcacaataaaaatagtgcaaattagctgggcagtgtagtgaaagttaaatagatcagctctcttagatacataaaacacagataacacagaaggggcaagtcctcttaaagtacatagaccgtgaacaaatattgaacacatgcatttgttaaataagtgagcaaatacaaggctaacctaagacagcaagtgcaaagtaactaggtgaacttacttgtttagataataactttctagaattctgtgtgtttcctagagaaatacaggaatgacagctgacaataaagctttggaaaaatcctgtaagtaattgccttggctccaagtatcaaagcagaatttcggagaaggtcctcctgcactaaagtcattgtccccagactatgagtttctgcctccttctctttcagcattctcctcccctcctctggctgtcctttgtcagactctacaatcatggctagaagaaaaaagttgacttaaccgttctttgttgaaattcgggactatgttagagataccaggtctcaatcaaatacagccttcaataaaagactcttacgtaaccagatcctatgagcagagagccatcgtgcctccaacttagtttcttcagattggctggttttggtgctcaacttttgactttacccaccttcctgacaaagtgttgaggaccactaggtaagcatgctatcttcaacgttaaaaaaaaaaatcatgrttgaaggcagctgcacttcatatatcaaggagcattgaatataactaactctaaaacttcatcaggtcatgaggttttattgacatcagtgtatttggcttcagctgtgataatcatgtggcgcagtctcttttcctccccgcaatgccytgcctcccttggaagactccctccaccccaccccagccccattcagcttcgttcagaaaaaccttcatttttatctcccattaaagtttgtctgatgaaaaggctctgaggctcaaatgacagctcagttgtttgaaacctgctgggttagagaatggtgctataaggttaagatcaaaaggtcaccaggtcagggtttccttgctgaggaagaaaagcttcagtgacagtgactcagtgtaaagttatcatcactagcataattaaacacacacacacacacacacaccacaatgcatacactgtcccagctggaaggggtcagggtggacttctggctctggcctccagcaacctgggttcaaattctgcctctaccacttggcactgtggcttcttgcagctatttgaacctctgtgagccccattcttcttgtctgcaaactgtagataataatcatgactaccttacaggagaagtaaattggttcagagaacacacttaactacagtgccaagcatggaagtaagctctcaataagaattattgattattaaaactacattcttggccaagtgcaatgactcacgcatgtaatcccagtactctaggaggccgaggcgagcggatcacytgaggycaggagttccagaccagcctggccaacagggtcaaatcccatccctactaaaaatacaaaaattagctgsgcatggtggcacatatgcctgtatgtgccagctactcgggaggctgaggtggaagaattgcttgaacttgagaggtggacgttgcagtgagctgagatcgtgccactgcactccagcctggacaacagagcaagactccatctcaaaataaataaatacataaataaattcataaataaataaatgaaagaaataaaattatattcttgttttagttataacaacattttatatgtctctcaagccaaagtctaatagcattacaagttgtttttgcacatgtatcatctccctttaaaggacagatagtttcttgggattattcttatttttgtcctttatgaagcctaacccagcactttcagcacagcaggccttcaataaatatttggtaaataaataaataaatgttctaaataaagtggatctgcagggacaggtttgtacacataatccctctacttaggatcctagtagaatgacatacacattctgaatgctctataaatattttataatagtaacaatgatataataattataattatgaatgaagattactcttagctcaatttcctgaactagaattatgtccttcagccacggagaaaatgtattcatacagggttccagcttaatgtaaacagaattgtaacttgatttttaaaataactaaagcaaatgaaccaatgtgtcctttcctttcctttcaaacagttgtttccaggaaccagaagtgtggggctatcatatgcaagttgtgataaattaggtcttttccttcaacatttagtctcaaaaaaaagaaaaaaaggaaaagaagactccttaagggcagtatgaccatgggcaagggtgagggaacacacagctttccttagtaaatctcaagcctccaaggttggcgttggaaaggatctgcaggtagcaaatccagctgtcccactgtgcacgccctccccagttcaccttttctctgagggagactcattggtgctcaggtatgcatgtgactcttcacacacacacacacamtcacactcacactcttgccaccatgacttccatttaatgttcaagaattcttctctcacagctctgtaaaatatttgagaaggacaaaaactttcaaaaaacccttaattataactgtagtatataaccatttttttaaatgaaattaaggagagtataaattggaaggctgaggtgggcagattgcttgagctcaggagtttgagatcagcctgggaaacatggcaaaacctgtcttgacaaaaaatacaaaaaattagccaggcgtggtggcgtgtgcctgtggtcccagctacttgggaagcggaggtaggaggatcagttgagcccgggaggtcaagggtgcagtgagccgtgattgtgccactgcactccagcctgggcgacagagtgagaccctgtattaaccccccacacacacacacccacacacacaagagtataaagaagaaaattacttctagggaccaccccagttccatccgtcccaaaggtctggtatgacttcggggatctctcgctggggtgtcttccttgctccctcctgacttgcttccttgctgccatataccctcttaggccctgatgggaaactcagggcacgagatttctacctgcagcatacccaaggctcattctgatccaacttactctgtgaggtttgatccttactgcaacttaatgaaagaggcacaggtaggtattactgccattttacagacaagaaacttgaggcttggggagattcaacagttgggctattgctatttgcacacaattccaagtatttagcagataactaattgcaccacacgaaggtctactacagaaatgggctgatggggtgaaactcggaaccagggcagatgctctttaactacaaagcttgtataacgcgtggtcatgttcagtattaatactagattagcttaactgaattctgagacaatggacacaagacaaattagatttgatgagaaaggagggagaggaaaggttctaaacatgggcatgctgtcagtaggatagtcctccttgtgacccacaactgacagaatggaggaaaatattttaaatcatatatcagataaagactagtatcacttatcagatatgaataaagacttcttacaattcaataataaaaagacacataatctaatttaacaatagacaaaagatgtgaatggacatttctccaaagaaaatatacaaatggccaatacgaattctcaacataattagtcttagagaaaagcaaattaaagccacagtgagatactacttcatagccactaggatatctataatcaaaaagaggataacaacaactgttggcaaagatttggagaaattaggacccttatacattgttaacaggaatctaaaagtgtatagctactttggaaaacagtttggtagttcctcaaaaagttgaacatggagttggctgggcgaggtggctcacgcctttaatcccagcactttgggaggccgaggagggtggatcacgaggtcaggagatcaagaccatcctggccagcacagtggaaccctgtctctactaaaaataaaaaaaaattagccaggcgtggtggcgagcgcctgtagtcccagctactcgggaggctgaggcaggagaatggcatgaacctgggaggcggagcttgcagtgagccgagatcacaccactgcactccaacctgggcaacagagcaagactctgtctcaaaaaaaaaaaaaaagttaaacgcagagttatcatatgaccaagaaattccattcctagatacatacctaagagagaggaaaacatgtttattcaaaaacatgcacttgaatattcatagcagcattattaataatagcccaaagtggaacaacctcagtgtccatcaaaggatgaatggataaacaaaatgtggtacatccacacaatagaatattgtccagcaataaaaaggaaagatgtacagaagccccaggagccacagccccagatgaagctggcatccctgggcccaattcctgctgccacagttccactattgccagcccccagaccttggagatcctccaccgccgacaaggctgctaccaactgccatccttgcagagggggctcctgcaaatcttttaccttgtacttgaagcaggggccagggaagaggactctggaaaggacatgtgggcctgagacaccttaaaaacaggaaaagccctgaggagcacgaaggggaaacttttttacctgtacccttttggggacttttggttaaaactgagaattacattgacatagatcaataggagaaatgcatacgaatttgtttaatataagttttgtgtggcataggagactttacaaggaaatgaagacccaaagatgcaattagagatgaacatgtatatactgatttagacaaagagaagtactttatgaaaatgtgacaaggaaaaggggcttgctagttaatkggtgaagaagtggtgaagaggataaggattagtctaacaagtttgtttgtaatatttccctcagactcttcccctccttgatgatgataatatttccttctggtagagagagaacatcttttgcatgggaattttatctgctgcttttaagaaacagaaggaagggtagagtgatcttcttgcacctgctgttttttaagcgcctttaactcaaaatggtcaacatgctagagtagcatatttttaactccttcaagcagctacaacaaaatggggagaaaaaatagttacaactgtggcagtaacctacacgtgtcaaacatctctcatgaagcaaaattaacaagaataataaacaagtgacatgtcagctatggagttatcctcttactgaaagagatcccatagataataggaatttcaaaaaatctgtaatggaaactggctttaatgtaactggtaactccataaggctcttcactctgaaccactcattaacaagtgcttcagttgatgagcaagttggttcttatcctggactgcagatgccattaggtctctgctggccctatgctgatgaagacttttttaaggatgaaaatgagccccatgttaattcatgttcaactacagaaaacaacaagtgaaactttgtttgctccaaattggaaactgaaatatggaaacagcagtgtggaaggaaatttaacatatgaaggtgatttatcagaaaacgaaaaggcaaaggatactttattcaattatatttaaaggagggacctaaactgaaagccagaaacaacagaaaatgttgtagaatctttcacagaggagccaagtgaagtttttccataccctgattttctccctcctacggagcttcagtaccctggacttgcacagatgaggccctcacaaaatctgaaaattggaaagcaacaggggaaccttcagaaagctctattattggaaatggaaagattacaacatatgactatacaaaaagagaggtcaaagttacaaactactttctgtaccccagcagttactgaaygactttcttcctccaaagctatactgagagtgggacagccaaaactttctgattcactgagtcttcagacatctcgtgtagataaaagttgagaaaaaagaaaaaaaaaaccaatcgggttctttcaagcttgagcaaaatgcttcaaaatggatttggagcaatgctggaaaatataaatgaaattctagaccaccaactctaaaaagttcatccaccacaaaacagttggttgcaacttaggactttaaaactcttaaaagttcatttttaaatccgtggcaagaactttcagcaaggaccaracaacgcactgactggttaaagtggcctcaataaggtgtctgcccccaaggttttcagtaccagtctccatcttttcttgaaaatgagaagaaataaatcaaggcaccaagaaccaatcacaaactttataaaaaaaaaatagtgttgcatagaccattctatatttagaagctatttgttgccttcatttatagctaagggcttatgtattgactaaaaataattcttttctttcatatatctcagtgtgagcaaatctattccaagaagcccagctaaaatatggttcattgttcccagatacaggtattcgcscacgcacagacatacacacacacacacacacacacacacaccccaattgcttgatatgatatcgattggaatttgtgaaaattactgctgagagtattttaattttcttaattgttactttttaaaaaaatagagatgaggtctcactttattgcccaggctggtctcaatccaattcctgggctcaagctatcctcctgctttgggatctccaaatgatgggattataggcacaagcgcccagcctcgcgagagtctttatataaatccaagggcttctatgctgacatgtttgacaatctttcgcatgttatatttcaagaaatgtttcacttagtaaacggttctattcaaagattgttcttttgtgacagttttccagtataattctatcatcagtaaatggtataatgggtagggggaggaagaaagtactgaaacatactacagcatggatgagccttgcaactattatgttaagtgaaagaagctagtagcatgttgttatgttcctagttatatgcaacgtccagaatcagcaaatccatagagacagaaagtaaattagtggtagccagcggctgggagtagggaggaatggggagtgactaatgggtatggggtttcttactgggatgtcaatgttctggaattagtggtgatggttgtgtgactttgggaatatattcaaaaccactgaattatacattttgggagtaaattgtatggcatgtgaattgtatgtcaataaaataactaaattaaaaatgaaatttcaagtataaatccactaaaaattcagaatctgccatacttttgattgattcgttttgcttactcttgagggcctatcaatgtttactgactaaatgcaaagagggagaaataaaggagaggtgaaggctgggaattctggggatggagagcactttttttttttttttcttagagtcgtgctctgtcgcccaggccaaagtgcagtggcatgatctcggctcactgcaacctcmgcttcccgggttcaaggattctcctgcctcagcctcccgagtagctgggattasaggtgcacgtcaccacgcccagcgaatttttttgtattttttagtagacatggggtttcaccatgttggccaggcyggtgttgaactcctggcctcaagtgatccacccatctcggcctcacaaagtgctgggattataggtgtgagccagtgcacccggtcgagggcactatttatttatttatttttgagacagggtcacactctgtagcctggactagaatgcagtggctcaatctctgctcactgccgcctcgacctccagggctcaggcgatcctcctrccttagcctccagagtagctgggactacaggcgcgcgccatcgcgcccagctgattttttttttttttttttttttttttggtgaaaacagaatttcactgtattgcccagaactcctggggtcaactgatctacctgtctcggcctcccaaagtgtgaggattataggcctgagccactgcgcctggccsacgagcacttttaaaatgcaggagtcttcctgcctstgatatctcatcccttatcaccatgcaaacaattctccttttcatagaagagtagacatttggggcggggtggtggtggtgggggattttagaaaatatctactgcatccaaatgccctactctacagacgaaaaagcaaggcccaggaggaggaaagagtttgcttactgccacccagtgagctggcaaaggcgctgagattcaaaatgagctttcctgccttcacatatcttccggctgccctttgcctattccctaaacagtcaggagccatcaagttcaggaatttgcaggtgtgcttcgctgtgaactgtggaaaagcagcgtcttctccccagaggcaagcatgtcgccttgtgaagtttgatggctcttcacttgcacactcacaaaaaagactgagcgtgtgtaacgccctgctggatgtgtgcggtgctagagagcttgggggtgaggggaggactctctcccttaagaaaatcagttgactgcagagctaacattgttttttgagtaatacctggtttttataaagtcgtcccttcagttcccaagctcctcttctgtttgttcaagccaccttcaatttgaaaaagactgaagtcacagcttctcaatccctactaatttctcatggacctactggattgctccaaatcgagtatttgggactgaactaggaagccagttcaatcctgagcccccgaggcaggcgttgggtcttctgtggagtccccagagacctgcaaccttctgaacacgcatcctcccctttcygccgaggactctgtcctgcagccgagccagggcgaatgcacggaggtcacaagggaggtgcccttggaggcgggaggtttctggccgccggggcgaccgtgctgacgaggcacctgcaggaaacagagctctgcacgctccggtccccctcacccggggagggagaggaggtacagaggcgctgggggaggacgtcgagcaggccagcctcgttgccagaacccccgccccagccggagatgggagcaccgcaccgtctcacgggggctggatttcttctccccttgcgggtgtgtgtgcgaggatggacgtggtaaatacgggttggcagaaggagcgaaccgcggtggaggaagttcttctgcttagttctcgccgcggcgaggcccgcgggccaggcgcggcgacgaaggtgcacgaaggtgccccgcgggcctggtggagttgcagcggcgcgcaggcgcactgagggccgcccgcggccggctccgcggtacaaagagcgcccccgcggggagccgggcgtcctctgggcggagggagcagccggggcttcgccggcccgcgccgttcttctcacgcgccgctccggggcgcagccacagctgtcgcccaccgcgggtgagaggcttgctggtccgccccggcttccccgccccggcggcggccgtgcggttcgggctttaattctggcgcttgccagccggggccgactccgccccctgcgccccgcccttccccgagctccgggtccgcggcggagcgagcgagcggccggcaggttgggaggagcggccgaaggtgagtgacgcggcggggccgtgccgcgccccgtgccgcgctgcgccccgtgccgcggcgaggttgtcccggagcgcgaggcccctacccctgcctcgggctggccccgcgcggagccgacttggcgcgcgccggggttgcgcggcggccgtggcggtggcggagggcagcccccgcgggctcccgctcgtgcgggtgaacccggcggcctcggggcggtcctgggggggggtccgagaggtggcgtcggccccgcggccgtcggagtttggcgcgctctgcagcggcggcgctcggccggtctggaggagggagaggcgcgccgggcacggagcagcgagaaagttcgggccgggccggccggcgggagggtgcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatggaaatgagggtctgtttgcttatattgaattcctgagtttattcaagttcatttttaggtggcgttaacagctaagtagctgttcatctgccagtttctcctttcatccaactttctctactaaaatgttgagcacgttttatttaaaaaaaattgaagtgtaataaacatataaatttactcttctaaggtcaaaattcagtggtttttaatatatccgtaaagttatgaaatcatcactaccatctgattccatttcgttgcccccaaaaagaacccctataccgattagcagtcattcttccatctcccagcccttctccctcattttaaggcagctacttaggaagtttttctaagrtagasactgagtgagaaaactgagaggtgattaactttgatcctttttctgttactaggtttggggaaaggtgctgctgaagcaatggaagaaaaattaagtattggctgtcctatggggaggttaaaatgaataaggatggaagagaagctgccagtagaggaataattgcctcctgtagagacccacaagttgggaatacattttatccccttagggcacagggatgctttctgggctctagacttgcctagtccataaatcactctagtcgaggttctgcctcagcgaaagtgagttctgggtgtgtgtgtgtgtgtgtgygcgtgtgcgtgcgcgctcggcagggaatgttagaaggaaaaaagactaggcttaaaagtaattttttaaaatatccaaactggccccaaagaaagaaaccaaaaaaccacaggcaaatggccactggaattgatacattcaagactagtttcatttcatgagtatcagttcacaaatagttctgagttaatgtgtgcatacattaactttttatcccaagtgggaggaggaggatggaaaaggatctagttgggggcagtgcaaggaactgggaagaggaatgggataatggccgaaaggggcagtgcttgtgggagctgaggactgttgagatggaataactatagggtgagcagattctgaaagagcagagtgggtctgtgaaaagttggacacttcactcgggctttttgttggataatgtgtgcatgttttaaaaatcatttttagtaaggagagttgaagctatccaaattatgcaacatccactacacttctcactcacccttcaataagaaaagtcaacttgttttcaagtgtttcgggaagttttaggcctgttgcatgggtgacagcttatgccatcttttttttttttttttggtaatttagaacattgacatagcgagactccgtctctacaaaaaaaataaaaaataaccggatatggtggcacatgcacctgtagtcccagctacttgggaggctgaggcaggaggattgctttagcccaggagtttgaggctgcagtgaactatgatcatgccactgcactccagcctagatgaccgagcaatatcctctctcaaaacaagatgagctgtaccataggtatacatatcccacacccccagccctgccgacggagttttgctcttgtcagccaggctacagtgcaatgtcacagtatcagctcactgcaacctccgcctcccaagtttaagcgattctcctgcctgagccggccaagtagctgggattacaggcacctgccaccatgcccggctaatttttttttttttttttttgagatggagtctcgatctgttgccaggctggagtgcagtggcgcgatctcagctcactgcaacctccgcctcctgggttcaagcgattctcgtgcctcagcctcccgagtagctgggactacaggcaccgtgtcaccacacccagctaatttttgtatttttagtagagacagggtttcactatgttggccaggatggtctcaatctcttgacatcgtgatgtgcccacctcggcctctcaaagtgtcaggattacaggtgtgagccaccatgccagtttttgtatttttagtagagacggggtttcaccgtgttggtcaggctggtctccaactcctgaccttgtgatccgcccacctcagcctcccaaagtgctgagggattacaggcatgcgcccccacacttggctaatttttgtatttttgttagagacgggggttttaccatgttggccaggctggtcttgaactcgtgacgtcaggttatccatccgcctctgcctcccaaagtgttgggattacaggtgtgagacaccctgctcagcctttttttttttttttttttttttttttttttttggagatggagtttctttcttgttgcccaggctggagtgcattggggtgatctcagctcactgcaacctctgcctcccgggttcaagcgattctctgcctcagcctcctgagtagctgggattgcaggcatctgccaccatgcccggctaattttgtatgtttagtagaaacggggtttctccatgttggtcaggctggtctcgaactcccgacctcaggtgatccgcctgccttggcctcccaaagtgctggcattacaggcgtgagccactgtgcccagcctgtagctatacatcttaagagtacatcttcacaaattgtcacaaagtgaacataaacatataacaagtactcacggaaagaaccaaaatattgccagcattgcagaagtgcccctatactcttgtccaatcactgcccctcccgaagagtaaccgttgtgccaactgtggattagttttatctgttttcatgctctacacagactcacacggtatatagcttttagtatcctggtttctttctcaacattatatttgtgagattcagctgtgttgttgcttgtggctgtagttcagttattttcactgctgtgtaatattcaattgtatgactacaatttatcaatttttaggtttgaggggcatttacatagtttccagtttcttacatggtaagtagtgtgactatgaacattctaattctagtacacgtcttgatacacaatatccaatacaaatgtgtacatttgtacaaattctattcagaagtagaatttcccagttccaaactaggattcagtttagaggtacagtcatgcggatttctgaagtggttgtagagtttatacttctacccgtagtgtgagagagttctgttgtgtcctttttaaattggaagagcagtagatctgcagagtttggcaaatggacaaaatatgacctatttattattttttttttggaggcggagtcttgctctgtcaccaggatgagtgcagtggcgcgatcttgactcactggaacctctgcctcctgagttcaagcaattctcctgcctcagcctcccgattagctggaactacaggcacacgccaccacgcccagctaatttttgtacttttagtagacacggggtttcaccatgttggccgggatggtctccatctcctgacctcgtgatccacccacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatattgcttcagtctctgactttttaatccctgcatatgcctaaggatatgctttcatttaataatcctcttattagaaatgtgtgttaatttctggtgttttactagtacataccgttgtggaaatcatctttgtgcatatagtttttacctccctcttgggtatttcataaatttgagatttttgtttatgtggcttgggatctttgttaaactgctgcctgcagagttatccttgaacctaatatggaattgattaaagaaatcttttttatttttttgagacaggatatcattgtgtcacccaggctggagtgcagtgacaggatcagagctcgctgtaaccgtgaactgctgggcccaagcaatcctcccgcctcagcctgcctcccgagtagctgggactacaggcatgtgccactgcactcagctaatttttccttttttttttttttagttgtagagatggggtcttgctaggttgtccaggcgggtctcaaactcctggcctcaaacaatcctccctccttgccctcctaaaagtgctgggattacaggtgtgagccactgcacccagtctaagaaatctttaaattgctaatatgttacctgcaaaagggtgtctcattgggttaaattgcaattctgaaaataatggtgaggttgaccatgataacttctttaaaaatagcataaattgaacctttgtggcaatttcatttaggtatcactgattaattttctttatatggtcctgtttacaaaggtattgagccaagagcttgaaaggatataagaaggatcataccattaagtagttgattgtccagaaattatatctaataattaaaaataccagttaggcaaaattcttacacatgaccaaggagtgttcattctacaaatgcagtgcttgtttaagttctgagggagaagtctttcttgtctagatgattaggagctgcttcccccaaaagtaagacttgagctcagctttaaggagtctctagaaattggctagggagcagacatcactaaagagacactgagccttctcaaggagagagatcagcggtgcatagggagagccccggttgaccactggacagtggggttggtgatgctggcttccttactattctttttctggaagataccgaaaataaatgaactaatatataggccgaaaaaagtacttggaggattttgggagaaagctgtttggtacattcaagtcagcatcatggggtttaatggtaaacacctgccagagattagaatgcagtaggctgcttttttgcctaattatagatcttaactcctttcccctcaggtaaaattcagtgataatttctctaagatgaaggctgctagaccagccttcattcagaataagccaatatcacttaactttagtaaacagtacttaaatttgtattatgtgcaaggccctggtgggggaaatcagagactagaaagctaagagttcatagggaatgaatgtataatgatgcaaaattgtattaataggcaaaatgttagaaatactcaatatcgatacaaaaggttcactctggaaaggaaagggatggagaaattaatgctgagtagagagatctgggtgatatttagggggatttggccttgaaaaatgtgtatgggtgggaattagagtaaagggcactgcatttaggcaataggttttgaaaaagtaaaaggtggcagtgcttgacacataataccatggtcagtcataggcttggagacccaggtgaatggcaatttgagattgtacctttcttcctgtgacttgtgactgctgagccagcctggtgatctctgtggaaatattgtaggtgtaggcccaggctggctacttttaatctaggatctgttgcttgctgtgtgacctttggcacagttactaaacctctctgtgtgtcaatttcccatctataaacagggataataaaagcatctcctttattgggtayttgtgaggattgaatgagttaaaaccaactctgttggttgaggcagtcacctgtccagactcaagaacacttagaagggtggttggtatacagtaagttttatacatgtttgctgttattcccttaatttttgaatttctgaattatagaatttctaatactcacacatagtgtaaataatataaacaacaaagggtttaaaataaaaacaaaactcatcattcttgtctggtcccaactcagctacagtcttggtttaggtgtgataactgctgtttctgtttttagttcttctagtggttattttagcaaattaccccccaaaatttagtggctcaaaaatttgttttatggtgttttggattctgtgggtcagggattcaggcagggctgggctgggtgattctgctgctttcggtgttgactgaggtcattccctggtacccagctggtggatgtgctggtccactggctccaaaaaggctttgctcccatgactattgccttagtgggagtagctggaatgctgggctcagcaatgactgttgagcagagcacctacacatgttgacttcatttgtcttcatggcaactacatgtcttcatggtgacttcagcatggtggctccaggtagttgaacttgtgtggcagcaggcttccctcatgtgttactaagggctctccagagaaacataaccaatagtgtgtgtgtgtgtgtgtgtatgtatatacacacacacaagatttttaaaacaaggaattgacttattcagtttggaggcgggctagtcctaaatactgcattgtgggccaacagatggagacaaggagagtctagaagaagactgaaggaggtctgctggagaattccctccagctcagggaggccggtctttttgtttagttcatacctttagttgtttgcatgaggcccacccacattatggagggcagtctcttttacccatagttacctgatttaaatgtgaatctcatccaaaaacatcctccaagtcaacacataaaattaaccatcataccctgctacgagcaccttgggnaaaccagttggaagcttcatggccttttatgacatattatcagaagttaataacttcccttttgccaaactattggttgtagcacaaaacttgctcaggctcaagcagaggggacatcgacctgccacttgatgggagtgtcaaagaatttgcagtataaaatatactgccagtctatgcttgagttcataaatttgacagtgtctgttaacttcctgctaaggaagaagtggaatttatattccytcacacctctctttcctcttctctctgcctcctggtttttattagatatcttattatttttgccttattatttttagttgtcttcttttggttacctttctgatttaaaataaagcagtccattctttaycaggccgtagagatatggaaaactcaggtttgttgaagggtatggtgttggggagggacatggcagaaaagcagcttcaaatggttgaggcttgacaatgaggctcttgttaaaacactccagccactaaaaatgggaattgcctatgagtgtgtcctctttgtgagcctagcaggtggcataatttgacactttttattttttctctttggcttttaaactcagatacctgtttgcctttttcttccctacacttagcatttaaattatgaatgctggaagcaaatgatattttcaccaatgaagaatcttattacagacacatggttgagttgagtgtttgtatgtggatgtgctgtcagaaataagtgctctcttgcttttttcattaccaaagcaatcagttaattggaaacagagtgtcaggagccctgtaactctgttggaggtgttttgggttttttctttttttggattcatttagttaatacaattgagcaatggggcttagtttaactctcagaacacataactaatccctttttataattatcatccaagaaacatataagaacctctagtcttgttggtttgcattcattgtatattgcagatataacctcttttgatatttgtcttactaataaaatttgacttggttagtggcaagaatgtaaatttgtgtttgatatctgcataatatttttggctaaattttttcagatttctgttgttaattctgactggttcaccctttgaccttgggaaaaaatagaacaaaagcaattagaacaaaagtagatactttgggaggccgaggcaggcagatcacttgaggtcaggagttcaagaccagccatagccaacatggcaaaaccccatctctactaaaaatacaaaaattagctgggcttgctggtgcacacctgtagtcccagctacttgggaggctgtggcaggagaattgcttgaacccaggaggtggaggttgcagtgagtcaaaatcacgccgctgcattccagcctgggtgacagagcgagactccgtctcgaacaaaagttgaaatgaaacataaatactgtattcaccttttctcttttctgtcctcctcctctccttccctccttctcttactccctccctctcttcctccctctctctctccctccctccctcccttcctctctccctcccttcctctctccctcccttcctctctccctcccttcctccctccctctctccctccctcccttcctccctccctccctcccttccttccttcctccctccgtccctcccttccttccttccttcctattcatctcaatagagctgctttttcctctaaaaataatagcttcagggtagccctttttaggggatgggattatccctgttatgagatggttcagctcacttttctgccaaatactccctcatctcctttacccaaatggagccacagaccaatctgaccatcttggtgtcatatccccttctagtcacaactcttgccccgagggtatccttacttctaatatcatagatcaatttagtcagtttttgaactttatgtacctgagatcacagagcatgtactctttcgtgtctagcttctctccatgttatatttgtgagattgatccatgttgtatgtggttatgggttcatgctcattgctgtatagtgttccatcatgtgaatatactgctgttcatcctgttgtccatgaacgttaggtttctagttttggaccagtatgaacagtactgtcatgaatgattttgtatgtattttctggtgaatataggtacacatttaagttagatatatatctaggagtgcaatttttgggccatgcagttcaactggagtaggtaccgtcagagtggttttatcaagcggtattcccagcagtggtgtatgagtttcagttgcaccacagtgcttgttattgtctgttgtcttattttagctaatctggtaaacgtgtgttattgattccctagatgactaatgaagatgaacacctcaaaaagggttcatactttttattttattgcatagcaaagtagaaaaacaaagccagtttgaccgggtgcagtggctcacgcctgtaatcccagcactttgggaggcagaggcgggtggatcatgaggtcaggagatcaagaccatcctggctaacacagtgaaaccctatctctactaaaaaaatacaaaagattagccaggcgtggtggcgggagcctgtagtcccagctactcgggaggctgaggcaggagaatggcgtgaacccaggaggcggagcttgcagtgagccgagatcgtgccactgccctccagcctgggtgaaagagcaagactccttctcaaaaaaaaaaaaaagaaaaaaaagccagttaaagaattcatctagagacattgtatcagttctttaaccactctagcttttctgtttctctacacatttattgtgtttttttgttttagttttatgagagatgtatttcaaggaatttacttctaataaaaatttaaagaacagaagtttatggataactctactagttctgagaattaaggtatttaaaggatgaaactgctcatactgtattactctttcaacttttctaatttgttaactcagtctatttatttttgcctttcactttgacatttttataggagaatttgaatcatgttctatagtttccaggaattaaatttccacataaatgtaaaagaaaacttgagatcctgatgcaccattttttaaagggttttaaaaaggggaattgttaacgtagggataagctatatattgtgaggcttcgatggcagtgctgttaagttcttgtcacttcttagcaaatgaaatgcatagtttcaaggaaacctcacgtgtggtttgatgtgtttgagttcgttttgatttatttcctgttgacattttgagatttcttcctttagcttttattctgggcacctattttatcctctcagttgtttctttttaagacctgtatgcctctttaggaatccaacatgcagctgtcatctagctttgtacttctgtgcatatattccatcttcccttaaatattattggtgtattgctgatcaggggacagacacaaggtggtcttaaatatctgtaaggtacttacaggtgttgtttggcctcttggtggcaagactatgtcctgggtcagattatctaaagggtttttggagaattcaggcttttgaccttggaggcagaataagatttctctgcctccagagacaccaaacttttaactccttttggagttatacttcaggagtaggaggaaagtttgctgaattcctatcaagaaaaggtggttgagagacatgattgaagattgcttaattcatcacagtttctcagctctggcatgaaacagttgggagaagcgattcaaataactgctgatgaaagttgtatattatttttccttttttgaagtttagggaattcagggctagctcccaaatgagatcatgtgaacttagtgatgttctttctggtgggtctttattagagtcagtggggagggaaggggagcggttttggctgtagagtgggatctgaaaattgttcataatgctgggaatgacagaaatgtgggtgcgaagtgcagtgcagagacactggcttgaggaatagcaaggccttttatgatgggcccaggtgggaggggagttactaggttatacttcataggcattcaaaaatacttgttgaatgaatatggatcattttatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattcagcaagctgtttgtgtttgtttttgtttttgttttgagacggagtctcgctctgtcacccaggctggagtgcagtggcgtgatctcagctactgcaacttccgacggttcaagcagttctcctgcctcagcctcccaagtagttgggagtacaggcatgcaccaccatgcctagctaatttttgtagtttgagtagagacagggtttcaccatgttggccaggatggtctcgatttcctggcctcatgatctgcctgcctcggccttccaaagtgctaggatcacaggcgtgagccactgcggcccggctgcaagctgtgttttgtccggacggtttcgattagtttttaggctaataaagaacactgtttctttttgtttcttttttaggtttattttagccaacctgaggaaacaaaagcctactgttaggatattcatgggaaaatagggaagccttttttttcctttagtgaaatcctatgtgcctatagagctttttcacactttctagagaaggtaagcatctcttcctgagaaagagtggggataatatgtctgggctcaattctgcctgttgtagggaagggtgtgccggtgggtcaccttttgaggttaagaacgagtaataagaccttgaggattcttttttttttttttttttgagacagagtctcgctctgtcacccaggttggagtaaagtggcgtgatctcggctcactggaccctccgcctcccaggttcaagtagttctcccgcctcagcctcccaagtagctggaattacggagtcccccaccatgcctcgctaatttttgtatttttagtagagatggagtttcacattattggccgggctggtcttgaactcctgacctcaagtgatccacctgcctcagccttccagagtgctgggattacaggcatgagccaccttgcccggccaaccttgagggttcttagccatccccaaatgatctgataaagtagccttagtactgtggaaaaaagtgtcactctttcctgctctgtcaactttgatagcaaaaggaggaaacactgctaaaggggcttgaagtttatatagtttgtgaatcattttcttgggaacttttcaaaagaagtgttgtaaacctctgacctcacatccagtttgaccagataactgtgcttacctgttgaggcccatctgatttgagtcctggcttaaagcggttgttcacatgttgaagtctgtatttaagctccgctcccaggctgggttgtgtcatcccgagcctccccttctccctycttgacccccagtggcccagggcagtttttactttaccgtttcttcctggctttttacctatacttttcggccagacacttcaaggggatctgattcgatgtaggggaggggttcggagcatgggttctagaatcgaaactctactatttcctgcgaggtgtatgttttctttgcttctttgtgtttggaaagaaatattgatattgtcattccgtggtgtttaagtgtgtaaagaggaggagctgggaggaagatgaaggaagacctaggatgtagtatttcctgactrtaaaactccctaggaaaagtcctcaaagagccaccttgtttactttaggctagaggagcggagaaagggcrgtgaccctrtatgacatacagtgaacaagagaggtggaactctggcaggaagtaaagggtagaggcaggctcagggacccaagtcttgtaggaaaccacaactccatgaagcctatatggagtttcttagcattgtctttaaatttttttttttttgttttragacagagtttcgctcttgttgcccaggctggagtgcaatggcatgatctcggctcaccgcaaactcccccttccaggttccagtgattcttctgcctcagcctcccgagtagctgggattacaggcatgcaccaccaggcctgactaattttgtatgtttaatagaaacggggtttctccatgttggtcaggctggtctcaaactcccaacctcaggtgatctgcctgcctcggcctcccaaagtgctgggattataggcatgagacactgcgcccagtgtctttcaacttttactaggcaccttataattgtgtcttttcccccaaagcccgctctcacgacagcctctggatatcaagatctgtcagccttaacttagtaagtgttctgagtttctctgaacttccaacttctcaggatctgccacaaatttgcaaaaggtggtgttgaatatttttccttcagaaattaagtttttaattcttgtatattttcataggagtagctatgagaggagtcttaactttgggtattgtttttctttggcttctagagaaaagtttgagaggtctagtgattttcattaagttcttttttaagcaatcatttgtgaaactattcacatcctcagatcttggtaagatttccatgcagagcctaatactgaaaagctaaagaagaacctggactttttggaatgatttcgacctctcataaaatcccagacaattacatttccttattttgccaggagactggtatgccagttaagtttataacctcgatccttgttttatcctccatcagttagagattaattacatgcctttggaatggtgagctgttgagccttgtcgtctttgaacctactattgttctcaataaggtcttctaaaggtcagacaaacaagtcatttagatttttctcctccccttaaagcatgcatttataaggcaaaaacttaatgatcattcattccattccattgatcattaaaacagctttaaaaatgaagtggtttcattactcatattagtctagttatgctcagtgacttaaaacaatacattttaatttctagacttaatgagccactccactctgggacatacttatggcagagggtaagaaaagaaatgaccatagccgggtgcggtggctcacacctgtaatcccagcactttgggaggctgaggtggatagatcgcttgagcccaggaattcaagactagtctgggcaacatggcaaaaccccatctctacaaaaaatacaaaaattagccgtgtgtggtagcacgcmcctgtagtcccggctacctgggaggtggaggtgggaggatcacctcagcctggggaggttaaggctgtagtgagctgtgatcataccactgcactccagcctgcttggtagagtgagaccctgtckcaaaaaaataaataaaaattaaaaaggaagtgaccagttcattcatagttattaacacttctgcttgtgtgtcacttctactcgccttcacttggctgaagaaagtcatatggccaggcctgccagcaatgtggtagagaagtgtggttaattcttccatctggagatgctataagtcacgtgacaatgggggatataatcctctttcagggaggttagcgaataattgaaaacaatataatctaacataatggaagactatatttaactcaaaaaatttaatggcctgtgttctgattcagaaatagtttttagaattggttaaatctgcactttgggttttattttgaaaagattatgcctcagaaatctgcctagatatggaaaacagggtctagtttttggacaggactgattaatcttttatgaattggagagctgtaccaacaacttggtaactttccattagttgtttcccatggctccagatctgtattttaatcaagaagttacacttcttcctctcttgacttttatatcttgattttrcatgcattgttagtatcctattggtcagatgatttttgtttaattgcctgatttaatatggttttggcagccaattaacagtggatgctactgtcaagagaagggtagagatggggccttttgacagaaataaaatttattaaggcctcatcagtctgtcttggtatttttctttcaaaaatgaaactgatgaactgttgctgatgttcttactaggaaatttctgtcttatataaaagatatgaaatcggaattctttgaagcaagatgacaaaataaagtcatacattgctgtgaggaacagaacgtttgtgcctcaattggttattcaccatctacatgttgagattctttttgtgggggatcttggccatttctgcatgttcaccctcacactcctttttatgaggtgtgggggccatctacttaggcaagagtcttaggtagcttctgtaatttttatgagaaagctgaagtctcttctgcttggttgacttttaaaaagtaggtgcaccaagcctcagctggtgtcagactgctgcacttggggttcttcctgagctcttaacctgcttccagctcttagtgaaaacttgtttttgggagatggtgttcattcatgaaatttcatcaaacactgggcacttggaattctctactttcttttccctccagattctttttttttttttttttttggagacagagttttgctcgtcacccaggctggagtgcaatggtgtgatcttgggtcactttaacctctgccttctgggttcaagcgattctcctgcctcagcctcccgagtagctggggattacaggtgtgcgccaccacgcgtggctgatttttgtattattggtagagatggggtttcaccatggtggccaggctggtctcgaactcctgacctcaggagatccacccacctcagcctgccaaagtgctgggattacaggcatgagccactgtgcctggctcagattcttttattgaatgaacgtctactatgtcttcagcttccattatttagaaatagagaagagtttaagaaacagccacaggcagctcatacatggtgatcccttttgcctctctcagtggcccttttttggagaactgttagaaaagttgctgtaggccttggtattagaaaatgttggcacatttcttgggaaaatgtttgatttgttgaataatgtaaatattgtaagagattgtgatttcctcattgctttgaccaaatttatatcccactgttaaaaagaaatggagaatttcatgatggttatttactaatttaggtctcattttacgattctgttttcccttttgctgaatttatttatttttaaattaaaggtaaatatagttacatctagttttgaaagatgccgcaagtgtttttggaccaaggttgggtacagatacatatatcgtggttccttcatgcagttgaaagttttaagaggactctgtgtgggggagtgcacatacacacagctggatagcactcctaacgctcctttctgtgctcactccgtctctttcatggttttcacaagcagagcatatgctctgtggcatactgggggtactcagtactctgtctcagtgctgagacttggagaaaggcattctttttgagcccttttgctcatgaggaagggggtcctggtgtaccccagggtttgttctccaggcctgggacccacagtggggttgaactggcagaaggcaaagaccataatggttacttctgcagggacagatctggaagggacttcatgctgacttttgggtttttaagttggtattttctgatgagtgactttggtatctcatagaattctgtaaactctaatgcactccttaagcttagcaatgtgtgcctgcctgtgctctcctgaccaccagcctctgacctaccctggttttcacttcattactcctcccttggtgctgacagctcatgggaattaagccagaattggcccaaaagctaaatgcctgcactgctgagctgtggtttcccatgaaaatgccttccctgagttaatgttagccttttgcttgtattgatggataatgcaaaacatgatcatctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaaygcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagcctttacttgattaagtcgttctgtagttttttgttgttttttttttcttgacaataactctgccttttattgtttgacttttcaagtaactttttggagtgtatgtgtataagaattcaagtcaatcttcaaaggaagagaattcatttattacagagatttgtttatcttagcttacggctggttttattttagctttggccaggttggcaccattgtttcaagtagtatgtcacttattgtggggttttttgtttgtttgtttttgaaactgtgtcttggcctgtcacccaggctgaagtgcagtgctgcgatctcagctcactgcaacctccgcctcccaggttcaagcgattcttttgcctcagccttccaggtagctgggattacaggtgtccactacgacacccggctaatttttgtacttttaatagagacggcatttcaccatgttggccagctggtctcaaactcctgacctcaggtgatctgctggtcttggtcttccaaagtgctgggattatgggtgtgagccaccgtgcccggctcgttactggttttgatcagtgttctgaaatagtaattttgggtatgctgtctctctacaggcttctgtttgattgaatttcatttatacaggtattaacatgcttgtaaactactattgtctattgctttattgctttggttagtcaatcccaaactcttgctgccttttttttttttttttttttttgaggcagagtctcactctgtcacccaggctggagagcactggctcactgcaccaatctcagctcactgcaacctccgcctcctgggttcaagccattctcctgcctcagcctcccaagtagctgggactacaggcatgcgccaccacacctggctaatttttatatttttagtagagacggggttttgccatgttggccaggctggtctcaaactcctgccctcaggtaatccacccascttggcctcccaaagtgctgggattacaggcgtgagctactgctcccagccaactcttgcttcttaaacccaaggaccctgatttctgacagaatatgtatacatacgtgtgtgtgtgtgtgtgtgtgtgtgtgtgtgtgkatttatttgagacagagtcttgctctgtggcccaggccraagtgaagtgyagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgcygtttctccattagaactggaattggggatttcacaaggacctcttggaaaacttcacagttagtttwaaaaaaaaatgcatttgtcacscagaggatcaatatttttctaaaatttctaaaataaaggatcagtttgtttctgaaatttggttacctgaagccattgacaaattagttgtttcttattcaggttrcttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataagaccatcattggttctcatatgggaaaaacccttgaatattggctctaggacagattttaaggctgggtgtggtggctcgtgcctrtaatcccaacactttgggaggccgaggctggaggattgcttgaggccatgaattcaagaccagtctgggcaacctagcaagaccctttctgtacaaaaaaataaaaattacaaaaaattatttaaatgaaatttagcaatgttttatgtacgtgtcttctcatacttcaaaaagtcaagttgttctacaaaaccgtccatgaaaacagtagctttctgccctgcttttcccacctgattccctctcctcagaggaatctctcatctatcttctgatgttgaaccataagaaaatgctgatatttgactgctttagatctgtgaaaatgactgtatcttgagaaagcatgcttatcatgtcatttcttgatttttttaaattcaattttggatatttactttcctcacactgtggaagatgaagatataactcttatgacttcccccaacacgtctcttctccyrctgtaatattaatatgatttttgtttgattaatatataatgtttatagtattatttagactggaaataattcacagccaagacatgtaatttaaatatttccttcctcatacagcttttgcccacccagagttaatcattgttttgagtgcttgttttaagtacctgtcactgactcattcccaaactgaagcctaaccttcctttctgtgtgtttgcacacctcagggtagctgtccattcatcctttcttcctgaaggygtcccttctgaagtttccaggccgttctgtaccttctctctgtttctcttccctggatactatggtatcctcctcctttgtggtttcttttggtctctggtttttgtgtgttttttgtttgtttgtttgtttktttttgaaatggagtttcactcttgtcgccctggctggagtgcagtggcgcgatcttggctcgcggcagcctacgccacccagtttgaagtgawtctccttcctcagcccctcaagtagctgggattacaggcaggcgccaacacacccagctaattatgtatttttggtagagatggggtttcactatgttggccaggctagtcttgaactcctgacctcaggtgatctgcccacctctgcctcgcagagtgctggaattacaggtgtaagccactacactcggctgctctctggtcttggtagagagcattggccaacagcttctgcacaaggttacaagggagatagtctccttgagatttggcatatctaaattgtcttttttttttttttcttttaccttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcgggaaaaaaaaaaaaaaaactttttaggatttttctttttgtccaagtattctgattggtctttttgcattcatttttctgggcacacaatggccttctcaaactgggaacttaatgtttttcaattattggaacatttaaaaaattatatttagataactttccctcttttcattgaatttgcattttctaatgttggtggtccttctgggcaatcctctgattatcttacctttttctctcctattttctatgtcttggtctttttattccattttctggtggatttcctcagctttaccttacaaccattttactgaattaaaaaataactttttttttttttttttttttttttttttgagacggagtctcactctgtcacccaggctggagtgcagtggcttgatctcggctcactgcagtctctgccttctgggttgaaggttgaagcaattctccagtctcagccyctcaagtagctgcgttacaggtgcccgccaccatgcccagctaatttttgtatttttrgtagagacctggtttcacyatgttggccaggctggtctcaaactcctgacctcaggtgatccagccgcctcggcctcccaaagtgctgggattacaggcatgagccaccatgccattttcaagctaatatgtctcaatttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacacacacacacacacacacatatacacacacacacagacacacacacacatatatacactttttttttttttgagacggagtcttgctctgtcgccaggctggagtgcaatggcgccaccatgcccagctaatttttgtattttcagtagagatgggctttcaccatgttggccaggatggtgttgatctctcgacctcgtgatccacttgccttcgccttccaaagtgctgggattacaggtgtgagccaccgcgcccggcctcatacatatttttaaaagtgtgtgtatatgatcatattctctctccctgtgaaatcacagatgataatagacttcatatattgttatgcatctttttttcatagaaccatgtgtcttcagactgctccatgtggaggtatgggtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgtaactcaaagaatgtttagggacctaggctggtaaaggtcagagttttctaactcaaggtttgcttccttttttttttaaatccctccaatgagggggaaacagatgctaaaacaatagtgagaagtacttaattggctgggtgtagtggttcatgcctataatcccaggactttgggaagcccatgcaggaggatcacttgaggccaggagtttgagaccagcctgggcaacaaagcaagaaccttccctctataaaaaatacccagatgtggtggtgcgtgcctatagtcccagctactgaggagactgaggtgcgagggttgcttaaacccaggaggtggaggctgcagtgagctgtaattgtacccctacactccatcctgggtgacagagtgagaccctgtctcaaaaaagtaaaaataaagtagtacttaatttgggatcaagatcggcttacaaatcagaacattcaggcttgaggaagagaaaaagcaattaaataggtcaacaattgcaaagcaaaactcaatttgagagttggataaagagatttgattgtggggactctgtcatttgagatgcaactcttggtccagtctcaggtgatgaaaatacagcatcagtagttaactggagtacagcagcattggtgcctttctttctgtgaaaaaagtctttatttgcctaagatgtagaaaagagactgtagtgaaccagagaccattttattctgaactgtggcagaataaaacgccttctggcgtctgtcctcactgttactctgaaatagcccatatatcgggaaaaaatgtggctgcttctgtgtgtgtgtgttgtgtgtgtgtgggccagattgttgttgtgttacattgtgataccaagagagaagagaacttttgtctagatgctcacctgagacatccacctggcctccaagcagcatgcacatgagtgaggaatttcaacaacttgtttttttcctgtaagataataagtgtaaaacattcattggacatgagcacaaacacagaggcgttatagactagactgtaaaatcgtctgtgggccactctgagcccctgtggtcagtcctttccttggatgactctaaaggggacttgggccccacttaggcataacggtgaacagagatttaaaaggagtttgagagcattcgtgtacagagatttaaaaggagtttgagagcatttgtctttttttttttttttttttttgagacagagtttcactcttgttgcccaggctggagtgcagtggcaccatctcggctcaccgcaacctctgtctcactggttcaagcgattctcctgcctcaagcactttttttttttttttttttttttttaccatttcaatcattttgagtgtatagttcattgatgttaagtatgtttacattgttgtgccaccatcatcaccatccatctccagaactctttcatcttcctaaatagaaactctgcacccattcaacccttaactccccatttccctccactccctccagcccctggtaacaaccattctacgttctaactgttttatttttaaatttagacatatagttgatactcagaagcttaacattccttatatgaaagtcttcaccaagctacttggcgtgagcatcttatttgccctttaagccttaccctgggaataaaatatagcctttatcactgtttttggaatatcttggaagtgcgtaaaactgcttsagtttattatgtagaagtgcatttccagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccrggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgtgaggttttgaacaaaggttgttgaaaaaaggagataatcattaattttttcagtaaaattcattgaaccccaagggcaatttggaggggtcatagctgtttttagaatctgttgctaatcactgtatatcgtagatattaagcctaggttaagagcattagtgtgggtacagagtttagatttgccartttgtgactttaggcatgtttaacctttctaagtctgtttttccatctgaagaatggacatagagaaaatttatcactgggctttttgtgggggacagatgaggtaaggcataatgcatttaaagtggcaggcacagtctaaatactacctagtgctcctgcacaggcatagaaaatggaaaattgtttatatattttaccctcctccaaaacactcttagaccatctgatttttatttgacttatctgaatcctgaatagtttttactggatcatactctggtatctggactgtccctggtttgaaggtggtgctgctgggtgagaagccaaggatgagagaggctgtgttttggaggcccagtctgtcaaaactgaggtggcatttctagttcctgatagagtgagacagatgcaaaggtcatgggagctttgaacagtttctatgcattatgtgttgtttttcatcttctggaagtgggctggaatttgttttcagcagctaagttcattatgtagttgcctctaagccatgcctccccttttccatgtttgtgaaaagcaaaacaaaaccaccaggcacattatcttttacgaggacctggagattgactagctgacacccccagatttcacatttatgttgagataaggagaataatgtaagtcacccagactttttgtcattctgcatttttattcacagggatgaacagaagcttgcagattgggagaaagkggggggcagaaccagttgttttcaggtggacccaaataatgcatctgctttgataactgcctatctcgatttgcttggaaagggcatagagtaataaatagtttgtgggagtgtgaagaatgagcctttagactgacccaacttgtggaaattcagaaaatgcagaaatgtacgttcttccagcttgtgaatsctgaacaatggaattgttagaagaacttttgaaacttgttctttttttgaaagtattattgtgctcggttggctacatgtgctttggtctcaaaaatttgtgccttaatcacattgctggggaggctgtggatttcactatcaacagaaagtaatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttggcactgagagtggcacagtaactctgcccagtgttctcagactgcagtgggcaagtttccagcaatagagtcacccaaagaaacaacgcagcctcctttttttctttctctgttgcctagggcagttttcctcagacctcagtacctatgtcccttgcttttggaataaccccattaggtccccaaaccttgcctttgatgtatgtggcttcttgaggatcccctacatttgcatctgtttccttcccttatgcaaaggccctacgtcttcyctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcasaggtactatgatcatctccaagtgacgttcagagaggtggtctgccccaggtcacagggctaaaattagtaacatgtaaggaaaatggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttyaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctactaaaaaatataaaaaaaatagccagacatggtggcgggcacctgtaatcccagctactcgggaagctgaggcaagagaatcacttgaaacccaggaggcagagtttgcagtgagctgagattatgccactgcactccaacttgggcaacagagcgagactgtctgagaaaaaaaatacacaaaagcacacatttttttatattacagttgtgtagatcagaagttggacacaggtctcactggaataaaatcaagaagtcagcaggaccagttccttctgaaggttttggggagaatctgtttccttactgctgcagcttctagaggttscctgtattccttggcttgtgacccgtttcttcatcttcaaagccaccactggcaaatttagtcccttttacgcctgacatttcttctggctcctcttatgtgatcccatctttctgtctctgaccacagaaataaaagactttttaaaaagactcattagattgggtccatctagataatccaggaaaatctctccatcccaaagtccttaatcttaatgccgtctgcacaatgacttttgccatgaatgtaacatagtcacaggtttgggaattagaagttgggcacctttggggggcgcatttttctgcctgccacacatgataaggtgtagacacaatacagttaactctcttagttcgcagtcggcacccctttaagtaaagtgtgtggtttctaatcaagcattttattcagggtgcatctgttccacctggctggcagcacgcaccttgcaggtcaggtgtgagatgagcaagacccattggaagactggaagctacctccttctctcttttaggacaagraagcgagagagaagcgaggagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaagctgcgttgatgcttgcacctctgctcttgcgtgggaaaattggacccctctgtgacatttggtatgttactgagcagggttcccttggggaggacgagaagcctcctctccacttgacacttggaatttgataccagttcctgtctgacagctggttagcctgtcaggccctcacaagttaaatcttgtctcagaaaataatttgctagaagatcaaagcatggatgggataaattaatttttcaacaagccacaggtttgggataattgtctctcaagtgttgctaatgtctttgataaacaagtaatttgggggggctctttttttctcttgagattataaatcttgattgattcatatgttgaaaaagaactctgaaagcttgcacctaagatgaagccctggaataacctgaaataataataataggtatatttcaacacctgtgccattcggagcagtgattctcaacaggtgggggtgggagatcgatttttgccccccaggggcatttggcagtgtttggagacatttttggttgccatgattttggggaggggtgctactggcatctagggagtagaggccagagatgcccagaatagcccacaacaaagagttatagaatgtcagtagtgctgaggtggagaactcttgattgagaaaggagtgttttctattttacttattttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgttttttatttatttattttttgagacagtctcactgtgttgcccaggctggagtacagtgacacaatctcagctcactgcagcctccacctcctgggttcaagcaattctcctgcctcagcctcccgagtagctgggattacaggcatgagccaccacacctggctaatatttatatttttggtagcgacgggatttcaccatgttggcccagctggtcttgaactcctggcctcaagtgatccacctgcctcggcctccctaagtgctgggattataggcatgagccatcatgcctggctgaaaactttccagtttttaaatgtcatgcatgtttttgctcaagaacgctttggctgtttggggcattttgtagttccatacaatatttttttccgctgtaaaaaattacattggaattttaataggaatagtattaaatctgtaggtcacttcggggagtatgaacagttttaacagtgttaattcttccaacccatgaatacaggatatctttccatttatttatgtcttcagtttcttttagcaatgttttatagttttcagcatacagatctttcacctccttggttaaatttattactaagtatttcattctttcttttttttgagacagggtctcactctgtcacctgagctagagtgcagtggtgcgatcacagcttactgcagcattgaactcctgggctcaagtgatcctcttgcctcagcctcccaagtaactgtgactgcaggtgtgtaccaccatgcctggctgatttttaaatttttttgtagagacatctctgcgttacccaggctggtcttgaactcctggactcaagcagtccttctgccttggcttcccaaagtgctaggattacaggtgtgaaccattgcacacggccttattctctcttgatgctattgtaaatgaaatcattttctttattttttagatagttcattattagtatatataatagaagtgctactgatttttatatgttgattttagtatcctacaacttcactgagtttattctaacaatcttttggtgaagttctgaaggttttctatatataagattatatcatctgcaaacagagacagagtaacttcttgctttccatttttgatgtattttatttttcttgcctaatagctctggctaaaacttctagtactatattgaatagaagtggttaagagtgggcatcctgttttgctcctgatcttagaggaaaggctttcagctttttaccactgagtatgatattagctacgggcatgccgtatgtggcctttattatgtcgaggtccattctttatacctaatytgttgagagtttttatcatgaaaggatgttgaattctttcaaatgatttttatacatctattgagatgatcccttgatttttatcctcgattttgttaacgtggtattagttaattttaattaatttgcatatgttgaaccatctttgcatcccagggataaatcccatttgttcatggtgtatgatccttttaatgtgcttttgaatttggtttgctggtattatattgaggatttttgcttctctagtcatcaaggacattgacccataattttattttcttgtagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggtttgtgatttctgattcaatctccttacttactattggtctcttcagattttctatttctgtattattcagccttggtgtaagttgtatgtttctaggaatttatccatttgttctaggttatctaattggttggcatatatttgtctatagtagtatcttatataatcctttgtatttttgtggtatcaattgtaatgtctcatctttcatgtataattttgtcttttagttcagctaaaggtttgtcagttttatcttttcaaaaactcctggtttcattaatgttcatttttttccttctgctgactttgggctgttccttttctaattccttgaggtgtaaagttaagtgtatttgagctctttcttccttaatataggagttgattgctgtaaacttccttgtagtgctgcttttgctgcatctcttaagttttggtttgttgaaaaacgaaaaaaaaacacaaaaaaacagagagctggaggcatcatgctacttgacttcaaaatatactaaaaagctgtcatcaaaacagcatagtagtggtgtagaaacagacatatagaccaatggaacagaatagagaccccagaaataattcatatttacagtcggttggctctttgacaaagttgccaagaacacacaatggggaaaagagagtcttttcaataaatggtgttggaaaaactgggcatccacatacagaaaaattaaacccctttctcacaccatatacaaaaatcaactcaaaatggactaaagattgggggcatggctcaggggtagaggatttgactgcaaaatggactaaagacttagtaagatccaaaagtataaaactacttgaagaacacacagagaaaaagcttcttgacattagcctgggcaatgatgttttggatatgacctcaaaagtatcacagaagcaaacatagacaaatgggattgtgttaaactaaaaaaaaaattctgcatagaaaaggaaacaaacaatagaatgaagagatggcctgtagaatgggataaaatggttgcagaccatacatctgataaggggttaatatataaaatatacaaggaacccatacaactcaatagcaagaaaataaataaccggattaaaaaaatgaacaggccgggcgcggtggctcacgcctgtaatcccagcactttgggaggtcgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaatgaacaraggaccttaatagaaatttctcaatagaagacatacagatgaccaacagatacatgaaaagtgctcaatatcactaatcagggaaatgcaaattaaaaccacagtgagtggccagatgcagtggctcatgcctgtaaatcccagcactttgggaggccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctacttctgggtatacatccaaaggaattgaaatcaaagagatacctgtrcttctgtgtccctcgcagcatgattcacaatagtcaagttatggagacagtggaagtgttcatcagtagatgaatgggtaaagaaaatgtggtatatgtgtacactggaatactcttcacccttacaaaagaagaaatcctgtcatttgcagcaatatagatgaacctattcataaatgaaatagccaggcacagaaagacagatactgcattttctcacttatatgtggtatccaagaaagtcaaactctcacagaagctgagagcggagtggtggttgtcaggggctgggagatgagcggtgcttgggagggcgttggttaaaggtaaaaagtttcagttaagttaaatatgttctggagatctattgtacagtgtggtgactgtagttaatgtatacttggaaattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtgcatggtaacgggcgcttgttatcccagctactcgggaggctgaggcaggagaattgcttgaacccaggaagtggaggttgcagtgaatcaagatcacaccattgcactccagcctgggcaacaagagtgaaactctgtctcaaaaaaaaaaaaaaaaaaaattgaaaatccgcaagcttcagaagacacactactgcgtgtttgtccttctacggaagtcagtacagatctcaatgacttgttctcatttcaccagaaaatgaccattgtgcattatgctgtcagtgcagatggaaaactagcagcagtttacaaagtttccacttgaaaaaacataactctaattgatttaaaaaagtagttgattgttgcaagacttgacatttctctagttaatttctatgcctgttgttttgccccttaccgtcttcaaaatctgaatccaaatccagggcttctctattaggaggctccatatcatatctctttaatcctgataatttctcagttttttgtttcctacctacctggctattttcttacgctatctttatttgcttagtaaatataacatttcatgttctattttattttattttattttattattttattttttatttttgagacaatgttctgttgcccaggctggagtgcagtggcatgaccatggctcactgcaacctccatctcctaggctcaagtgatcttcccacctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctrttatgggcgcttcatactgggaacattaatgggaggtggaggtcgtagttgaagctgaaacctgttgggtgaggtggagttcgccaggtgaagtggtagacttggggaagaggagaggagggggagcatcctgtgtttagaaccaaagagagtttagtgtgtgattattgggtgggggtgggagggtaggtcataaagggcctggtaaactgttaagaaattttaaactttatctcaagagttgtgggaaatcactggcaagttttaagttggtaggtgaagtgctggctggaggaatccctccagcttgggtmtgtgaggatggcctgagaacggaggcacctgcagtaatcccccagtgagagacactgtagcctgagctgaccttggggctagaaaaaggggacaaatggcggytgaggaggagaatctctgtgagttgattgaatggggagaggcaaacatcaagcccagtgcccagacttctgggaggatctggctgctactcagtatggcggttgaggaggagaatctctgtgagttgattgaatggggagaggcaaacatcaagcccagtgcccagacttctgggaggatctggctgctactcagtgaaaggaagcctgggaggtttgggagggcagatggatgagctcatttatggacagattgagttcaagcatctacagatcattgaaggggaaatgtgagcttgaaccctgcatttgaagttcagaaaagagaaagagcagaatgaattgagttctgggagtctttcccatgtggatagtaactgcagcggatgaggtgataagatcacctagttagaggtgggggagcagaagagggcttagggcagaactctgaagagcaacctgcaaaggagactgaggaggaatggacagaaagggtggaggaaatcttcatgggtgcttttcaaggaggcagtggttaccagcattagctcctgcagagccaagagaattgagtcattttgctgggcttagcaacaagaactttcagggacttcatggcagcgtgacagcatatggagatgcagtactgttggcctgtacagagcctttttttttttttttttttttttttttaaattccctgagatgtagtctcgctgctctgtcgcccaggatggagcgcagtgactcgatctcggctcactgcaacctctgcctcacgggttcaggtgattcttctgcctcagcctcccaagtagctgggattacaggcatgcaccaccatgcccggctaatttttttgtatttttagtagagacagggttttgctatgttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgygtggtggcctaggatatatctgcacttctcaatckaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccarttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctgggtaagtttgaagagcaaagttgccttttctgttttcagaaatattttaccccgcaacgatgtgtaaatctaaagcctgtgcaagaatgaaaacgagcttgagtattaagatttggcacagtgtgtgcaagcaatgagactgggttaaaaacaggaagtgtcttaatttaaagatggtgatggggagacggattaaaataaactgctggccatgttgaatctgagataggcaagccttggttgtgggcacattcccttctgaattactctatgcagatatattttaggcctctttctattaaattgtctttcacatggtttcaaagatagggctagtgataagaattctcttcctgcatggtgggtaccattatataaacggtatgagcatgcttttcttgtgtctctgtataactgcttggtctggcactccacaaaatagtaaaacacatttctgcagtggactagcccatgctgtgaaagaggaaggtggtggtggacaaaaagtggtaagttttaggctgaaggatgttgatgttaaactttatttctgattatggcagtctttcatcatgtaatttaagaagcctgagatcatctgacttttttttatgttttttttctttaggactgcaggaagtgttgataaacatctgtttaagttgtctataccatgaaatccataatcttccttcataactatgatagcatatggttttctatagttaggaaaactatttctcatgtatttcatggtttggccaaatccttttattacattagtactaaaaaattccttaggatttctagagaaaataataggtattatggataaataagggaaagtaagataattcttaaaccttagtatcagcagtcattctaaaccacattacacatcttcagtaaaagtggttacaaaagatttttctcacttcaaaagatccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcaaagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaarctagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggtatgagtggctgtgactgtatgacataggaactatgaagcggggtgaggggacggtttggtgcgtaaatcctcacgcaggtggcggttattgtctgtgtggaggaaataagcccggttcttcctgggactgctttcatttccctctagcttccagagggtaaaatgaaccttaatggaggttggggggtggcacgcacaaagtcctgggttgagggggcagtggtcagaaagttccctagggtaatatacaaaggagaattaacactggggacactgaggtgggttttggtcctttccacataactgacacctttcaaagcaaggacttgctttctcgtgaggaatgtcagcagtcgcaacaccactgggttggatgcaggataattattcagaatcacgagttacctgtttgcaagcaatcacattgcaggtgggataaataagcagacagtctgtggtaggttcccccaccccaaccgcctcccctccccccagggatactgtaattttaagtattgttttggatattggtaattctaaagctccaatcttaactgggttttatgaaagccgttatagggtgtttattaccaaaaaaacctccttcttatttaataatacagtgcctagccactcctttttccctgcatccgtacatgaagcctgattgcagatctcgaacagtatatttctttgagctaaacagcaagaacagataaggtatcttatcaaaacaccacgccaggtggcgtggctcacacctataatcccagcaatttgggaagctgaggtgggaggattggttgaggtcaggagtttgaggccgcaatgagttatcgcgccactgcactccagcctcagcaacagagggagaccctgtctctaataaaacaaaaacattacaccattgtcagaaagtgatttgttcttctttgttggattaaattctctcacgtgcaaggtagtggccagcagcctaagaagatacacaagctcttcactgtagatgtttggcggtgtgggagttacaaggttaattatgagcgtaaggcccaggcgtcttttcttcctaacaatttcatttcatcctatttctttttccattctttctccgaactgtctatactttattaaagtcttctttttcccagactccagaataatttcctgtgatatgttttagcagtttctccaggaaaaggctccaggagtctttaaatccagccctctttctgctgtatctttgtgcctcacatcttgagagaagttgagtggtagaaagtaaaggaaagcagaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgtttataatggttactctcacctgtgctccagacgctccacttggtgctagaaatacagcagtgaacagacatggttcttgcctccacacagcttgcagtttagtagggcagactgacgacattaaaaagataccatcggtgttgttataatggtgataagagttacaaaataaggggccaggtgcagtgtctcacacctgtaatcccagcactttgagaggccaaggcaggaggattgcttgagcccaggagttggagaccaccctgggcaacatagtaagaccttgtttctacaaaaaaaaaaaaaaatcaaaaattagctgggtgtgttgatgtgcacctgtggtcccagctactcaggaggctgaggtgggaggatcacttgagctcagaaggtcaaggctgcaacgagctatgatcgcaccactgtattccagcctgggtaagtgagaccctgtctcaaaaaaacaaaaataaagggagcatgtaacagtaggatctaatctagcctaggcaagtacggcattcttgagaagtgacttaagacctgaaggactgatcgaattgtctgtgtgaagattggcagcgggtgctctgagggggaaaagcggaaatagcatatgcagacaccctgaggtagaaagggagctctggcctgcttgtgtgattactgtgggagaatgaacaggaagaagacgaaagtagaagcaagaagaccaattaggaggttccarggacctgcctaactaaggtcagttagccggtgattgcccaagccaagactcaaastcatttttatgaaggccgcacaccctcatctcctcagcagttgttaaacaatatttgataatggtgttcatgtcaacctggcacatgtctagaagattcttaagtgactttttcttttcacatggctttttgaccttttaaatataatatgttttaatatgacgttattagctgcacaaaggaagggaactgctcatttgaatgaaccagaagaaacttggaattttgcctgccttctgcttcagccctgccaaaatgtaatttctttaattcatcaaatcacattcttgactaatctgctcaagtctgtactatgccttggcctttttccctgtgacaatttagggatctttaaagaaaatattttgaaatgttttctcttgatcagggtgcttgtggttagrtattgcatacactgcttttatttgcagaatgagctatttttctaccatgtgatcctttgttagaaatgaacatgattgtggctggccgcagtggctcacgcctgtaatcctaggactttgggaagccaaggcaagaggatagcttgagcccaggagtttgagaccagcctgggcaacatagcgagaccccttctctacaaaaaaattagaaaattatccaggcctggtggcacacacctgtaatcccasctacttgggaggctgaggtggcaggatcgcttgagcctaggaggttgaggctgcagtgagccatgattgtgttactgcactccagcctgggtgacagacagcgagaccctgtctcaaaaagaatgcaattgtaattttgtcacctttakttaaaaaaaycatttatcaggtggttgcaatgaaaagcaatttagttgtttacaacctctaccttctagggacttaagtgtgttcagaagtatttaaaatgaaataattatcttagctaataatgataaaattactgtggagcattgagggctactttgtgccaggcaatcagctttaaacacctttgattttctccctatgatgaggggtatactgtgatttttattaaacatttggggaaactgaggcttaaagtggctgagttttctaagagcacgcaggtggaaagtgatcaagctgagtcctcagcttcatatcttctcagggtccttgatcttccgcaccctgtagttctggttcattttaggcaattatcagaagtcacctcaaatgccaagaacctgtgtaacacaggggatgaagtaaatgtgagcaatgtaatgaagcgtttccttataaactgttgtaaggattttgttccagagatgaagtatgagaaaaatataagccaattgttcagtttcatattagtcaccctcttctactgaactttggtaaattcaaagcttccctctatacgaatttacttttataggaatattacaaaatctrtactaagaaatattagaaaataacctgtacttaataggtttaatggaaattaaacccaaatataatggaaatctgaatgaatgctcatttaaaaaaatataatttatagcagtggttctcaaactttagcgtgcatttgggtcctctggagcattatgttaaaacacagatagctgggctccaaccccagaccttctsattcaggagttctgggactggcgtacaaatgtacatttttgacaagttaccagctgtatgagggttctccaaagagacagcataggtatattaggaaggagattcattataggaattggctcatgtgattacgaaggccaggaagtcccaggatgttccccaagaagtctcaagatctgccatctgcaaactagagaacaagaaggccattggtgtaattcagtctgagtctgagggctgagaacctgggagcacctggcgtaagtttccatctccatctgagtctgaagatccaagaaccaggtgcgctgatgtctgagggcaggaaaagatagaagttccagctcaagcagagagcaagtatttgcctttcctctccctttttgttctattctggccctcactgattggatgacacccatccacactgatgagcatccatattggcggtcttaacccttttcccacttagaaaaaaagtgcggtttgtggccagtgcttatttaattttacataaacaggctcttggaggctaaagcaaatcggactgattttcagtgtgaaaataaaatagaaaatattatttctaaacagaactaacatcacaaccatctgaattatcagaatcatctatttcagaaaaatcggattcatcaaatgaatcttccatcaactgttagagaacgatgttaacatcactcataggaatgctatgttttctaggatttgacattttcagcaattgagaattactatattttgtaaatggaaatgccactactaaaaacagaatcctataaataggatgatgtcttttgtttccaaagtcgatatactagaacgatgtgaaaatttaaaaaacgagatctttcgtggcaaggttatcttggggtaaacactgcagctgcaagcaccatgggcaagtattctcagggcaaacaggaagagagttagtgaagtctactaattcaaatgctgatctcttcttggcacacccagaagtaatgttttaccggctgcctgggcatccgtttgcccagtcaagttggcacgtgaaattaacctgcataccaggtaatgtttctgctgctggcctagcgaccacactttgagaacaactaataagtcataagacagtagaacccctggatagtaataagtgctcgtgaaatgagctggccagtagctaatccctgagaaagccatttcctagtcttataccacgtcagtaatccaaagcaggatggcgatctgaagtcctgaagagtcaagggtgatacgatgactctatggagccatcaccactattgggaagacagtggggacacctgcctcccctaccttccacaccatgtacatgatggcacgtgacttagatgtgcaaactgtgcagtgtcagctttgtgatgataaactcttccactcagtctgctatgtatatggcatagtcactatactgctaaattaaataaatcaaatgagtgaacataaatcaggattcagataccaattaggtaaaatactatagtttgtatatgatggggattatcctttttctggaatgtttcagcatccaacctttgctgcgtttgtcttcttgcagtgactgagaattagctgaaataactgtaaaagcgtgagattcccatttggctggagacgaaatcacagaggttggtttactaagccttaagaaattcctttagatttgatgtgtccagacttgtactggaatatgaaatattcaatttgacaagatctgtgagttcctagtacatatgtgtttttagaaatgtgtttctcaaaatacaattaggaaaaaatccctttgaaatgctaaaactacctttagtggtgataaagatgccgacaaccccttctgtttaaataaaaacaaacaacttttaaccttcatgatgttataataacatcattaacttgtgtagacaaacatcagtgctcacatttaaagtaatcattaaacattttcagagttatacttaaaatgactttttaatcatactataaaatactgctgcaaagttgttggtggggtactaagttgtagttcttatttcttctttctctacagtctgttttggctctaccttggggggaaaattcccaaagaattgtaactgaatacagaagcattttaaaaaatcttattttaaagaggaggagaaattttagagctatttctgataataaacctcaaaaagtgagaagtattagaatttatcttggttaattttctttttttaattaaygagcatgcattgcttatataaaacttttctctgtatgtgtctgtatctgatgcagttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagctaaagtccttgttcsattaagataattctgtcatttgtccagttactctccttactcaaattsctagcccctttggtactttctctctagctcttgccctgcttcatgatgttcctgaatagttttagttttctttgtttatttttccactttcttgggccagacctccaatttaattcttttagttgaatgagctkctttctcgcttgttacagactcacttagggctcattcctccctgccttagtcccagtatggtctcagtaatgacatgcagtatggggactttggactcctgtttgaacaaaccagctttgagatgataaaaatttgaatatgaattgagttcttgaagataagaaattgttaattttgtyaggtttgttaatggcatggtagktactctaaaaacaaatttctgggcgagtgtagtggctcatgcctgcaatcctagtactttgagaggccaaggcaggaggatcacatgagcctgagaggttgagcctgcagtgagatgaaattgcgccagtgcacttcagcctgtgtgacagagcaagaccatgtctcaaaaggaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggtgggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacrtaattagtgaatactgagccattgctcctaggggaacaatacagagttagattcctgtgagcctctggttataacgattttgtcagctgtcaaccgatcaatacatagcyttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccacaaaaatgaaaaaaaaaagccctaaaaactagccacaaaagggacatttgttaatagtataagggctagaacaaagagtgtaggctggttttttggcttcagctgggtacatgtatgtggagtgactcaaatattttggtgtgtacttgcttcagtggcacatatactaaaattggaatgatacggagaagattagtatggcccctgtgcaaggatgacacaaattcgtgaagcgttccttaataaaaaaagaaaaaaaaattttggttctctccacctgtgcgcaaatgaccatgagcattagtcttggggttataaataagttttagtagatgaatttgcaaatgtggaatccgtgaataataaggatgtactgtattttttcatctttatttcttaattaacaactgtgatctgtattttaaatgagcctttttgggggagcttgataggcattgagtgtttttcccaaagatttgtcaccttcttgtgagttgtctagtctgttcttttggttttatagatttattctaaactaaaagttaatggtagttgccatttataatttcttgcagaggtttttgcagagatcatccatttaatatttttgtgcattgaaggttttaattgtacagtcaacactgtcattcacttgtgattttcattttttccaagcttagaaaacttgaaggatgatgacttttttattggagaggttraaaaaaaaaaaagtaggtaaaagtgatggatgcytaggctgagggtggtgactgaatatgtggtacttgaaattgagtttgagtgtccaggcctggtttcattatatcttgggacacttaaaaaagtcttgcagaggcaatctgcttgaaaatgctgtataaaccttaaacctctaaattgtaaaatgtaagtgcataataatttctgatttgtagacttctgttgacaatctttcaagacgggagaagggtgaaaaagacggaaaagacaaacagatatttttcagaaatgaaaaacatgtacattttctgaaatagggaatgagagatttttctaaatgtgacccagaaggctttgaggtgatttcctaacaagatttgagttttctcggattaaatatggttgtggctctctaccatgtgccccagtcttatctttgttatgccccttcacacatactctgttcttcacatactcttccttctgctggctagtgcttccctgtttctggaactttcttaagcatttttaccatgtattatagttatttgtattgtagttacgtgtcatccttcttcgtcttagaagagaagtttccatctgactccatgttttctattgtagaccctagttcagtgccttttaaacagcagatatggaataatcctctaatggrataaatggggagaagaagggatagtttgtggttacctgggaaagcagtgtggttaagtcagcatgggtttctcaagaacaagcctttcttgaattaacctcatttcctgtataaatcagatacttattggagagagaatttgggtaatgttgttgttagaggatatcagaataaaaaaactacatgtttcattaagttcttaggattttttatggataagttggaaaagcatgggcttgattgtaataagatagatgaatgtgttgcaggttgattaactgttgactttgtgcaattcactgccttgccagtgctattctaacttttccatcagggaactattaaggaagaggaaagtttatactttattttggagggtttagagggttgagggtacaggaattgaaggttggattgtgggcaggatgtagggagactttagaaacacagccaggagcgaaatgtctttgaagactcatgttttcacataaagatgcattcactttgtatttttaacatgcccatgtttgttttaaaatactttaaattatcaccagataaaatgtttgagtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaasgctgcaaaaagttgaaggcaatcaacatgaacaaatacacaattaagctctactgaatgcagcttcctagagtcgggggaaagttgcatgtttatagaatgggagacctggatcagtagcagctcttgttaaaaagattgaaggtttcagccaaccatttgatatgggtggccttctctggcagctttaatggcacagtactcagaattaaggagataatcatcccgttgttttctgacttcgttaggctacctccgagggcttgttttcaaacaagttctacattttaagagggtaagccagggaaataaatggactagaaactatgccctaccaggaatagttgaaaggctatcggggtggaaaggagagcaaagttaattctcaacttcaggggggcaggattggaatttatgggtagacataagaaggatatgtttttctatttcaatcaattaagaatttttgctttgtaaacacacataaaatggatatcatatactatttagtaatcacttttttcacttgatagagcatgtatatcttatgtaactatttgatatgttcatatgatttttaatggctacatagcatctctctgtatgagtgcactcttatttattaaaaccatccctgacagttactttggtcatttccaatttcttagtataaacaacaactctacaatgaagatatctcaaatacactcatcactgtgcatttgttgagttgtttccttaggacaaattcttagcagcaggacagctgagtcagcattggtactatttacttatggcttttgaatacttattgccaaactgcttcttaccagtaataggaaccgcatgtgttaaagaagtcagattaccccaaattagagatgttgtcataggattttggcagtgggttgaatgttggacagtgatctaaggctccttaaaaaatgcatgaaagttttagtgtaggaccagatgactgtttcatctagaactttcacatttcagtcttactatgtaagtcacactgttaaagaaaactgtcaagagtctgtaacagagaaaatactgcagacgttttctgtattcagaaagcactgtagaaattgaccaaggaagagaggctcatggcaggcaacaacgcaatgctgttaggttgcatgtatgatagaaatagtaaaggaatctttcagcagattaaccattttataacttaggtaagttggggttttccaagtaagtaaattgcattttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagtaaattgcattttctacaccctgccagagctgggtaacaactgcttctggggaagatgggaacggacaaaaagctgctctagatcatgttcccagtaaagagctcaaagtgattttgcacgtgttttatcctcatgacctaaagctcagctgcagtgagatggtgtagtgcactgagattatcagcaaaggggattccagcttcactgcttgagtaagccactgggcctctctgagctgtagtttcttaacctgcataggagatgaattaccaatacaagtcagagagttacagtgaggatttcctgagatgatatattggatagtactttctaacctgtaaaatgctttacaaatattagttgtcaagttagacaaccgatgctagtggagatttccaatttaaagctttctaatggatgaaagagctagtgaacttcatcacggcagaagttgggtctgattttgcttgattttgccttgatgtttggctcatagttgcaattcactaaatatttgttgaatgaaaaaaatgaaatyagcatttcattgttttattaacacattagagaggcacccatgaaaatgtgtgcttctcatctttgtggagtaagtactgctattcattcttacaagcagggaagcagatccatcaattctcaaatcactctcacagccagattctgcatttttcaggtgatttctaattacatgaaagagattagatcaagtactcttttttggttatttaagaggaaagatggaaccaagcctgtgttctgtagctctattgtgtaaaatcacttcgagcaaatgaatgaaatattttgtcagactttttttttttttacttactgacccttaatagaaaataattttatgtgtagccctccccagagtctctgttgccaggaagctaatgttgctatccctaatacggcaactttgtctatttttctgttctttgtgcattgtgtttggtcttaaactgtgaatattccattaactgagaactctgaacagccattgtgtaactggagtgatagtctgtgtcagttcaatgcattgtacttgagaataaacatgctgttttatttgtggtgggacttctctcattgccactagtaatatgttgttaactgaaaatataaggctattaataagcctcataagtactttgcattgttgaaacaatccttcagtgtaggatcacatgattttgtagatatgtatgtgtgtgtctatattttcaaataggcagtagacccattcgtttcttatccttgggtgtgaggtcagaagtgtcagtgaaattgagtccagaattgtagttatgcgtgctttcctagggagaggtttctcttctttttaatcagaatctcaaaattgctctatggttcagaaatgtttagggaccactgacgcagcaaattcagttcagcccggatagtttatttgatctgtggtgactgtgtcactagaaagtgatataaaatacctagactagcacagggcacacataggttctacacaaatatttgttggaaacccaataaaaatcactggtgctttttttctttcttccctgtaacacattatggcctgtgaacctctagaagacaggatctttgtcttacttagtctttggcagctgtgttaacttctcgcgtctgtctcctagtgtcatagaatgtgcactttctttctttttttttttttttgagacagagtcttgctctgtcgcccaggctggagtgcggtggcgcaatctcggctcactgcaagctccgcctcccgggttcacgccattctcctgcctcagcctcctcagtagctgggattacagacgcccgccaccacgcccggctaatttttttgtgttttttagtagagacggggtttcactgtgttagccaggatggtcttgacctcctgacctcatgactccgcccgcctcagcctcccaaagtgctgggattacaggagggagccaccgtgcccggccagaatgcacttcctgtagcaaagtagaagttgtaaaactttttctcaccagacacccttatacatacaaaacaatctgaacatgtgtcctcaacgtagacacctagttataaattatatacgtgtacatatctctattgaggatatatgttcagattgttttatgctaatatgaaacatacatagttgcaatgttgagagatgaaaagtaatgttttagcatgtattgataaccatgatggctttatattaatattaaaagctatacctatttctgcccatgcctacttttggtgttctcataatctgagcatgcgctcagctctggctctttgcagccgctcttccacctcctaacactctttcaggagatgcccttactgttaactgcttattctctgtgcttcttaattcatattcttgagagtcagcatctaattgactcagttcaccttatcattccaggtcaactcatgtgagtctcattgacatacagtgttgtttttggcttctcttgggaagcccactctggtccacacaggtgactgcatgaagtgggaaatgaagacacttggcacagacatggctgttcaggtaacaaagagtgtgtgcagggcggcttcactgagaaggagcctggtgaggctggaatggtgactgctttcaccattagacaaatgtcagtgggtagagaagagagaccaaagtgtgactttagaaacagaaaaatccccttttcttcctttgcaaatccatacctatatattttgaagaccactaggcatgtcaggtaaactttcagcaatttaaattaatcagagagctggagaacatctattcctgttaagatctttcccacccattcaactccctgactagttactgctaaagagaaaaatggtagcagcttcatctttaagacttaagccatagttcttgcaatgggaaagtcaaccctaaagaatggtttcatgtttgctcccattctaccttgtgcagacagtagtttaaggatgtcttctgcagagcataacttgtgtagtcacccaaaagggacttccagttcactgagaccatggtattgcagtaaagaaagagtttaattgacgaagaggtggctagccgcatgggagatggagttatcactcaaattaatctccctgaagttttgggggttgaggtttttcaaggatagttcggtggacaggggactatagaatggatgttgctgattggctggggatgccatcataggagtgtggaaaacagccctcatttgctgagtctgcctctgggttaggggccataggaccagttgagtcatgagtcgcaggtccaggtggagtcagccagtcgtcaaaaatgcagcagtctgaaaagacatctcaaaaggccaatcttaggttccgcaagagtgatgctatttaccacagtaattggggaagttacaaatcttgtgacttccagaacaatggctggttatcatttatacctacgcttttaacaaaacttttattttaggttcaggggtgcatgtgcaggtttgttaatatgggtaaactcgtgtcatgggggtttgttgtacagatggtttcatcacccaggtgttaagttaataatacatagttatttttcttcaccctctgcttcctccccaacctccaccctccattaggctgcagtgtctgttgttgtcctctatgtgcccatgtgttctcatcatttagctcccatttataagtgasaacgtgtagtatttggttttctgttcctgcgttagtttgctgtgggtgatggcttccagctatccatgcaaaggacatgatcttattcttttttatggctgcatagtatttcatggtgtatatgttccacattttctttatccactgtaccactgatgggcgtttaggttgattccatgtctttgctattgtgaatagtgctgcagtgagcatatgtgtgcatgcatctttatgatagaatgatttatatttcttttggtgtacacccagtaatgggatttctgggtggaatgggagttatatttttagaactttgaagactcatcacattgtcttccacagtggttgaactaatttatacttccaccaatactgtgtaaatgttcctttttctctgcaacctygccagcacctgttatkttttgatttcttgataatagccattctgacaggtgcgagatggtatctccttgtggttgttatttgcgtttctctaatgatcggtaatgttgagctttttttccacatacttgttggccgcatgtgtgtcttcttttgaaaggtgtctgttcatgcctttgcctactttttaatggagttgtttttttcttataaatttaagttccgtgtaggtgctggatattagacttttgtcagatggatagtttgccaaaattttctcccattctgtaggttgtctgtttactttgttgatagtttcttttgctgtgcagaagccttttagtttaattagatcccatttgtcaatttttgcttttgttggaattccttttgacattctcgtcacgaaatctttgcccattcctatgtccggaatggtattgcttaggttatcatccaggtttttgagtattacatttaagtttttaatccttcttgagttgatttttgtatatgatgtaaggaaggggtccagtttsaattttctgcacatggctagccagttatcacagcaccatttattcaacagggagtcctttccccattgcttgtttttgtcaggtttgtcaaagatcagatagttgtaggtatgcggccttatttctgggttctctcgtctgttcmcttggtctgtgtgtctggttttgtaccagtgccatgctgttttggttattgtagcccagtagtgtagtttgaagttgggtagtgtaatgcctccagctttgttctttttgcttaggattgccttctatgcctacatcttagcagaattcaggcccttctcataaccctaaccttgtggtgtttcattagctttacaaagttgatttagttttggaaagtgctattctcattcttgctttaaagttaaactataaactaaattttccccgaagttagctttgcccatgcccaggaatgacgaaggacaacttggaggttagaagcaagggtcagatatctgttactgtcacagttttgcaaaagcagtttcacttccctcttctaagtaccttctgcattgattggagccagcaaagagaacttttgcagcatttcttagtttgaatgtgccatataaatgaaacatgtttggaaatgtgaaaccaagtcatccatgagaatgttttcctctgaaaggcagcacttcttgataagtcccttcctcatggaactttggtgcagtgttggcccattttaaaatttattggttacccagggagatgcccgagcttatcagaattagagtctctcatttgagtacgttcttgcagtatagaagtttgcagatgttttataactttaagaggcccagtggtattgaatttagagttaatttttaaaactggctccaaagtcaccagcatggacaaaacttacagtcttccaaagagagagtgccaaagttcaacgcttggcattgttggtttttttttttctttgtgcccatatcaggtagctatgattatcttcattttacagagaagaaaacaaagctcaagagttaatttgactaaattcacagatgagtgaartatgaggtagagagtgatcctgtgtgagaatagtttacatttatcttgatgtggttataaccactaccttatctataatgcatgttaaaaatcaacttctcaagattttttacaccaaaggcaaaaatattcaaatgttgatatagtcccttccattcatttttatatttttgtttaaaatcttcaacatcatacccagttttcaacctaactttataaagtaagcatttccttaatcttcataaacatgtttaagatatgtatcataatttaacaaattactaagtttctgaaatttttacagtagtgaggcagtggatgtatttatgtgtaagtctgtggggtttttttcctgtctctcccatagaggcagagacttgctctgtgacccaggctggagtgcagtggcatgatcgtcactctgttgcccaggttggagtgcagtggtgcagtcatggcatgctttaacctcaaactcctgggctcaagctatcatcccgcctcagcctgctgaatagctaggactacaggtgtgcatcaccatgcctgcctaattttctaaaatttttttgtagagacaaaatctcaatatgttgcccaggctgatctcgaactcctggcctcccaccttaacctcccaaagcactgggattacaggtgtgagccaccatgcctggccaaggttgattttttaaaaacattatttccttagtatgtgtatgattagaagcaaaattacaggtcagaagtcacattttaaaagatcatgaccacttaaaaaacccttaatatgttttgccaaatttatatcttttaaaaatgggatcgatttccacactcatcggggtatatttgagtatgtagctcactgtagacagagctcctggggagggaggaatggctctggtgctcttctacccacctgtagaggttcakctggggaccagctccactgtggggcattgggaggctgttagtgcagaggtatcttctcagtatctgcctgacacactactgtatccagctgcctgacccagtcctgcccacctgccttcctttcttcctgcctcccctctgttttatcaactttgtctcaaaaaaacatagcttcctatctctatatgttcgtctcctatttatggtccctcagtatgttatagtgcttgctaaggtttgaatgtcccatgtgaatctcatgttgaaacttaacccccaatgtggcaatattgagaggtggggcctttaagaggtggctctgccctcatgaatggattaatccattcatggattaatggattaatgggttatcaggggagtagggctggtggcttttaagaagaggaagggacctgagcyagcacactcggccgcctcaccatgtgattccctgtgctgcctccagactctgtcaagtccccaccagcaagaaggccctcaccagatgcagccctagactttggacttctcagcctttgtacctgtaagaaataaataccttttytgtataaattacccagtttcaggtattctgttataagcaacagaaaattgactgagacaatacgtatattctaattgtgttcacttttctttcatctagacttaccagaagtttacttctctggttggcttttcaaggaagcttttgaatttcacttctattttttctattaatgcattcattattagtgaagtattttgtaatcatttttcaaacagattgggtgttttttttttctcatttcaatatgtagttcacttatgttaattatttagggcttacatttttctctgttctcaacctkcatsagattccgtaacayttgataygttgtaaggtttctgttttcattcattatacaccttccccaccccaggccttttcattackttcaacacagtctcgtattaggatttatgttttttaaaacaattatttaggagaatagaatagtttttttctccttgtattgggttttttgtttgtttagatgtctgttgtttctgtgatggctttgttttaatctgtgcttggagagtgctctctcattgctactttggagaatgtattattctttggcctagtatgattgtgtgtgtacatttggggacaaaatgtttttgtggagataatgtagacttaaaattttaaatccgtagctgtattttcgtcacaatgaaaatttgatgtccttagtaagccccgaatagaaagccttgacttgctttttgagcatagttaacagtgttgagataagagaggtttgctggcagttgcactgatggctgcactgttgtccagtgggcccagctgggtgtacagctcgccgtataaacagaaatctagacacaggtccctagaagcctaatctgtgacctagaccctgtctctgaggtactcttaccagaaagttaatctgttagaggatctttcatcagcataaaaggcagaaataattttctaaatgctgttgataaaatgtgagtgcatgctgcttcattcgattatggaaactgagcattggagacttattctcctttttaacaccacttgcctccagtaacttacactaattgtcatctatacsaagcctttgaaaatttgtagtttttgtaagtttttaggaaatatgcatgctaattagataatgcctaaattatgttgcttttcatgtgaatttagtaaagtcatttaagacccgttggcttagtttttcatgagactttctaaacatgcttaatctctgcatactattttaataataatgtaagtttttgactttttgctattataatgggcagtgaatatatttgtgctgaaatctgtgtggaatttttttgaacatcattttcttactgtatattattagaggtgaaatgtttgggtcaggagttacaaacatatatatttttaaaaaactactctaaagatccttgatacattttgtcaaattgatttcttgtaaaaatgggaccagtttgcacctctgttgtggtatgagagagtgcccatctccttggggacctagccccttgatggttccagcactccatcgaaaaccagctccactgtggggtgttttgtgtgacrtggtggtgtcatatgtcttctctgcaagaaaaggcattgttaccaaggcaaacagaaatactcgatacagttatgtataaaccagaggaagcctttgccagagagattgttgacaattgctagagggtatgataatgcagaagttacagagtgttcctttggcaacacgtgttaatggatttgttccagtgttggagccctttttaatgaaaattctcaacacctacactggaaaaataataaaataaaaagccttagtcaggaatgtattgcttgttaagatttagccaaggaagtcacatgttatttaacaaggtagattacttttttctttgtagtaggcaaggaaacagctatgcttcacttctaaataaaaaaaaaaaaawtttwwaaaacgttttttaaaaagaaaaacgtgactaagataactgtctcattcccaggcactttttaatctcatataaatttacatttagagacttaacagtttggcttttttgaatgaatgccagaaatacagttggactatagagtctcagctgagaagcagacacatggagcaaggtatgttctgtcatttatcagaaaagttaaagaattcattttgtttaaaaggcagcacatagattattcagagagagaaaaatatgggtttataggaaaattcttatgtatttggtaaggactctgagtttgtactttagcttcatgtctcataaatcaagtcccaagttcaccaggtgatagtattcccaggttacttgtgggtctaggtgcagaacaactcggaactttgtggttgggcatctttttctgccgtccaactttggaggttgctgggaggagatgcttattttccttttttagggcatttcagtttaaaacaaattaaaaatggaaagtcaatgttttccctccactaatacaactcttaacttatggttgtaataaacagtgattttttttttttttttttttttttaagagacagggtcttgctcttttcccaggcttgagtgcagtggagaaattgtagttcactacagccttaaactcctgggctcaaggcatcctcctgcctcagcctcttgaacagctaggactacttgcttgtgctgccatacccagctatttcggatcatgaggtcaagagatcgagaccatcctggctaacacagtgaaaccccgtctctactaaaaaatagaaaaaaattagctgggcgtggtagtgggttcctgtagtcccagctactcgggaagctgagacaggagactggcgtgaacctgggaggtggagcttgcagtgagccgagatcgctccactgcactccagcatgagtgacagagcgagactccatctcaaaaaaaaaaawttttttttgtagagacagggtctcgatatgttgcccaggctggtcttgaattcctggcctcaggcaatcctcctgccatggcctcccaaagcactgggattacaatatggacataagccaccatgtccagccctacttttgcttttttgaaggacatgtgtgttaagcagaaatttctaaagtcagtgcattttttgcatcagaacatgttttaactcatgagttaaaacatcgctgtttctggcataacggtcttcccacatttccatctttatattaaaaatttctgaaataaaatttctttttgggctagaaaaaggtaagattggatcaagtgatccatttaggacttgccttttcatactttgcagtctcattactattatcacaatgtatgtcctaatacaataaagttgaggtttaaccaaaagttctcttttcttctggcatgctttgtgagaaaatatttgagctggtgtaaattgtaattactggcagatatggaagagagtctgacttggagtattcatgatgctgmtatgctgctgcagtcagtcaagtgctgcgtgagttgatgtcattaccaaaggacagtctctataatcagagaataaagtataatttgtaaatgtggaggagctagaggaacaacttgatttcacttgtcactaaacttatctaataaataaaaatgaggatttattattattattattattwttttgagacagagtctcgctctgtcacccaggctggagtgcagtggcgcaatcttggctcactgcaagctccacctcctgggttcacgccattctcttgcctcagcttcccgagtagctgggactacaggtgcccgccaccacgcgtggctaatttttttgtatttttagtagaaatagggtttcaccgtgttagccaggatggtctcgatctcttgacctcgtgatccgccctcctcggcctcccaaagtgctgggattacaggcatgagccaccgcgcccggtcaaggattttttttttaaagccagaagtaatataagtcggtatcagtgagaaaaggtggtgaggatagcagggattaagtaagtcgcgggcattttatttttatcttaaagaaaatgttaaaatggttgacgttttctagctcracactcccacccccacctcacccattgattgatggtttgctttcgaaatcctgagtgaaaagacaggaattacttcattgtgctgagagtgactgatgtcagaaggtcagttttcctacatttacaagattcatacacacttctgaaaggttttctgttagactgggtggactgtagatgaacagggcactttttgttttgtaattgcatttagctttaattagaggtttagagtagaaagctgagagttgcttggaggagccaaccaggagattaatgggctgtgcccatccgccgcagctctgtgcttccaagaagtttgccagggtaacctggatttgtctttattgtactggaaggagtcttgtcctgtagaagtagaaatcactgatgcatcactaacatcatgtggcctttgttctctgccgcacatgtttgaaaagcgcagctcgcacccactcttcccttaggaaagggggccgaagctctgtacctgtaacattccataaaggctaaggatcatgaggatgttgagtgggcagggccccagcggtctttactgaaataccagagcctgcactctgataatgaatgaggctcgagggaacattcctttggcatattttaatgcttgacctagttgactggggtgctctgggaaaatgagcctcacttcctgcttttccaccttaaattgaagtatggggtgctctgggaaaatgagcctcacttcctgcttttccaccttaaattgaagtatggggtgctctgggaaaatgagcctcacttcctgcttttccaccttaaattgaagtatgtcatttatatgattgttaatattgaaatgagcagctgtaccactctgttctcaacagggaggaagcctttttatttgtaatgtttgaaaatattctttctcagccgcgcgtggtggcttatgcctgtaatcccagcactttgggaggctgaggcgggtggatcctgaggtgaggagttcaagaccagcctggccaacacaatgaaaccccatctctactaaaaatacaaaaattagccaggcatggtggcacgtgcctgtggtcccagctacttgggaggttgaggcaggagaatcgctgaccctgcgaggtgggaggttgcagtgagccgagattgcaccactgcactccaacttaggtgacagagtgagactccgtctcaaaaaaaaaaaaaaaagaaaaaaaatattttttctttttttaagtgtatatattttttaagttgaaacctgtgtttgccttgtctttatgcccacaggggaacttgaagtcattttacatatcaaaagcatcttctcaggttattctgaattttgagaaggctaacatttgctaggctttatgtttaaaaaaacaaaaacagaaaaagatcctgggcttctcccatcttgcttggcaaatgaggagtctagggtacttgtcttaaatgttctgacatatttcaattaaagcagtgaacaatattctcaaagacaaggcagcagctgatacttggtaatgtccttaaaactgcatagtaataaccttcagtgagatttatataatttggagataagctccacttatatctgtaaagttaaagcacagagaaagttagtacagtatttgcctgaggtcagtcacgcagttggtgacaaaagccactattcttagtacttcatgagacttctgttttatataatagattacagaggccaggcacagtggctcttgcctgtaattccagcactttgggagactgagctgggaggatcatttgagcccaggagtttgagaccagcttgggcaacatagcaagaccctgtctctacagggaaaaaaaaaaaaaaaagccaggaatggtgatgcacacctgtgttccagctgctcaggagactgaggtgggaggattgcttgagcctgggaggttgaggctgcagttagccatgatcatgtcactgcactccagcctgggcaacagagcaagaccctgtctcaaaaaaaattaattacagagatagtgttctagttaatagcaaggaaagaatggcttaagcaataagcttggccgggcacagtggctcatgcctgtaatcccagcactttgggaggccaaggcgggcccgatcacttgaggtcaggagttcaagaccagcctggtcaacatggtgaaatcctgtctctattaaaaatacaaaaattagtcagatgtagtggtgtatgcctataatcccagccacttgagaggctgaggcaggaagatcgcttgaacccagtatgtggaggttacagtgagctgagattgtgccactggactccagcgtaggcaacagagtgcaactgcatctcaaaacaaaaaacaataagtttaatgaatgattcccaaagtatggtctatggaccagcatcattcacatcatctgggaacttattagaaattttaaatttttaggccctatcagacctactgcttactctgaaggtgggagtctaggaatctgtgtttttacaaagccctccacatacttctgattcatgataaagtttcagtaccactagcttcataccatccttttataattttatgagtttaaatgctcagggctgctgagataacatacccttgggtcctgagtgtatacaaggtaagaagcagctggcagcctccttgaaggcccagcatagacaaccttactggcctcccttttaatatacagataggtaagaaagcagaagaggaaccaatatttgctctgctaggcactgtgcctatctttcccacagttcccttgcatttagccctcatgccaatcatatgcttgtcatagtgtgctccttatatgttttgggtacttcatcattttctagttgtaatctcagtcttgagagcaggctcagacgtttgcttcgattctttcactggcaatcacggagacttgacattgtttcatttaggggactgtacatttcctcatggggcatgcagtttgtgttggagatacagaaagcttcatcttgaacttggtgcttcttcctggaacagtaattttatttcaggtttgtgggagaggaagaggagggaccttgttttttttttgcaaaccatgacattccctgtacgtaccatgtacctggtgcatgataaataactgttaaatagatttctatactattaacagaaagcttgtattgtgtccggaattggttccttcaggtggtttcttggtctcactgacttcaagaatgaagccatagaccctcacggtgagtgttacagttcttaaagatggtgtgtccggagtttgttccttcagatgttcagatgagtccttagtttcttccttccagtgggttcatggcctcgctgacttgaggagtgaatctgcagacctttgcagtgttacaggtcatgaaggtagtgcagacccaaagactgagcagcagcaagatttattgtgaagagcgaaagaacaaagcttccacagcatggaagggaacccaagcgggttgcctctgctggctctggtggccagattttattcccttatttggccccgcccacgtcctgctgattggtccattttacagagtgctgattggcccattttacagagagctgattgatccattttacagagtgctgattggtgtgttattacagagtgctgaytggtgcatttacaaacctttagctagacacagagtgctgactggtgtgtttacaaacctttagacacagagcgctgattggtgcgtttttacagagtgctgattggcgcgcttacaaacctttagctagacacagagtgctaattggtgtgtttacaatcctttaactagacagaaaagttctccaagtccgcacccgacccagaagctcagccggcttcacctctcagtatcatctcccagatagcttgtgcccacccttcagacttctttgtttaaggcagttattctcaaaatgtcccttgaccagaaacagcatcacttggaaacttggtagaagtacacattctcaagttccaccccaaacctcttgaatcagaaattctgagggtagggcccaggaatttatgtttcaacaagtcttgcaggtgattttgatttatgctagcatttgagaaccactggctttacgcatgagaagtaggattttaaaattgtactttttattataattttctgggaaagtaaagctgtttcacctgtaaactttgggaataggagcaccctgaagctcacaatggcatcctgcaaagccccaaagagtgctagttgttgatcattacctgtgcacacatcattccctcactcagagcccagctaggaggcctcctttcaccttgtaaccaggtcacccctagatgtgatcacttcctccacaagaactgagagagaagagaagaacaccagaggatactgaactggccatactggggcttatggtttaaagggcagaactgagccaaatgaggactcctcagaaaattgctttctcgttggatcaccccagaaataaatcagtaaaagcattcaccttttgttttatttgcttcaaacaaagtaggaaacattcttcttgctttatatatctagataccaagtaaggaagtatgatttggattcttgagtctctttattttatttttcaactgtgtgtgtgtgtgtgtgtgtgtttgcctttgctaagccatggagggtaaaaaatgaaatatattagcaacattgttgacatggaccacagacaattaaatgtttcatttcttattaatcctgaaagaaaaagccttttttttttgttgggcggcagggagggggtgcagtcctctatacaaaaatcttaaaaactaaatatatctattctaattgttttcccctggaacatcatcatagtttaggagtatatctcaatgttgattttaaaaaataaatatgtaaacagctagatttatgcactgttaaagcatcagtgcaagttttaggaaaaaatcaagcatgacaattgaaaataaaataaccattactaagttggactcttctttaccctcaagaaattgtacttggatgtttatgggagaaattattccaaatcctaccagttctgtcagaaaactaatattactctacataatcattttctcccacctctgtataatatttaacttttatttgaaatgtaggctcaagctatgctaaaaatcccatctcgaagatgacgagcttatccatggggaggggatggagggcagagcactctcataactctaggaatttgactgttatatcttgacttaataaatgtctgcagctgaaaataggaaaaattgactatatgcatgtttgaacacatagacataaaaaatgccagctgaagcagagtattccgcatgcaagccaagaaaaatcgggttcagtgaggcacagtttggcagggaaggcacactgaagctgcagggatgggaggtctagtaactggggaggtattcagttgagggctggtgccctccacgtagccttccccgacccacccaccctgggtctgcttccctctgcccccagtgtgggctcccgtagcacagctgggtattagcttggtaatggggaaaggatggtattcaactgggaatctttggcttctaggaacaaaacaaacttggggaggatgttatcaggatactgaagtcctccccaaaatccaggatcttcagagaaaacctaagaatcaaaaatagaaaagcacaggaagttgaaggactctgtctctgtgtgttgtccctgcttctctcagctccatcctcacctttctgcactccagctctgttgtgtcgtccacagcatgcaacacacagatccagctccatctggagcccgcctgtcagctcctcagccccaattttaaaaccctaggggagaagcatcttctcagcataggtctcacatctttatgtggtccagtgagccatggtgggggaggtaggtgggtgcagggaggcagtatgggaggtccacctctgaccctgtggcccagtcagaagaccccaaagagaggagtagcttgcatagatggaacaaaagcattctccctatgttattccgttcacatgttgctgtgggttcattaaccccacacttagaaagtaatcatctttggctctaagaaaatctggaggttggacmtgaaaaacctcaggccagacagtgaatcagtcctggattgtgctgaattttctaatatgactccaccccatgaggcttcatgactgtcagcatctgctgtctccagtgatgctgtgtccgaaattggtgggttcttggtctcacagacttcaagaatgaagccacagacccttgcggtgagtgttacagttcttaaagatggtgtgtccgaagtttgttccttctgatgttcgtacgtgttcagagtttcttcattctggtaggttcgtggtctcactggcttcaggagtgaagctgcagaccttcgcggtgagtgtwacagctcttaaggcggcgcgtctggagttgttcgttcctccggtctggagttgttcattcctcccggtgggttcgtggtctcgctggcctcaggagtgaagctgcagaccttcstggtgttacagctcataaaggcagcgcggacccraagagtgagcagcagcaagatttattgcaaagagtgaaagaacaaagcttccacactgtgggaggggacctgagcaggttgccactgctggctcaggcatctgcttttattctcttatctggccccacccacatcctgttgattggtcaattttacagagagctgattggtccattttgacagggtgctgattggtgcatttacaatccctgagctagacgcaaaagttctccaagtccccactagatcagctagacacagagcactgactggtgcatttgcaaaccttgagctagacacagagtgctgattggtgtatttacaatcccttagctagacataaaggttctccaagtgcccactagactcaggagtccagctggcttcacctagtggatcccgcaccggggccgcaggcggagctgcctgccagtcccgcgctgtgcgcccgcactcctgagcccttgggtagtcaatgggattgggcgccgcggagcagggggcggtgctcgttggggaggcttgggctgcgctggagcccacggcatytgggggaggctccggcatggtgggctgcaggtcccgagccttgccccacggggaggcagctgaggcctggtgagaattggagcgcagcgctggcaggctgacactgctagggaacccagcgcaccctccrcagctgctggctggagtgctaagcccctcactgcccaggggccrgccgctccaagtgtggggccygccgagcccacacctacccagaactcctggcctacccagaactcctggcccgcgagcgttgtgtgcagccccagttcccacccacggctttccctccacatctccccgcaagcagagggagccggctccggcctcggccagcccagagaggggctcccacagtgcagcggcgggctgaagggctcctcaagcacggccagagggggcgcygagagcaggcaagggctgacagcacgttgtcacctctcaatgcctatcttaaacagaccctttacatggcattggtggcaagtgagactggaaattctttgtgaaatgcttgcatgatacaagagccttctcgtaaatctgttttaaaagtgtcctttattctgaataccattttgatctgtgatccactgatggaagtcaatgatgttgaactaagaaaatacataggttactagctatgaaccattccttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcmctcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagaygtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgacttyacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggrtatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacaygttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtwtgtactaccaaacacacggaggaggagwacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgcagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattrcatgcttgtgctgtgccaagctaaataccaagcattttatatatrttaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaaaaagaaagaaagaaatgacttgcccatgttcacatagctggtaaacccacactggttcagaacttaaaccagtgagataccaaagcccatatcagtgggcttttttacatrcttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagtggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcagratgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcastctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttayattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagattttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagrcagatgaacatcttttcatatgccatttatattcctttgtgagttttctgttcmtatcctttgcccatttctccagaggggtatttgctatttttgttactgacttgcagcaacgagattttaaagatttaaaatttttaaatgtcttttattataaaagtatgttagttgttttgataatttctttgaatttttmtactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaagtgctgggattacaggagtgagccactgtgcccagccacaattattatttcttattaacttactcttttcctgtttccccctgcagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataacaaggggatgtaaaggaattgatctagataagtwagtttacttaggcctcagaacctggcctttaatcatctgtgcgyaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacrwtttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgatttgagataggaattaaaattaatttctttcccaaatgartagccacctgcaatttttgtagttcttgtttattagagagtccttactcaaagtatagtccttaagcactattatattgttttttctttcttttgtttgcttttctctccttgggtagtcctttgtgcaaarcgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatacggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattcccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttktctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaamgcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttayattttgtaaaatgtcttaagatacaatgaaatggagaatccctgagtgtttttttgatttcctaaactctgatccacaattatagrtgtttctgaaggttcaaaaataytgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcarcgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactccggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcaccygtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgycacctctctctagttccaaaacatttttgtcactacaaaagaaaaccccgtacccagtaatcagtaacacactattctctcctctctctcatccctgacaatcattaatctgctttcagtctcwgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctrtgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccarctttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttgagacagtctcattctgttgcccaggctggagtgcrgtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattattttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttkactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttttgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagytgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattgtgtggaatgactagatttggggctgtctgatgtttcctagtatttacctttaagttatgcttttttttgttttgaaagaagaccacaaaagcaatgatgtgtcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtttcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtgrtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttrtccacagtgataattatcttccttagcgttttgttctacttcagagctcatttgtgggccttaccacctgtttcttacatatggggaaagagtctcttattctcttttggaatatagatctaagagtagatttatatcrggatttgaaagatgaatctttttcaaggatgtttttcctctggaccgtggcattgtgtaagaaattkccctactcatcccatccctggggcacattaatttggagatgatgttaaatgtgtcagagtgtggcacaaatytcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcastaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaattttyctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccgtagtcccagctactctggaggctgaggcaggagaatcacttgaacccgggaggtagaggttgcagtgagccaagatcacatcactgtattccagcttgggtgacagagcaagactctgtctcaaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagagctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggyaggagaatcgattgaacctgacagatggaggttacagtgagccaagattgtgccactgcacttcagcctgtgtaacagagtgagactstctcaaaaaataatgataatagkaagtttcctmaggcttccccagccatgcagaactgtgagtcaattaaaccttttttcttcatarattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgmaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaargggcatctaaaacaggcagagagcatcaggaagggcttyctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggcgtggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatcccacctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataacctataaaatatgtgtgtgtgtgtgtatatttttatatatttatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggagggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccgtttccttgttctcctaacttactatgctgggaggaaataatatggtgtggtaacgattttaggcaaagaaaaaaagcaccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaaagatcattgtttcagagcatgtgagatgaagatgattgactttagggcatttacatgtgggaactgtcaaggtagttgaagtttacaagagtgggctctctctctagtcacttcgggaggaatgccatcatcaggacatcatcacgactgactgatttggtcagtctgtctttcatcaagtcagggagataaacagaattgaaaaattgttcacaaaggttgtcagttattagggtgtggctgacgaaccacacctgaagagctacctagatgaaggcaactcacagagttacttaacaacctccaccccagttgatggtccagagtgtttccaagggaggtgaactaagccaatgttgagactgagtgggataaggccatggtgacatgcataatagatgcattcatacacattgcttcaatagagcattttcttggatggaagcatgggaaataacacatgggcrtatactcacgcttgttgttagctttcggggtcactgctgatatccttccttgttcagttaccctttgggacttgaactcctgcaagatcgttgaaaatcttcatgttctcagaactcaaagggaagaagacttgacccctaacccttcagaaagctggctgaaaaaaaaaaagattgtccataaatagcaattggctttacctagtattatttaccacattattaaactgctaattgcagtggtgtttttataatgccactatattattttaatttagaaaacattttataagtttattgtttataaattaaatagatttgcttaacagttctttgggaattccttaaactttattgctagctacaagtcctttttaaatagaatcaataggctgggcatggtggctcacgcctgtaatcccagcactttgggaggccgasgagggcggatcacctgaggtcaggagttcaaaaccagcctggccaacatggtgaaaccccatctctactaaaaatacaaaaaattagctgggtgtggtggcgtgcacccttagtcccggctactcaaagggctgagacaggagaatcatttgaaccccaggaggtggaggttgcaatgagctgagatcgctccactgtactccagcctgggtgacaagagtgagacgctgtcccaaaaaataaataaataaaataaaataatgaatagactcaatagacattgatcctgctaacatattttgccttttaatctattggtacttcttttattccctttaaagttaattctaaataaaggagaagtatcttaatttggttaatatcatagtttggaactatggcaaaattattttttctcaggctactttctagcaagtattttatatttattcactaaagaaaatttttaaaatttcaaattacgtagaattgtaccactctcacatagaaatgtttttatctttcttatacatatatttatgtggtttgatttttatttggaatgcttgttttacttgaggtgtcaggactttccactcatttatgaagcctttacaattataatgataaatactgttacattaatgtacaataatttataaaactgactttctcatgtttaaaatttagatcgtgtctaattctttgctactttaagtatcattgcagtgaaatcttcaggccataataagttacttccttgcgataagttcacaggaataactagattaaaggtatgaatacattttaatttggttgaacacttacrtttatcaaaaactctttacaaaagtaacacaattatcctaataaattagaatattagaagtatataagatgaaaaaacattctcactgaacttcagtcctgctctccaaagtgaaccatgatgagaccttaagcaaatgttatatataatgagaaaagatagtcctgaagaattgagtgatatggaagtgataatggtgtactatatgggtgaaaaaatraagtactggtttagatacatgatttaagaaatagaatcctgacagttccctctgtggataagccatagaggtgtccagtgttggtttaatatagcagctggtttgaccgagtaccctctgctgcgtcaggtaatgttaaatgatgtcsatgcccccttgactctgatcaagacatggctacaacctgcagtttccagctttcctgggtttaagggccattgaagaatccttgtagataagagaagaattgtacattccaggaactggaggcatagctagccttggaaagctcggagggttagttgagacagctttagacttgcacatctgtgacctgagtatctttgagacttgatttcatcttctagacccagaggcagagatcatgtttgtggttatttttctgggaactgagactgggcaaagggaaagaggccagtacgcaagagtgctgtttataaatggttaacatcgtccccagtcccgtagaagaagaatgaaatggtattctcctstttggtggttttatttgattgtttttgaattctttgtctctgacagaaggcatcttytgtatcctttatgttgtcactcactttattactctggcattattataattaggttaccttatcactccacctgccagccctatctccatccccaagacctgaagggacggttggcttgacatgtgaggaggttttttggccttcagagatgtcgctgtcagccccctgagttccatttgttagtattgggtccagcccacagctttctactaaaaacaacaggcaaactaaagaatcttttagtaagtcacagacaattgtcactgaaccaagagcccagcccacggggccagttcctcaccgactctrtgccttaatttccaatgtgtaagcttggatgactacacttatctccaggattcagtgtaggacatagaaaaaagtacaggactcaagtaatgattgaacttggaataaaaaccttaaggcccatgtcctctgtctctcatgcttttcagatgtgtcttagtgcctgctccttgcacagaagctgaatccaaacaagccactgaggaagttacatttcacttcacttcttaataacataggtatgtcgatcccattagataggagtgtgtctaaaattcagaacctttgacactaattatctgactgtcaaatgacagtgtcattctattttgcaggcatttttgatagtttatcttcccagtaatatttttgtaatcttcatcaccttgaccatctaactcttttttttggagacaaagtctttctctgttgcccaggctggagtgcagcggtgcagtctcagctcactgcaacctccgcctcccgggttcaaccgattttcctgcctcagsctcctgagtagctgggattacaggcgcatgccaccacacccggctaattttttgtatgtttagtagagatggggtttcaccgtgttagccaggatggtctcgatctcctgaccttgtgatccgccagtctcggcctcccagggtgctgggattacaggcgtgagccaccgcgcccggccgaccatctaactcttatgtgcccttgcctgtacatataaaagtacatttaaaaataggattggctttcatttgcataatgaacacacatattacccatagtacctcccacacaaagccacctatgcctcttaaattgcactttgttaataggaaactatctgttgttttgtgcttttggcagctgtagagaaaatacacaaagccaggtgttgtggctcttgggtaagactgagaatgtgatttttgcaatctgtgtttttttaatagccagttattggagataagaaagagaaattcagtacaaagtctaagatgtcccagtgatgcactctgactggktgtcattatctcaacaggaatgaatgtagttcaacagtatgtaggcccggtttcttagacatgatgtstgctgaartggtgataaggtatcccacattatcggtgtttttttgaagacagcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcccttcagctgaagaagctgcttagaaatttaagccggacatctcaggcggccatactggaatggaatgtggaaaaggtagcagttatatgtgagcaatacctttgactgtgacactctttcgaaccccagtttagaccagcagcagctctcctaatggggagtcaagaagtagtaagagaccctaagagtcatataagacacaaatcacctttrcctgtgatatttgccatacatatgcctatggttacatgcagaggatcccaacaggagcatcatacacacagcaaataacactaatgtgttttatttatatgtaccaaattaaaggggcatacaaaataaaatttttaaatgagtgggtgaagatattgggacagaaggaagatatcaagaggaggaaatatggagtaaagatagaggtagcatgtactgtaaaagatcttgtaagtagaccagaataggccagtaatttggctccatgcttcctagcagccaaggcaaagaagtaattgtgaccagatacatagttcacagcrtctttaagattcagtaagctagcaactcaagaaaagcacaagtagtcaccatatagggacaagtggaccatgctgtgaacagcacactagatagcaagtrcagctgtaacaatcgttgctggagatagagcagagcttcagtcctttatgacragcttgtccaacccatggcccacaggctgcatgtggcccaggacagctttgaatgcagcccaacacaaatttgtaaacttcttaaaacatgagatttttttaaagctcataagctatcattagtgttagtgtattttatttgtggcccaagacaattcttctagtgtggcccagggaagccaaaacgttggactcccctgctktatggaaaatcgaatttgtttacattctcctgttgtattcatttttgaaattttgctaattcctaaaaggaatccacagagagcaaactctctattactaacttttttcctcttctcaatgtaaattaagtagtatttcaaatgagattaaaaacaggatacttcttgaactttactttaaaaatacaggttcatgagcccyttaagttttgtgactttctgttgtaaaaaagactgtattcactagatggcagtgtcamcagccttttgggaagttaaatatgagtgtgactgtcctaagtactaaacatgggtaaaagtaggaagaccatttaaytgagcataaaggatctcatttctrcgccctacaggaaagagtagttctcctttttctcctcccctcttatttgaggccgggaagaaggcgctgtgcatagcgctccaagcatctctgggtggcactggagggccatttttcacaaggagcaagtcggccagcagagtgctcagttcttggtcatgccagtggctgcagggtttccagccacttgtccttgcttctttgtttctgaactttcagtccggggcaggagttactgacaagagttcacaaaccagctgtgagataatggtgtattgataaggtacaaaagtgtgtttagcagatggggataatttttcgaccctcagtgtttgtttaaattgtttctagcatgaaagcartatgatctctctcaggaaatgagattgttttctctattcaggtaataggatcttttacccatttccatctttgaggagtgattatmtacttctgcagtttttttaaatgaaaaagatttatttttaaatcatactggcataaagttaatggtattttgttaaattttaggatttttacagcatatcttggctgacactgatcttggtcctatcctagtggcartctcttaacagtwgtgctgctggtgttatgagtaggacagttcctcattgtgtgggactgtctcgtgtgcggcagggtattctgcattcctggcccttgcccactaaatgccggaagtgcccctcagacatgactgcccagtaacactcccatgcatttccgtgtgcctcctggggtggggccagtactgtctagtgttgaaaactgctggrctagagattttggtgtaggttgtgggccttgtggatttagtgaacatgatcttttaaagaaatgtatataaatctactttatatttttaaaaaatcactacagcccatcaccttaaacttctgctcattcatatttatatatgtattctgattgtgattactcctacatacaatttttaatatagtacaaaatcgtacatatataattttatggtacccatccccccccygccctttttttgagacagggtctcaggctggagtgcagtgatgcaatcatggctcactgcagcctccgtttcctgggcccaagcaattctcttactcagccttccgagtagctggtaccaaaggtgtgcgccmccatacccagctaatttttaattttttgtagagggtctccctgtgttgcccagactggtcctgaactcctggcctcaagcaagtcctcctgcattggccttccaaagtgctgggattatagtcttgagctacygcgcctggcatagtatcatctttttgataccaacatactataaatatattttattgcattttatttgaaactgttaatagacacrtaatttgctgatgaattgtattctttgctcttttagtccatctggcatcatatgctcttcctttttgctagaattccctctttttttctttctacagaagtatcactgggtgggagaaagccttacctgtgatggtttgagtacccacattttaaaattatgctagttaagaagagggggaataatgttgtttcttttctctttttcttatcaaatagactaaaaaggctactcaagggctggaatttgattcccacttgttcttgtggtacctagcacagagtcagtcccatagtatatcctttaggtaaagacttaattaattggtgtgctttcagtttattttccctggttggtctttgcatttgtccagttaacacsagcttctggatattagatcaccataaagtccaagacatgaagaacaaatgttatatattctctttgacatttaaagacagaagatagtggtagaggagatcccaagtgatacctaacctagctaaagacccatgaggaatgaaagaacgaacagggaaaacaactgctgaatccaggtggaaaaatgctggcctacttctggtccttggtatgccaggatccaaaggtggtgccagctgatagcatatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatccactgaagctcaataaagaaatgtttaatgctgaagagtttcaatcaacaagatgaaattttcaggtttaggtaaacttaggaactggcttgggttactagacttccaaattttatccggtcctaccttattgcatgacataaccgtgaggactaaagtgaaggcttttcagcagtcacttcagtgagtcctcagcatttaggtgatactgtatcaactcgtgtctgaagcaacttggatttaagatagtagatcttgtgctgattattagaatggacatcctgaacaccacttaaattaccatcaaactgcatagccagatctttaatttacgaaacctctattttgtcacttctccaagctgtcatttaagctaaaagctgctgtctttacacatataaatcaaagaaatatttcatttatattcacttgatacctaccaaatttcaccactggaatttctgaatactttatatcctctatccttccatccaggcttggctttactaagtgtcctttctaagccactcattatcaatcaagatagtaattattctgcaagaccccaaatctcagtggctttcaacaacacacactgatttttttactcatatgctacacgtccattatttgtcagctgcagctgtgttcagtgttgacctcaacctgtgatggagcagcctctgcttatgtcgctgctgttctttatagcagaggaaggaaagaaagcaaggcaaagttccacactagcccttaaaacttcttcctggaagtgagacatggtatttctgctaccacttcattggttaaagcaagtcacaatgccacacccgagttgagtgagggtggggatatgtgattcttccttaggaaggagcaggaaattttggtgaatagtaatgtaatctaccacatgtttaaaatgcagtcccttctctagaagatctcagtagtctaagagagaataatttttttttaatatactaccgtaagtgaatgttaggtcagttaggtcgatttttttttcattcttgcaaggaatcattatgtctaataaaatataataaagagtttatggtatatttgaactgtccttaatgttattttactgagtccagttcttttggcagtggtttagtttctttaacaatctgtattctacaacttcactcgttgccttccttgtttaacatttatttttcaaaaccagacatgtcttttgtcttcaaaggataaatggaattggttaggagaaggattggggaggaggggggttgtggcaaatgtctaaaacctatgttttattcccttattttctcaaaaatgttagctcatgttcacacgggtttatctgtttagtctaagaagtagttacttttgctgtctggccaaagaggttcaggaccctggagctttgttctttgggaccctgaaggcagcctggcaggcagagcccagtatcacctttacagctacttgatggtgatcaagagccagctgctcttctttcacctggctgttgggggaggcacaccaatatgggtgggcaggaaaagttacttcccaggctgaaattttcccaccgtaaacttaggctgataggctgacagtctgcacctctcttcctcagcagacattccgatcagcaggccagtttgtgacgcgtgcatgtgcacacttcagattgcttcttccactttcctctttcctgctcaggtttctcataggagtaggctccatgtaagacttctgtcttttgtgaaaaagaaagcacgtatttatagaatggaatttcttactgaaagagggtgcgggcagaatggaggatgacatgaatcctgactcagtaacatttatggaaccactctctggatgccacacttactgtgggcagttaccaaaaaaatcagtttggcctacctgcctcctaatataatttaccctgcacacaaggcagtatcttgaaggttatttcagtagtacccacggaattctgcttcctttaggtaaggaaaagtattcccaagaacaaaatatacaggttaaagcccatgtaatataaaattatggcattcattgaagaaaatacaggctattctaattccagatcacatttatttatttatttacgagacagagtctcgccctgtcacacaggctaaagtgcagtggcgtgatctcagctcactgcaacctccacctgctggttsaagcaattctcctgcctcagcctcccgagtagctgggactacaggcacacgccaccacacccagttaatttttgtatttttactagagacagggtttcaccatatcggccaggctggtctgaaactcctgacctgaagtgatctgcccacctcagcctcccaaagtgcttagattacagtcgtgagctaccatgcctggccccagattacatttttaaaatgaagaaacagatattttctcttagtcaaaatacttatcggaacaattttttttaaagcaaagattgcatcatttaaaaaaacatattcactcctaggcatctgaatcactgcttcacatgcacagtagacattcgtgaaattatttttttaaatgatgatgaatgccagggcttgctttttttaaaaaaaagtctccaaccacaacatccaaactggtcatttgggaagtgatgcttccattcagtaagaaagctcctgcacactgggtgaacaggcggtgttttctcctctcatcgctgacatttaatacctgtcttgaggcaaaattgtctccaccttattaatccatggctcctcacgagccttaaaacagagaataaaacttgtcaaagaagaaaaatagaaaattagagaaaataacctsactacttattttcargcaccttgtgacttaagaaaatgtttttaaatgtggactctacattttatgaacttaaatttagtgtctgttggtcaaaatccacaggacctttaggagagaaaatggccataactaagtacaagcctctctttttaaatgcttacccaggtcagttaaaagcttccttgtagttctgaatcctcagttcttgctttacagccaatacttaaaaggaacaggggagagctacagtgcttttgaatttcagagaggcctcttatttgtgcctcaagaatagtttgtataaatgttatatttcaagccacacagtacttaaaaccatcacactgtttagtttatctagttgggtagaagagggggcaagagaacaaagcagtattaaattagggcagcagcatcagggacaggctgatgtgagagcaccttctttcttgggatgggtagagtataattgtccctttgcctatcgtcagatttgggtggcccagttgctttaaattttgaaaacatgggagtattaacgcaaagaagagccaacattagttcagaatagctgaattcatcattcttttggaaccagttttgctactgtataatgataatagctcttcagcattcatctagtgagtgataaagataagtgatgatccacaagaaagtttacctttgacttgtgggtgctcacggactgcagaatgcagatgttcgtagatcagccgtactgtaattttcaaggatttaatatgcaatacattcctatattaagatgttgaaacattaaaatattaataatttgcaatgatttttaaatactttaaacaggctcttccactggtgagattgtttttccaagcagagttagctagtttaaattctttcgttgtggctgggtgcagtgactcacgcttgtaatcccagcattttgggagtctgaggcgagcagatcacctgaagtcaggagttcgagaccagcctggccaacatggcaaaaccctgtgtctactaaaaataagaaaattagcctagtgtggtggtgtgcgcctgtaatcccagctgctagggaggctgaggcaggagaatcgcttgaacctcggaggcggaggttgagccaagatcacaccactgcactccagcctgggcaacagagcaagactcccatctaaaaaaaaaaaaaattgttttgttgtattctcagttgtctatttcaggtctaggcaggcaagaaaactttgtcaggtacactggtgtcttccaaaatgtgcatcgtaccctctattactcagtgtcattaatcacatccattcctttcccaccctgtcttggaataggacattaactcttcaacgatctgccccctaaataaaacctgctttcttgggccatagtaaacaacacgtaattctttgcgagaaaagcaaaatagtgataattataatttttttttttggaacggagtctcgcactgtcacccgggctggagaacaatgaatggcgtgatttcggctcacggcaacctacacctcccaggttcaagcgattctcctgcctctgcctcctgagtagctgggattacgggcgcctgccaccacacccggctaattttttggtatttttttagtagagatggggtttcactatgttggccaggctggtctcaaatgcctgacctcatgatccagctgccttggcttcccagagtgctgggattacaggcgtgagccaacttttaaaaattaaaaaaatttttaaaaaccaactttttaaattttcaaaaaccaattttaaaaaccaatttttaaaaagccaacttttaaaaatttaatattggagcataatagaattcagcaatataagatttgattgggaataagaaataacatctcttttaaaaatgactacagccctcttaacaattttactcttaaccaattttggggtaccagtttactaattgatcaaattccagattggaaattagtcatcatttgattaaccagagttaagcctcttgaatcaaattctctaatttattatctcccatctgatctaaattcttttttaggggataaattgccaaaacgctttcagaatgcccagtactagaaatctaagctattcaattcagtctcttctctgttttcaggctcctttcctgaccctttggagaacctaatatatttagctaaaaatttttctttggggcctcacctaataaaggtaaatagaaaactgatagctatcacataacatacatattggttaataattgcaaccaaaagtaaattaataattttgagctatttatattagctctgccaaaattacatcattaaatttggccttatgaagcattgctgactgtagtaaaaacaagtgtgagcaaagtcttcatatgcactgagtctggtttcagttccacgtaatactgacttggcaagtgtggaaattctcatgtcatcattaccaaaaaaaagtgagttcacacagggatttctgatcaagtgacccattactgcgggaaaaaaccacacatacaaaagcctttgaccccagtaattttgtattggtatatttaccctgatcttaaactgcaaggaatgtccgcaattagagtttttctttgttttctaagtctgaaacttgataatccatttctgccttcccatgacgagtggacattcctccagccagtggtgagttcctctttccttcgctctcagcaagagcatgggttgccctcccatctcgtaagcagagcctaccacaaacgcagctcaaatctcagtttccagccctgcttactcactcgcttgttcctgaatccccacattacccatcatggcatcttactctgtagacttcacatgtgaactttgccctcgccggtggaaggggtacagtccagatgggagatgaaatccaaatgctccaccaaagggctttggtttgttctggggagccctggtgctgccgaagcctcttgggaaggaaggagggaagaggagaagaaaagatactaagtttggttttcattaaaaatttttccaggttttctttaaactgataggttcagggtctttttcatacaacagtctacttttagagcttttgttcgtttgttgtgtcatgggaatttataagggatggaaggaaaagggggacaaggaatggtctaatttcggtcagtagaagaatacctgaaacctgtttaaatttatttggaactaatgacttctacttttagtatccataaaagacttcccttggagcacaaagaagttaataatctgtgtatattgtcacttcatgctcttcttaagcgctgtgtgttggggcactgctctaggtgtggtgaaagactgctacaggataaataagtcatggtcactgccctggaaagaagcttaaaatccagtgggagtaaatgataaatgcataatgacctaaatgtcagatggatctagtacgtacctggaggattgcatagaagcatcctgacaagggtgccaagaatacgcartgggggaaaggacagtctcttcgaagaatactkttgggaaaactggatatccacmtgccaaaaaataaaattggacccttaacaccatatacaaaaatcaacttgaaatggattaagacttaactgtaagaggccgggtgcagtggctcatgcctgtaatcccagcactttgggaggctgaggctggcggatcacaaggtcaggagtttgagaccagcctggccaacatagtgaaaccccatctttactaaaaatacaaaaaatkagccaggcgtggtggcagcacctgtaatcccagctaatcgggaggctgaggcaggagaatggcttgaacctgggaggcggaggttgcagtgagctgagatcatgccattgcactccagcctgggtgacagaccgagactccatctcaaaaaaaaagaaaagaaagacttaatggtaaggcctgaaaccatataatttctagaagaaaacacaggggaaaaaagcttcttgacattggccttggcaatgattttgttgctgttacctcaaagcacaggcaacaaaagcaaaaacatacaagtgggactacatcaagccaaaaagcttctgcacggcaaaggaaacaaccaacaaaatgaaaaggtaacatacaggctgggagagaatgtctacaaaccatatatctggtaaaaggtcaatgtccataatatacgagaaactcgtacaactcaatactaaaataaaaaaaaaagtggaggtggggcaaaggaccttaatagacacttttccaaagaagacacacaaatagccaacaggtaaatgaaaagatgcttgccaggtacggtggctcatgcctgtaatctcaccattttgggaagccgaggcaggtggattgcttgagtccaggagttccagaccaacctggacaacatggtgaacccctgtctctacaagaaatacaaaaattagctaggcgtggtggcatgcacctatagtctcagttacccatwagactgaggtgaggaggctgaggcaggaggatcacctgaacccgaagaggtcgagactgcattgagccaagatcatgccactgccctccagcctgggcaacagagtgagattgtgtctcaaaaaaaaaaaaagaaaaagaaaaaaaaaagaaaaatggtgcttgacatcactaatcattagagaaatgcaaatcaaaaccacaatgagatattatctcacatttgttaggatgcctgttatcaaaaagacaaaatataacaagttttgacaaggatatggaggaaagggaacccttgtacgctattagggtgaaaattggtacagccattatggacattggtatggaagttttgtaaaaatcaactatatgatccagcagtcccacttgtggatatatgtttaaaagacatcaaattagtatgtcaaagagatatcttcacttccatatttatttcagcattactcacaatagcaaagatatggaaacaacccaagtgccatttatcttaggaatggttaaagaaaatgtggtatatatatacaggatagaataatatttagccataaaaataaggaaagcctgccatttgcaacaacatggatgaacctggaggacattatgctaagtggaataatccagacacagaaaaacaaatactgtatgatctcagttatatgtagaatataaaaacgttgaatccacaagccaagagtagaatggtgattgtcagggtctggggcatgggagaaacggtgagatgctggtcaaagggtacaagctttcatttataagatgaatatgttctggagattagggagcgtccttagtcttttccctctccatgcagagggtaactatgtgtgatgacagatgtgttgattaatttgattatgggaatcaatatgcaatctatatttatatcaaataatcacattgtatactttgaatacgtataatttctattaattattcctcaataaaattaggaaaatcagaagcatcctaaaagttgcattaaaaacaatgatgaaaacaggccgggtgtggtggctcatgcctgtaatcccagcactttgagaggctgaggtgggtgatcacttgagatcaggagtttgagaccagcctggccaacatagtgaaaccccatctctactaaaaatacaaaaattagtcgggcgtagtcattcctgtagtcccagctactcgggaggctgaggcaggagaatcacttgaacctgggaggtggagggtgcagtgagctaagatcacgccactgtaccccagcctgggtgacagagcgagactctgtctcaaaaaacaaacaaaaacaatatcccctttaaaaacgcaatgaaaaaaatagctgccttaccaagccaccagtgagagcccatctctgaggaaaaggggtgtgcagccggacaggcttcagtttaaaagcttaaaccttgacttggacttactttatgccctgagcaagctatttaacttttttgttccttaatttctaaattatgaaatggcagtggaatgaaatggaagatgaaattgtgcctgttcgatgccctggggtctgaaaggtgctcctaagggtgtacagcagttagcaccgttagcgtcctgggcaaacccacagcccacagatctcttatttggcagcgaattcctgcagatcagctctaagagccagatttcctcatggaggaaaagactgctactgtcacgggaaagatttgtttaaacatattttttagtacagttttataagtccttatcaagtagggccagcccccagataaaaaccgttaagtatttakctgtaagccagaggttgagaataggaaacatttgaatctttaagaacttgagtccaacaaaaatactggctaacagcctgactgaggtgaaataaaccttgtttccagttttccagaaaaattgtttattactgggcaaatcttgggcctccaagattgcctatatttttgtttttcttttctcttaatctacaggaaacttctgggttgggccttctcatagttatccgttgttaaaagttctatatttctacaaaccttcttgtgcgaggagtatctggaaaaaaaaaacaacattgagatcactctttaaaaattagtgttttagacaggtttctggttttctctgctttgttaactgaaacagcccccatagaaacattctgaaagacttaatcaaacaagtattcagaataaaatgaatgggaagaagttttgagtctccttgatcaaacatggacctgtgctttaaaaagctgagcccctgagtttgttgcactgtgtacttaaagtctgtgacagtttagcctctttctaggctgcccatatctctcaccactcggttcatttcccggttttaaccactccccacggtccccagatgatcattttcatcctgagcctcttattcccaccttcagtcacttcagaaactcccctgcactccattcaactttctggacctcccctttaatgtttgccatttgtgcattctacagctcggtgcacttgttttctgacctcaagagtcaggagaggagctatcccagcttcaattcctcatcaataaggtacagaaaatactctctaggattactgaagaaatgaaataagcaactgtattttaagtattttatgtactgtaaaagcattgtgcgtccgggtgcagtggttcatgcctgtaatcccagcactttaggaggccgaggcaggcagatcatctgaggtcgggagtgactggccaacatggtgaaaccccatttctactaaaaataaaaaagttagccaggcgtggtggtacatgcctgtagtcccagctactcggaaggctgaggcgggagaattgcttgaattcaggaggcagaggttgcagtgagccgggtgacagagcgagactccatctcaaaaaggaaacaaaaaaaagctgtgccaataaaattatacttattattctagatacaaatattctgaatgctcctttagtcagattctgtgttttctgttttgtttttgtaattttcacttaggaggaggctgtacataaatcaagcccttagtaaatccttatttagtgaataaataaatactgccaacatctggccccagccctatttggcctcaaatttctgagggctggttaccactattgctgaaaatagaaaaggagaaacaaaaaacaaaacccaccaattcaggacagaatatatttgtgcttaaacaagcacacagtactctcacatccaccctcggtctccctgaaactcagacctgcaaaactaggatacaagctgtaatgacatgatgctttcacaatagcagattgaagttagactccagaagacagctttacagtgtgttaaaccagatagaagacaggcggctgctattggtgttttacactggtgtacatcggtgcttctcagtctcttcacattctaactcattccttttggtgttctgtgtagctattttggtctttatttcatatttatttgatttgctcttttcttgtaccctttattccaagggggaaaaaaaggtgggggttggacaacagagaatgaacagcacagaattcctttccttaaatactgccatcctgggaaatctagaatcatgaaatgtaagatacagattgtgccctagatcctcctgtcctactcttcattttatggacaagtccatccagaaacctgtgatggatgagggcagagcctggaagaaccccagtctccattccctcctccttctccctaaaccacaaagcctgatttgagtacccagggctacccaggttggaaatagaagtcctcatcttctgcccaggatttctcactcctagccacagagcttctgccccctcctagccacagagcttctgccccctcccactggaagcattgtgcccaggagaggacctttttctcttatctctgctggtaagcttgattatcaggatattcctggggacctagaatttaatctcttctccaaagctgctctttgatggtgttgagggtgtttttgccagtaatgaacaatcttcttgttttgaagctgccttttatcttgtttaatacattgtaaagttgtcttctggagtcttcttcagtctgctattttgaaagcatcatgtcattccagctcgtatcttggttttgcaggtatgagtttcagggggaccagagggtggatgggagagtgctgtgtgcttgtttaattaagcacaagtatatcctgtcttggattggtgggttttgttcttgtttttccctttctattttcagcaatagtgataaccagccctcaggaattttaggccaaatagggctagggccagatgctggcagtatttatatattcactaaataaaaatttactaagggcttgatttatatacagcccccgctaagtgaaaattacaacaamaaaaaaagaaaaacacagaatctgactaaaggagcattcagaatatttgtatctagaataacaagtataattttattggcacartgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcgtcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgaggtgctggtaaactaagaccaaagtttagattccctgcttgagggcacttgaaccacagtggtggtgagttcagaatgcaaatgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccagctactcaggaggctgaggcaggagaatcacttgaacccaggaggtgaggttgcagtgagccaagatcatgccaccgcactccagcctgggcaacagggcacaactgtttccaaaaaaaaaaaaaaaatcccatcttgcatgcttttcctttctctgtagtatgtaaaataatgtatgtttgtgatcagtgagatctcagatctgataaaatgcagtgttttgtcatgagagttgctcccagccrctgatggggttgccttgttcagcactttttagcmccaggggagtaagccatgttcttgctccccctccctcaggctgaggctttgcttgatcacctgctaagacaaaaaccagagtgggtcacgagtcactctctctcttcccccagccacagtggcagctgcctaacttggtttcttgctggtgcacacatgtgacagaaatacaatgttaataaatatttctaygtgtaatggagaaacaagccataaaagtagctgtttgccatctgctcagatacattattaggaaaggcaatgacattttatgattcagtaacttaactattctcctgccttctgtaaaggcccatcacatataaataaattataaacatccaaacacatcctgagagaagtgcattggtctctgaagcagaaacaaatgatacctgattctcccttctcccagaggagatctcaaacaactcagttacagtgcctcacagttgtaacctatagtacaaacgtgttggagatataacaccttgtatacgtatgtagagagaattggcataacaaagtagagaggagaattagacgaatgggcaccccaatcagtgattcagggagaggaccatattttaaacagcaggcaatgactcatttactgagtgttttctgtgtgtcaggcactgtactacrcactttgttcatctataagtggaagaatgcttgtttttcaagaacaaagggaataataagaataaaagtgaaggccaggcgcactggctcacgcctgtaatcccagcactttgggaggctgagaaaggccgatcacttaaggccaggagttcaagaccaccctggccaacatggcaaaacgctgtctccactagaaaatacaaaaattagcagacgtggtggcatgtgcctatagtcccagctactcaggaggcataggtgggaggactgcttgaggctgggagttcgaggctgcagtgagctgaggttgcaccactgcattccagcctgggcaacagagcgagactctgtcttaaaaaaaagaaaaaaaacgagttggggggcaggcacggtggctcacgcctgtaatcccagcactttggaggctgaggcggatcatgaggttaagagatggagaccatcctggctaacatggtgaaaccccatctctactaaaagttcaaaaaaattagccaggcatggtggcgggcrcctgtagtcccagctactcgggaggctgaggcgggagaatggcgtaaacccgggaggcggagcttgcagtgagctgagatcccgccactgcactgcagcctgggcgacagagcgagactcagaaggataaaaagtaataacctgaagagtagcttcgtttcaggtggaaggtgagagaggctgcagaaagcttagggctgggcgcggtggctcatgcctgtaatcccagcactttgggaggccaaggcggtcagatcacctgaggtcaggagtttgagaccagcctggccaacatggtaaaaccctgtgtctactaaaaatacaaaaatttagccaggtgtggtggcaggcgcctgtaatcccagctccttgggaggctgaggcacgagaatcacttgaacccgggatgtagaggagctccttgggaggctgaggcacgagaatcacttgaacccgggatgtagaggttgtaatgagccgagatcatgccgccacaccctagcctgggtgacagagcaagactctgtctcaaaaaacaaaacaaaacaaaaagtgcttagtcaatatctggttgttgattgtttaaggaaaaggccaagtgagggtatgactggttggtagaaatatgtatcttggtataagcagttctaggagtgatatgtgtcttttgctgctgttattgttgtttctgttcagcgttaatacgttttgcattgtaccacaaatatttccttactcctttgcctttgagacaaagggcatgagtttataagttgagttgaaaatagattaaatatatagtacagcctatgcccagcaagcagaattatctatgcaagttatgcagcccacacggaaaaagaaatgctgtgcggcctcattagcaccccaggatttgtggggctccccctgggcagccttaaccaggaaaatttcatagtctccttggcattccatccaagatttaagacttctcctttcatctccttgaggaccatcaactatacccttgagctcagccatcccacgcactgaggcttatctgtacttccagcccagacctccctcctaattccccactatacctgtgcactgaaacaccctcttaggatctccttcttscacattcctcctcctctaggcaaggcaagtcgttttcctcatctcagccagagcagtagttactgaaaactaacccaatatggtggcttctgagctcaggtgtctttcagtgactcctgctgcttccaaaataaagtccaactgtttagcttggcatgcaaaacctgtagtcatccatcccttgcatatttaactcctcacacaccccattctgtggtctcttcttccctttgcatctgctctgggtgctctttgaagactgtacttcctcccctttggggccaatttagtcatctttaagcctcatttcaggggtggtgtcctcagataacccttcttcacataccagtttgggttatctaccgctgtggctctatagctctcagctcacaccaataggataagtatttaacatactgttaaattacagtatgccatgataacttctcttccatcattctgtattgcatgagtacaaagactgtgtcattaatccctgtctccgtagcattgtgtctagcctttaacagtcacttaataaaggcaatgaaaaggaaataacatttgaccttcaatttaagtttgactaggtatggtcaaacrttagaaagtggcagtgaacttcttttgaagtcagaattcatattttcctttaacatcagatattggcagccagcttttccagattttcttggccaaaaatattactaaaattgcatgcccctagattttgatatctaggatgatacatctacagcatgtaattatttgtctcaataattgagctttaccttagggctctaagagaagaggttaaaggaatcagtggtttagtaattgtattgttaatcttaaaatgaaagttgaatggaaaatattttaaaaactggttaagaagataattattgagagcatggaaaagataattactacatatactgtaactggtgaagatggaggttttatgaaaaataaagcagcttgtaattttttacaacttctttcaaatgcaccttggactgccaaggtgagaggcaggggaggacattttcattccgtggagtcacactgaggatttatcttgtaattgattatcacattatctgctttgatcctcatgagataatgagagtggtgttttgttttgttttgtttttctttgagatggagtctctctctgttgcccaggctgtagtgcagtggtgagatctcggctcactgcagcctacacctcctgggttcaggtgattctcctgcctctgccattcgagtagctgggtttacaggcatgcgccaccgcacccggctaatttttttttgtagtcttagtagacacggggtttcgccatgtttgccaggctggtctggaactcctgacctcaggtgatccacctgcctcagcctcccaaagtgctgggattacaggcgtgagccactgctcccagcctgagagtgagtgttttagcaaagcaaaacggcagaggtaacatggccccctccctccacatcttatgaggtttcctaccattttctgtccaatcgtgactttttctacactcacttttagtgccccataagaaggatatttaatgaaaccttttatggactattgataagaacccaacccttgaccgggcgcagtggctcacgcctgcaatcccagcactttgagagccgaggcgggcagatcagaaggtcaggagatcgagaccatcccggctaacacggtgaaatcgcatctctactaaaaatacaaaaaaaattagccgggcgtggtggcgggcgcctgtagtcccagctacttgggaggctgaggcaggagaatggcgtgaacccgggaggcggaggttgcagtgagccgtgatcgcgcccctgcactccagcctgggtgacagagcgagactccgtctcaaaaacaaaacaaaacaaaaaaaacacctttttttgtcttgccattcaagttacttccaacagtgctaccccttctcccaagactcttaatgtagtctgtctgtccatagcattgtatccagattcctgaacctggcatatgagctctcaataattcattctgactcatctttccaggcttactgtttaaatatgttttatttattaatgtttgagacagggtctcgctttgtcacccaggctagtgtgcagtggcatgttcatagctcattgcagccctgaactcctagactcaaagggtgttcctgccttagcctcccaagtagctgagattacaagcacatgccaccacacctggctaagtttttatttttagtagggacagggtctccttatgttgcccaggctgggcccaactcctagcttcaagtgatcctctggcctcagcctcccacagtgctgggattataggcatgagccactgcactgagccataaatagatgcaagtcaaaatccaagaaaaccttgaaacaaattgccttacatggtaagaaaggtttatctttttcataagttcagaaatgaacttctggggttaattaatttgtaattgcccaattgcacacacaaagccaattcactgagactgtgatattgcagtaaagaaagagtttaatgaatgctaggccagcaatgtggaaaatggagttattattcaaatcaatctccccaaaggctcagagagttagggctcttcaaggatagtttggtgagcggaggacttagggaatgggtgctgctgattggttgaggatgaaatcatagggatgtgcaaaatggtctaatcctgtgccacctcacctgcactgagtccatctctggacttccttggttgagttatgagtcctggctcccggtggggtcactcggttgcctgaatgcaaaagtctgacaagcatctcaaaagactaatcttaggttctatagtagtgatgttatctataggagcaattggggaagtcacaaaccttgcaacctctggccacctgacttctgagcagtaagagattatagaaagtatgcytacatgttagcagaattcaggcccctcccattattctagtcttgtggcctttattagtcttacaaaggcagtttcagcacctgaacaaggaagggaatgagtttcagggagggactgttatcatccttgtttcaaagttaaattacaaactaaatttctcccgtggttatcttagcccatgcccaggaatgaaccagcctgtgaggccagaagcaagatggagttgaaccatgctagatttctctcaatgtcatcatttttgcaaaaggactttcagatttagtggcccactgatatcattagrggcccaggttcttatcgtcacttcactctgccatccactatgcactggtacatcctgagacttgctctgcctcttggcaaaatggctacagaagtgccaggcatcacatctagacagggcatcttgtggctcttgtaggagtaaggaaacatttccagacgcaccctagagaacatcttacatttcactgaccaaaaatgagtcacatggtcctttacaaaccaatcacaggtaaagggaatgccgttattatggtaaccagcatgggggaacaggtggagagtcaaccaccaggactacagggcttccttttctccctttgtatgtccctcttccatcctgacctcatggtgaccctaaaaagtctgtgcctgcctaccaccaaacctgctctctgcccctctagattttaggtacccagccccccaggcctatacccgagttcgctttgctccatggaactttccttgcgcactccctgttctacccctttgccacctgtgtgaaggtcatatctctctagctggaccctgaggtcctttggggcatgcctgcgctgctctctattccttcatgtgcttcgtagagaaccacagaccctgactttatttgtgcaaaccttttccccaaaatgctaagactaataccacgcacagatggaagtactcttacatcctagtcatatcagccccttgagactggagctagtcttcaaaatggaataatagtgttccctttttattattagaatagtaagaattctatatgagtagaataagaaaaagttaatgtggcattcacaatttattaatgtcccttcatccatttacycacattcctttttattcttttttttttttttttttttttgagacggagtcttactctgttgcccaggctggagtgcagtggcacgatctcagctcactgcaacctctgcttcccgggttcaggtgattctcctgtctcagcctcccgagtagctggcrgtacaggtgcacaccactttagtagagacaggtttcactttattggtcagactggtcttgaactcctggcctcaggtgatccacctgcatcrgcctcccaaagtgctgggattacaggtgtgagccaccgtgcctggctttattccttcttaatgaggcacaaactcagtttctgcgtggtacatatagcctttagattttcatagttttactgtttttctgatattctcagacaaataaatggttgtacatcagaattattggaggagctttcaaacaatatgcctatccaagtatcaattaaagattcagtttcagttggcctgggttagggcctagggtgtttttgtaaaagttctcagggattctagtggcggccaggttgagagctctgctcttagatctttatatgcagaactctcctggctgagaattatcagaataatttcaaacttttcagagctcttatccagactgctgccatatattactgcttctcatattagcactgctgatcatgcagggtatgtcctggtttcttttgtgtttgatggctaaatatccaccttcccttttatctttttcctgcctggattgtaaacatctcatttctcttctgttccacagcattcaggacaatattaaagagatcatggaggctcagtcagttcccatcaacagagtccgaaacgttgtccacttcataacttgctgggcattctgtcctgtacacctttaaacaaccttcctggctgggtgcggtggctcacacctgtaatcccaacactttgggaggccaaggcaggcggatcacgaggtcaggagttcgagaccagtctggccaacataatgaaaccccatatctactaaaaatacaaaaaattagccagatatggtggtgtgtgcttgtaatcccagctactcaggaggctgaggcaggagaatcgcatgaacccgggaggtggaggttgcagtgagccgagattgccattggactccagccaggcgacagcgcgagactccgtctcaaaataaaaacataaacaaaacagaaacccttcctttaggcccagagagccaacctttccctcagagactgtttttaaaccaagccactttagactttgccagtccttctgtagtcccctattcaaaactttgtttatacctttcaggaatattttatctagtacttyattgatttcatccagttatgtgccccttctctccattttttgacagtttctactttattccactcctccaacaactccttaatttctgctgtatcagcagagcctctcctaggtaattggaagagttgtccttctctcaaccctattctttctcaagtttgctattcccaggtcttctgttgccttcaaacactaccaagtagtctcattatctattcacaataatgatgtgaaagcttttgttccagcatttgttgaatgttcattttttctctggcctttcatcatctgtgacagtactttgtttagaaaatggagggtagggtggcacttgtatagcccattttgtatggttcaacmttcatttcattgtgactaatgatgactgatagctgatgtcataagtagtgtttcttgcagcaaagtttcataaattttagcatgcatcacaatcacttggggtacttaactcaagtacgtattgctgggacttaccttcagggatatctaagtcaccaagtctggggtgaagcctgagaatttgtatttctgttaagttcccagatgatgctaatgctttatctggggaccacacttgagaaccactgtcctatgggatcaagaaataagccaggaacgagtgtatattttttctagttaaatatttaatgttaagatgtttagaatttttttagggaggtgcttgtcagatacttttcctaatagtgggtactcagagtatttcatgtgagactaccaatgtcatatattttaaaaactattagactgggacagatgggaaattgccttcagcataagaaaagccaatatttttcataagtcccaaaagcagcttttggggttggttgattcagtggttcaatgaaaccatcagagactctggttcctactctttattccactgtgccatggaccatgtgctggtacatcttcagactcactctgcatggtgacagaatggctgtagaagtgccaggcatcacatccaggttacatacagatgcacactgtttaatagccaagcttatgcagtatcagtaactattagagaaactgaaatggaggatccagaacttcttatcaaatataatccttaagatacaaacaaagcagtcattgaatagtttcttagcccattttctgtggcttatgatagaattcctaaaactgaatggcatataaagaaatttatttcttatagctatggaggctgagaagtccaagatcagggggacatgtggtaaacgccttcttgctgataccagtaaagcctgctgagctggagtgtcacttgaatcatattcgccacttttgctttctcttcctacatgggtcctgaggttttgctctcatcatcatcttgcctttcagtaaggtaactaacttgttaccctctgctatgtcagagagattgtttgtttcaggataaacatataaacagagtttcagataaatctcttatttcctggccactggggctcgagttatattgttagcaccagctctgtaaagtgcctcaatgtgttttttcaaccaaaggcaaaatatttggcaaagaatatgttggttctttacctccaggttctgggcaaactttgagtttccattcttttgagatagatggactttgttgtctttcataaacttgttaaatttgctatctgcccttgaagaggcacttggttccttctaattcttttctgtagattcctctgattctccatcagcgtatggaaattttctcttctatcccttccagagaattattcttctctctgccattcaatttgactgtgttactgccaggaagagacagataaaagggcatcagcaatgtcgacaacttaggagtagttcattcctttttcctatggctgagcaagtggatttgactgtacttatttttgtgtattttaatatgttcacctgagcaaagtcagtgatctagaagcttcataaaatgaatagtgcataacagaaatcacacctcagtgtaagtcttaccttcctacaggagtcccataaaaacactcttaggacatgctttccccccacacatctgattgctgaacactttgtttcactaggcttcaacaggtctcttcaaagctgtcattttacttcagctgggattacattccaccctatttcacttaaatatacaccttccctttaattttctctcattcttatcattggcagtaatcagtgtggcaagagttcactttcttttcacatggagatttgatctttgattattttatttttatttatttattattattatttttgagacagagactcactctatcacccgggctagagtgcagtggcacgatctgcaacctcctcctccctggctcaagggattcttttgcctcagcctcccaagtagctgggattacaggcacacaccatcacacctggctagtttttgtattcttagtagagacagggtttcaccatgttggccaggctggtcttgaactcctggcctcaagtcttctgcccacctcggcctcccaaagttctgggattacaggcacgagccactgcgcctggcctgatcttagatgatttaccaaacagtgccacaccctctgccttctgtgtgtgtctcaggctgtaagtaaagtctccgtcttagtccattcaggctgctgtaacaaaatgctacagactgtgtaatttataagcagcataaatttattgctcacagttctgaagtctgggaattccaagatcaagatgacagcagattcagtatctggtgagggcctgttcctcaaggatagtgccttctatgtccttacatggcagatgggcaaaagagctaacaagcttcctcaaaccctttgtaagggcactaatcccatttgtgagggttctaccctgatgatttaatcacctcccagaggacccatccttaatgccatcccgttgaaggttgggtttcaaaatgtaaatcttgggagacacaaaacattgagaaccatagcagtctctcagacctcgttgtactcagcttcattttaggataactccacatttgagttaagaaaccaagagtttgtattcccaactctatgcttcatgaggttaaagactcttggcttctcattctcactgctcaggcaggggtagtccatctgaatggaaactcctttttggggggcacacatcatttttattttattttatatttctgagacagagtctcgctctgtcgccygggctggagtgtgtgatctcggctctctgcagcctccacctcctgggttcaggcgattctcctgcatcagcctcccgattagctgggattacaggtgcatgccatcacgcccagctaattttttttttttttatacagagtcagtctctgtctcccagactggagtgcaatggtgtaatctcggattactgcaacctccgcctcccaggttcaagtgattcttccacctcagcctcctgagtagctgggattacaggcgcctaccatcatgcccagctaatttttgtatttttgtacagatggggtttcattatgttggccaggctggtcttgaactcctgatctcaggtgatccacctgcctcggcctccccaagtgctgggtttacaggtgtgagccaccacgcccggcctaatttttttttttttttgagatggagtcttgctctgttgcccaggctgcagtacagtggtgcaatcttggctcactgcaagctctgcctgccgggtccacaccattctcctgccttggcctcccgagtagctggacctacatgtgcccgccaccaggcccagctaattttttgtatttttagtagagacagggtttcaccatgttagccaggatggtctcgatctcctgaccttgttatctgcccgcctcggcctcccaaagtccagggattacaggcgtgagccaccgcgcctggccaccacttttaaatgtctgtgttgcagtgaaattttaaaagagagagctaaattttgatgtcagtttttaaatagatgctgccaagagccatgttgatagcccaaaccaattttccatttataccagtgatatacttcaagcctgaaaaatgtagtccagtgtgggaagaagccctgtgatggtgagaaatgcagtaagaaactgggttctcccatggaactgataattaatgcaatcagatatgaacagtatgtttaaggatagtctggacatgaatgtgtataatctgtctttatcagataaacaaataaaagtcttttacctaatcgtcgtttcctgagttagaagaatcctccttatcagatacctgctttggtcattggaaggaaagtagaacatccatcttggtggtgatccttgtttcttagtactctgtatatcctttccaagagacaggtttcttttatgaaatggctaagatcatctccaccaccatgaacaacatgcaaatggagctgctgcacaaagtttagggagttctaagcgttgggattccaaggcatattaccctgtactgaagaaactcggaacagaggcatcctcaaatcctaactgcaaggaagcgtagcctgtgtcctttgttgatggaggaatgattcagtgagaaagaacacagtgatttttttctctacctatcttacatcttactctcttgccatttcttgtaacaccttttcatcctgtcttaaccttcagctaccagcttaccctgatcgtaatgacaaggaaattcatacattttggttttttaaggactactttattaaggtataattcacaaaccatgcagtccaccctttaaagtatacgatgcaatggtttttagtaaattaacataatcgtgtaaccattgscataaacaacattagaacattttcatcaccccaaaaaagaaaacccatacccattggcaatcaaaagccgatttcctccccaaccaccacacaccccccagcactaggcaatcattattctactttctgtgtccatgggtatattaaatactgtgttgtaactggagataggatgcccatagtcagaaagcttgagctcacatgaactgttggcttggatttctgtgcggattaaaccagcttacttctgacacggcagatgctgggctttttaacctctttcctcattgtgcttcctgacttgttacctctgtatcataaaagcatgaaaggtcgtagaataaatgagtctgcagaaaactgcgtggttaagttaccccatttgtgttttacaaagatagcggaagggaataacctttgagggtcacatacaaaaagccatttcctcatcctccctaaccttaaaaagtcgacattatttttacagcagcttctctaaattgacttacacttgaacaaactaaaaactacaagaagagtagagcttagctggcaggcctggttttgaacaagtgtttgattttgctaatcttggtagtgcataaggtcacttttgtaaatttcctgtagaaaaattcttggttcttggacacactcagctactagaacagagagatggtttatattttttctatgaattaccagctgataaaattcccctcctttgagtgggagaaaaattcaagccagacaagaacttttgtggcaggtaactcttacttgaaatttatttggatttctagaggcaaattaatttctctctctgtctttcacaataaataggtgcctgtcaccttttttttttctctatctagtgagctgcttctatagatggaagaaagttagtccttccttttggtattttgagagttttatttttaggcctctccttggctgtcttttctccttgtaaagccagtgtcgaagtaatggcaatggtaagtatgcttagcgttctaaatttttttaatgcatgtttattactaagtaatttatctccttttcttctactttatagctccatattaaatatggtggcaccttttaataaaaaagaggaaagcctatttggaaacatataaaaatagcacaggataggtcatttttcagattctggtcagatcaccatttggaaagatcttattctttaaagcaaaagttttgaaccaaggatctgttgaagatggggagtgactctcattcatctccatcttcctttgaaatttcatacagattttttggtgtgtgtttgtgtgtgtctgtattttctaatgagaagatccataactttcataagcatcaaagccactgcctttaaatatctttttgattacttttactgtagttattgttttaagatctgctttttgccatttaaaaacatctttcaaatactagttaactcttaaatgtttttttgcagaataagatcctttttgcagtactttttgttgttgtttaatacctacccaaaattttggtccaagctctaggggcctcctcccgaagaatttggtttaaaagcaaaagatttttaacataaataaaccagaatttgctttttttctttttgatttttttttttttttttttttggtagtgatagggtctctctgtgttgcccaagctggtctcgaactcctgggccaatcctcctgcataggccttccaaagtgtgaggattaccggtgtgagccaatgtgcctagcattgatttgtgggggttttttgttttttttgggttttttttagagacagagtctcgctctgttgcccaggctggagtgcagtgggatgatcttggctcactgcaggctccgcctcctgggttcaaacaattctcctgcctcagcctcctgagtagctgggattacaggtgcctgctactgtgcccggctaatttttgtatttttggtagagacggggtttcaccatgttgcccaggctggtctcgaactcctgacttcagttgaggcacccgccttggcctcccaaagtgctgggattacaggcgtgagctgccacgcctggccttgatttgtttttgcatgtgagaaaatgtatgtcctagtgtagtgtggtgtgtcattagaagcatgatttgttcttwccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggygacagagcaagactccatctcaaaaaatrtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtcttygtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcytcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaaggggagtggtcttaagaaaactcttagtatagttgtgagtatccatagtgtcaaatgaggggaaacattgtaacaatgttaggagccaaagttctcaccacaatctcatcagatgtcctgagctattttttacttgttaactcagaacaacaaatactaaagaaagtgccaaacaacctcaattcttctggctcacacttatatatagcagagatacgaaatagcccgcaatcccagatcttccatgggtaattttgggaaagtgtttttcatagagatgttgaagtccatggaaatcaggtagaacactaaaggacccggttgacccagtacattgcaaccctctgctctcatgtgcacctcacacacagccagtctacggattagagaccaccatttctgggggttgttatcttttttttttttttttttttgatacagagtcttgctctgtcgccaggctggagtggtgcagtggtgcaatcttggctcactgcaacctccgcatcccgggttcaagcaattctcctgcctcagcctcccgagtagctgggaccacaggcacacaccaccacgcctgggtaatttttatatttttagtagagacggggtgtcatcatgttggtaaggatggtctcaatctcttgaccctgtgatccgcctgccccagcctcccaaagtgctgagattacaggcgtgagccaccacgcctggccagttcttttcctttaacttgtattaactgcatagtagttagtttctctttcttctttctttaataggatcatctcaacatatttaaaaactatgccgtatatgtataagatttgccacctctgggtcattaaatggcatcacagacatagaaatgtaccaattccttttttatgaaatttatccattcatgcaaaagaagtatgataattaaaaataattttgaacattgggtatcctaggctctgagcgcgaggctctcagaaaattaaaatgacatcatcatcgtacttgcaaagcttaaagcccagtggggaagagcaacatgatagtaacaaaggtagagtgtaataagtgcggttgcagaatcgcaggccaaggggagctcacgtctttgagcttcaatttctttatctgttgcgggggagagtatctcatgaagctgttttgaagcttatctaagacaatgcatgtgaaaacactgtaaaattataaagctgcggacatgtcagttgtcatgtttggtttaaaatagaagctgggagactctttattctgaaaccatgtagataatccagggatgagactctagttaaagtgaggaaaacaatgtacttgcatgtcaattgcagttcctgggagaatgtttgtattattaggagactctcattccagaaatcattttgttggcatttatactaagtggcgatgacactgagaacagcacagcttcatctgacatctgacgttattgtcagcctttcttagtacccatggtatgtttttactgtatctcgtgaataagataatatattaagtctcctggcatataaggatatatgtaagatacgtgttgtatagttggtttctagagtgtcttcatagcagtcttccagtatttctatttattgctattccctctccacctctgtttctttcccattagttctttacaggtagggagattatatgtcccagtttgcctgtcctggtttatgtctcttgtccctacatcccatctacttaacattttaacaccctcgaaagcgtcccaatttggacctcaccttatctggtcaccctggctcaaagcatagaagaaaattaaatgaagagccagcaaattagtgaaattgtacagatgtgtgataactgacttcagtcactgagctgagctgatttacagagtgtggatttggtccagtaatatcytggaatgcagcttacagatgtaagtaagtagtgcctgattatagctacacactatagcaggtttcctaatgagctgttaaaacgaaagcatgtgtttgttcactgtggcacagaacagtagctttgacacttcagtagttttcaccatagcatggcttgttggggcttgaagactggcattccttcttaaaggcccatcaaggttttcattcactgtgagctatgtgttaagctggtantgatctcgtttttgaccatcattcacccatggcagccaaccagggaggtgtaaaatgcttttgtccccctgcccacatatgcacctcctttggtgtgacccatgggatgacagttrcgatgcagcttgaaaggatggctctacattgcagcttctctgcgtcatccccgttgcccttttagaatgagaaaagaggattgaaaggttcaaaagcctagagagaaaattctgcagtcctgtgtttttctgagcagagggaaaggtgctacttcgtaagactgcttgcaatccccaatataatagaataaaactgtccctactgccagcattaatatgaaatttgtataaaggtggagggattactttactgttttattaatatgcaatcccaatattttcattgcagggcagcttgcaaattcattgcaaattatgctgagttaaaatcaaatacataaatctacctttctctgttggcagctgtattggagtttgggattggcctctgtgcttattagagccaaagaatgtatattatttaattcttgcaaagtgaaagtaaaagatcaggaaataaagacaaatcaggggaatggaacatttttagtgcgattcctcttttaytctccagcaagggaaagtggcttaaagatctctgttaaaacagtgcttctcacactttaatgtgagactcttgttatgtagattcttactcctgggtctaggatgggggcctaagattctgcatttctaactagctgtagagcatgctggtgctgctggaccacaggccatgacttgagtagcaggttgtcaggaagtgtgtgcttcagtgggctgtgactctgcatatccctgttgtgaaatatgcagatgagagtggcacacaccagaccctcaactggcaggaggagctgtgttttagctagaggttagggtgagagggaccacccagacttgtaaagcttaagtattgtccccggtctctttaccagtcttaaggtatccctaacagaggcccaatgttcctgctaatgaaatgaataaagaaatgttrcagtccatggatttgtaattccagtaacggcttattttacatctattaaagrctacaaggaaagaagtggagggaagggctggaagactaagaaaataggaaatgagaagaaatgcacaaaggagagttgcatttcctcctgcttctgtcaaaggaaaaaaagatgttatgtgccttctctttccacctctaaataaagsaacagggccaccactaactagtttgtgtgactatattctggctatttaacctctgctatttcacaaaaagtcctcatctgtgaaaggaggaatttggaatcgggacagttttcggaacccsttcaattgttaaagcatagcgactaagaattttatggtcatacaacactaaaaatcatacatatgtccttaggaatggggttttatttctgtaagagcacctccaaaacaagtggtgtgttaatacatgtgcattttatatttttctttatattctttgttctcttccttttaagaaaatctagtttgtttcattgcttcaaaattcctgaaaaattttctgtctttttatataatacagagttggctgtgttaatttctgcttccatcatactaatttaggaaacgtggcctaacagtggcaggaatagctagaactttcttctgtgacttactggcattttccctaagcatctgcatgtgttgggtgtatgtgtaagtaccatgcattggatacatcctctgttgaaaggataaaggaatgcttgttckttccacaagttaccttggctccaactctgttccatactcagcctgttctctcaacacaatgatgtcttcagtcttaggacagaagtctggagttcattcacatctctattttgattaattgttttacacatcaggctccatataatgtagtggataatgaaatgctctaagtgagttagggattttcagttcttagacttgtggatgagagaatttcaaaaattatctacaaatttaccaacatagataatgtttgtatgatatacagaggttgagttttataaaatataaattgctctgagccagaaatgaaaaataaatgtagaatcccatgataaaaaactaaagttgctatattaaaattaatagtatactgggatttttgaaacattgttttgaggatgtgtttactatgttcaaagcaataaatttaggaatggaatctagtttcattagccctgctataacattttggtgagaatataaattaatacctgctttttgaaggacaacctgacattatccattagaatgtgtaggccctattttcttcatctcacagattcatttcttgtaatttacccatttataattaattattgcaaatatgtgtttggaattattggacaggtacagaaagctatatgtagaagtacattcatcagagtgtttgcagtgtgggccaggtgcgacggtttactcctgtaatcccagcactttgggaggctaaggcgggtggatcatctgaggtcaggagttcgagaccagcctggccaacatggtgaaaccccgtatctactaaaaatacaaaaaaattagccagacatagtggtctgcacctgtaatcccagctactcaggaggctgaggcaagagaatcacttgaatctgggaggcagagtttgcagtgagccgagatcgtgccattgcactccagcctgggcgacaagagcgaaactgtgtctcaaaagtaaaataaagtgtttgcagtgtgaagaaacaatctaaatattcaacaataaaggaaggtcaaatgagacaaagatgaaaggggaatactatgcagccataaaagagagatgtggttgttatcttaggaagatgactataatatgaagttaaaagttacaaaggaacatttgggaagaatgtataggtacatacatgcttataaaascacaagaaagaactgggaagcaatacaccaaagcgttgatagtagtagaattacggctgattttttactttctctgtcatgcatttctttattgttgaatatttagtactagtacatggagagggaatagaaaacttaatttggaagggatggggaaaaagtagccaccctgggagctgagttagaggagaacacagagcccaggtgtttcagcatctgttccggcgttggcggtgggaattctctgaatagtcctcactgtgccagagaagctttctgcgcacagctgggtcctgtgaggcaagacctgtgtcctgctgactcatacacagcatcccatatggccttaactttatttarcaacgtcagctcaaggaagccttgtgttccctttgggcccaggatttagaagagcataatcatagaatgtctgtcaggcctggaagtgtcattagggctgtcctagtctggacatgaagagtctgaggcccagagcatttaagtaacgttcccagagtcccagaggtagttcgaggccaactggaaatgaaaatgcggttcccaggctcgtggtctctctagtgctactactttgcttgtctccaagctctgctctggtggatgagtctccagttctcacaagcagtttttaaggccagagcaaaaggtttccaggtaagagaattttttttgtcatataagagaagattaaattaataggacttttgttcagatctgcattcagtgagatacatggaaattcagaggttattgactttccttgggtctggcctcttttggatatttaataaaggctgcaaaacctttcccttgaacgatgcaagtttgctgaaaaccacaaaactttgcatttgatttcggaggtttcaagagccctgtaaagcctgtccctgggttctgaatgtcctttgtcttgtgctcccctgttttcaagcagttcttttgcatttggaggtaacagaactgtgatctggtttggttttcatacctttgttgcagatatgttttcttcaaataaaaaagaaggagaggatagcaactaggaagatgaasaagcctcatcacattggatacttagtgttgtctttgtgtttacagttgctgttagattgtcattccaataaaagtaaaattatgtaatactttttaaagctcccatcacactagcacaactgctttcattttttgcagagtgtgccaccctgttcctttccacatggatacttcctggttacagccaaagactgttcattatgccctttcatgcttccacatgaaagacacaaactgaggctgaaattgagtggcttcttaccagaaattaggtatttgaataagagcagatmgtttttacttaaaagatgtaagttttgaaaatgrccasatgcagcrgttaacacactgatgactggacttacctgaagagtctctgattcagtagcccgttgtggggcccaagcatttctaataagtcctcaggtgatgctgacatcactggtccacggccagactttgagaaacagtggcccagagaataacagtcttagaaggcagggtgttttccaaattttgctgaagacaagaatcagttgagaatgtttgttagaaatgtaaattttaacaccatgtcagactcactgaatcaaaatctctgggagaatcttggaatagtatattaccagatctggaggaactactattctcttgctatcaggtaagccccatagagtgtcacttgtttgcaaaccactcacaggacaatagaattttttttttcaaacactaactcaaccagaagggacaatgtaatatatttaccactcaatcgtttctcatccattgtctgctttgaycctatgagcccatgagcmcctagcagcatccacatttttaaatgaattttaagtcacccttctaagacataartatttttgtttcaggtaccaatatattgtttgaaagagataccagaatacctgctttctgagaatttcctcaagttttactgagttcctttttaataagcatagtcacaatatgcatttgtgtgtgtgtgtgtgagagagagagagagagagagagagagataaagggaggaaggaaaaagaaatgtggttttctgccaagttcaagttccctagtgatggtgatgctgctgatctcggaacacgttttgagaaccactggaatagaccaataactctcaaatgtagcagttggaatctcctggaggagctttgaaatatacttctgctcaggtctcacccccagagattagttcaattggtctttgatgagacctagacagtaattctaataatcatccagccgggcgtggtagctcacrcctgtaaccccagcactctaggaggccaaggcgagtggatcacctgcggtcaggagytcgggaccagcctggctaacgtggtgaaacctcgtctctactaaaaatacaagaaattagccgggcatgatggcacacgcttgtaatcccagctactcgggaggctgaggcaggagaatcgcttgaacccgggaggcagaggttgcggtgagtggagatcactccattgcactccagcctgggaaccaagagcaaaattctgtctaaaaaaaaaaaaaaaagtccaagattgtgaaccaatactgtaggttgctccagataaaaggtaatgggttaggaagcttaagacttgatgaggaaaaataaaggttaaaccagtgctccttccacttcagtgtgcatacaaatcacctgggggtcttgctggaatgcagattgattctgtaggtctagggtagggcccaaaatgctgcttttttaaatcaagtcaggcagatgctgctaagattgcccaggggtctacactttgagtagtgaggtggttagaaagtgttgacctatgtaagtgcttatcaacacacagtttttatatatttttacgtagtatagaacaaataaaagcaatgtcattgagatttcagataccttagaaacaataaatattttgccattaatgactatttcccttcccttgatggctaaaacgttttgtttttgcttctccctacctgcttactcagagtttcaatcaaatgtttgtaaattaattttgctttagtatgacacatgtagtaacaggcctttcccctttgtaactgagtcccaggattcacggagtttgaggatcttgccktctggcttcctccttgcctcagaccctgccctttaggggttactgccctaagaggctgaaagtttagtaatgccccagrgcctcgttgcaggagctagtcacttttggcactttcttgctgtcagaccgcaggctctgggagccagtcttcttgkgacatggcttcatcctgtgtctctggcttgagcccaacctttcaggcctgggttaggggtgaagccttttatctggcaggtcccacagtctggcgcctttcccagcgtggtggagttgagaccttgctgtcagagcctgttcagaaggagagagggagagacaagaccttcgcgtgaggaggaaagagtttaagtcccgtctgtggaatctgtttcccctggcttgttgaattttctcagctgaacatggcagaagtggttgatatttgaattagaggctatgaaagtgtccttgggaaatgggtggggctgagccagtggtcttcccttttgcctctacctcatgctgaccaggggacaaggctctgtctcctgggtgtggcctgtcattggtcagtctgtgaccatactgctattctccaaggcattcctcaacagaatgggatcaggctttttcagtcatttcccatttttaaaggacatctccatggcagatgcccctactccctmccggtgcctgaatatttgcctgtctagcrtgggtaggtgaacgtcagcagaactcttgaagaatcactaaagggatgtgcttgtcctagcaggagagcctgtgacaatraaaaagcagagaatgttctgagtctcctrtattaaaaagggaaaagcttaagtgaggtttatttccactaaaggatagcaacataaggcagcttgacctttagtgtgactggagcaccgtaaatgctacttctacttttttyctttttttttattgtggtgaaaaacacatagcatagatttgccctctgaatgtttaagtgtacacttcattattgttaactgtatgcacaatgccatgacagatctctagaacttttccatttcacatgactaaaatgctgtgctcatcaaacaactctgtttccccctgtgccagcysctggcaccaacctttctactttctgtttctatgagtttaattacatgtatgtgtcatagaaatttggctttttgtgattggcttatttcacttagcatagtgtcttcaagtttccattctattcatgttgtagcatgtgatagaatttccttttttgtaggctagataatagtccattgtatgcatrtaccacattttccttaggcattcatctgttaatggacttttaggttgcttctgcatgttggtcattgtgaataattctgtagtgaacatggggatrcaaatgtctcttcgagttcctgtttttagttcttttgggcatatacccagaagtagggttcttgaatctcatggtagttctatttcttatttttttgaggaacctctatactgttttctgtagcagctgcaccattttacagtttcaccaacaacyctcaccaatgtagggttccagtttctctacatgctaccgatgctttgtttttttgttgttgtttgttcttgtttttttttaatagtggccatcctaatgagtatgaggtgatactgtggttttgatttggttctgcctttttaaactccaaattcagtctctggttacagcttttcccataaccattttcaggtgaggtgcgtatgctgcgttggtaacataaatttaacattgtgagagcttttatcaggcagcaaattgtaaagccccttctaggtcagacagttgacctctgtaaagcttaagttaggaacttttatgttcttaataaaacacaagaaaatatgggaaatttccatttggcatgagcctttctgttttcttggtggtggtggtgtgggggtggtataggctctccctaaattgcccaggctggaatgcagtggctcttcacaggtgcaatcatagctcactacagcctcgaactcctgtctcagcytcacaagtactgggactacaggcatgaaccaccatacccagttccattctgctttaaacagtggaaaaaatacatgtattttttaaatggaagggttggttatatcttcaatgtgaaatcctctatgtgaaatctaaataaactattcctggaatrtccagtgtcctttccccgtgatgataaacaaagcccagmgctgcctctctttaaagatagtaagaagcctatgcataaacaaaacwcttaaaaataagatcatttattttattttactcatccgcttaaacccatcaatgacttttaacttagaagaaaacctagtcttcctactatgaccaacaggactaagcaaatctcataacctmgcctctgcttacctctcacttcagcccaacctactctttccctctcttaaaaactcagtagctgaaatatatggmgctctttctggccccgagcctccagacmttttaaagaaaaaaaaagattgtaattttgatgaagaccgcattgtcaatttttatttctatggctcttacttttggtattatgtctagacctctctaagccctaggtcttaaagatcttctaggttttcttaagttttatagttttttttttaattttagatttaagattcatttggaattaacttttgtataagacagacggttaagaagattcattattttgactatagataccagattgctgtagcactgtttgttgaaaagactttccttccttttctgaaagagtttttcttttctgaaatgcctttgtcaaaaatcgcataggcacatctgtgtgggtctatttctgggctgtatgctgttcctgggaccatttttaccttccacctttcccctagttaactcctacttatccttcaggtcttagtttcaatgttgtttccgtggaaagacccttaaggaccacccattcctatacatctgcataccctcaacttcagtcctaaggaagggtacctctgttattctcactcaacacctgtttttttctccttcgtagcatttagcataatacgtgtataactttttttgtttgtgcacatatagttcgtgcctataagcctcaaaaaggcaagaastgagtttattttgttcaycactgtagtgcccagcactgtgcctattacatgctgagttctcagtsaatatttttgaataaatgagtgaaacaaagttaggcttcctgggggatgttttctaaatccctaggtatcattttcttaaaatcagaggatattcttggctcttggagccttagggcataatttttttcccagttaacccatctttgaagatagggattttgagaacttttggcctacctcagggtcacctagcgggttatcaaaatgcagattgcagggccccaaacccagagttcctgcttcagtaggtctgggatgggccccaaaatttggatttctaacaagttcccagaaaataatgctgatgctgctgttctgggaacccactttgagaactgtattagtctgttcttgtactgctatgaagaactacctgagactgggtaatttataaagaaaaaaggcttaatcgactcacagttccacaggctgtaaagaagcatggctgggaagcgtcaggaaacttacaatcatggtagatggcgaaggggaaggtggcacgtcctatgtggtgggagcaggagaaaaagagggaagaaggtaatgctacgcactttcaaacaaccagttctcgggggaagtccgcccccatgatctaatcacttcccaccaggcccctcttccagcacggaggattataactcataagatttgggtggggacacaaatccaaaccgtatcaagcactagtgttttaacgttaagaatctgaagaggcccgagtcactgagccgccactgccaaggactcatctcccccttctcccgccaccgcccgcttttgcagccatttccactgaggaaaaacaatcgtatgtccacagtccagaacctccactctttccacccctttgctgatacaagtaagggtgatacctgtcctgctggcactgaggattatatccatataagaattcatccaacagagaaatggcaggaagacccttactactgtccaagggactgctgatgattatgataaaaagaaaccaatgaaggcatttaaaaagaaatttgcctgcaatgatactgtaattgagcatccagaatatggaggtcattcagctacagggtgaccagcacaagaacatgtgccagttcctcttagagattggaatrgctaaggacaaccagctaaatgttcatgggttttaastgctgtggctcgctgaagcttgaatgaggttttccttgcaatgagtagaatttcctttctgtcccttgtcacaagtttaaaaacctcacagctttgtataatgtaaccatttgtggtctgcttttaacttgacctagtgtaattccttcatgcagtaaacttgaaagagccatgctgtctagtcttgaagtccctcatttaaacagaggtcaagcagtaggygcctggcagtgtcaagcctgaaacaaagcaatactgtcatgtttcagccacacctagagccctaagatcatagacaactacgtctggccagaagctcctccgctctccctctgcagagttccctgccctaagagactgtcaccacccgaacaatcctcggtgaatctaagaggagaggatggggtaaggcagcaacagcaactctaccactggaagggagcctttggtggtcaaagaaagatcccctggtgtctataacctgaccaggtgcagagttttagagaggcccccttcccaatagtgaggtgataggacatctggcttgccacaaaggtctttttgaccagacatgccctagctaagggatgtccaaacaccagaatgtgagaccaaccttccatcaaagttaaacctttgacaagggaacaaatgtcaacactgatgtaccagtcatgtagctagctgtagagcttgcaacttaatggcaacagctgtccaatttcatgggaagtaaccaactggttttgaggtttgtttgtttttttcccctccagttttaatgttatgtgtaatgtatttaaaccccttttttaaatttaagttctagggtacatgtgcacaacatgcaggcttgttacgtatgcatacatgtgccatgttggtgtgctgtacccattagctcgtcatttacattaggtatttctcttaatgctatccctcctctcttccccctccccacaacaggccccagtgtgtgatgttcaccgccctgtgtccaagtgtgctcattgttcagttcccacctatgagtgagaacatgcagtgtctggttttctgtccttgcaatagtttgctcagaatgatggtttccagcttcatccatgtccctacaaaggacatgaactcatcctttttaatggcagtatagtattccatggtgtatatgtgccacgttttattaatccagtctatcattgatgggcatttgggttggttccaagtctctgctattgtgaatagtgccacaataaacatacgtgtgcatgtgtctttatagtagcatgatttataatcctttgggtatatatccagtaatgggatcactggttcaagtggtatttctaattctagatccttgaggaatcgccacactgtcttttacaatggttgaactagtttacactcccaccaacagtgtaaaactgttcctatttctccacatcctctttagcacctgttgttccctgacattttaatgatcgccattctaacaggtgtgagatggtatctcactgtggtttcgatttgcatttctctgatggccagtgatgatragcatttttcatttgtctgttggctgcataaatgtcttcttttgagaagtgtctgttcatgtccttygcccactttttgatggggttstttgattttttcttgtaaatttgtttaagttctttgtagaatctggatattagccctttgtcagatgggtagaagccaaatgatgagtgaactcccattcacaattgcttcaaagagaataaaatacctaggaatccaacttacaagggatgtgaaggacctcttcaaggagaactacaaaccactgctcaacaaaataaaagaggacacagacaaatggaagaacattccatgcttatgaatrggaagaatcaatattgtgaaaatgaccatactgcccaaggtaatttataggttcagtgccatccccatcaagctaccaatgactttcttcacagaattgggaaaaactactttaaagttcatatggaagcaaaaaagagcccgcattgccaagacagtcctaagcaaaaagaacaaagctggaggcatcacgctacctgactttaaactatactacaaggcttcagtaaccaaaacagcatggtactggtaccaaaacagagatagacactaatggaatggaacagaggcctcagaaataacaccacacatctacaaccatctgatctttgacaaacctgacaaacacaagaaatgaagaaagcattccctgtttaataagtggggctgggaaaactggctagctatatttagaaagctgaaactgcatcccttccttacaccttatacaaaagttaattttttttttttttttgagacagggtcttgctctgtcgcccaggctggagtgcagtggcgcgatctcagctcactgcaatctccgcctcctgggttcaagtgattctcctgcctcagtctcccgagtagctgggattacaggcacccgccaccacgcctggctaatttttgtatttttagtagagatggggtttcaccttgttggccaggttggtctcaaactcctracctcaggtgatccacccaccttggcctcccaaagtcctaggattacaggcgtgagccaccacgccaggcctaaacccttacttaactaaaacttgttttcagaaaaaaatggatctgaggatgtgttacgtgtcccccttttacttagtgacagtcccaggcacacttgagcttgtcattaacaatattcatcaatttaagcgttgatcagagaaggtcatacaagaatccaatctcagtggaattaaaggaaaaattgttgctaagcagaaaataaatgagaactgtacatttaaaataaataaatgaacagaaagcctttcaaatcatactaaactaacttatatctgtggctactacattgttgttctttaatgcttaaataggtaaaagcactgatgttttagttgaaactaccagcagtaggaatgcttgctcagtaagagcaagaccccactaacacagtcatatttataaagtcaaggtttaggtgtctgccagggtctgttttccctaaatctattacaaacaaatgaaagcaaatcagtaaatactgttttaatgtacctataccgagtcataaaattattttcctcccaagtcaggaagaaacataaagttggttaactgaaaaagagaaagtttaatcattctgattttcattctgatgctcttctttagactatctattgctgctttcttttgtagcagaacagctgattttccgcctaggttttcatgatctgataaaccttcaccatagacagtttcttggaaagaaactttggaagtgtcagttatctttaaatgttcaggaagctgtgtgggtctcagacccagctggagcagagccagcacgggattctgaaagcatttgcaggctctgagatggttttaacctgttccttggcagtgcagcccttgtgtacactcttggaaagatactaatgtttactttcatgatgtagaatggatgagcagtgaaggtttctaggaaggttgarcacactcatgcccactttgggacacaaggaggcagatgctctcatgggaactcttcaaataaggtcgtatggtttggctgtatcctcacccagatctcatcttgaattgtagttctcataatctcgtgtgttgtgggagggactcgatgggaggtaattgaatcatgggggcagttaccctgattctgttcttgtaatagtgagttttcatgagatctttacacttgattaatgttaactgtagttgtcctactgatctatcgaacaccaagtcttatttcttctaagtgtatttgtacccattaatctactgctcttcattccccatccccgctacccttcccagcctccggtaaccactagtctactctctatcctcatgagattcagttttgtagctcccacatatgagtgagaacatgcracattgtctttctgtgctttgcttgtttcactgaacataatgacccccagtttcatccatcttgctccaaatgacaggatttaattctttttatggctggataatattctattgtgtatttttaycacactttctttttaaatatttattattattttgtagagacagagtcctgctatgttgtccaggctggtctcaaactcctggactcaagcgatccacctgccttggcctccacattttctttattcatccattgatggacacttaggttgattccatattttgtctattatgaatagtgctgcaataaacatgcaagtacagatctctcttcaatatattggttttctttcttttagagaaatactcagtagtggaattgctggatcatatagtattctacttttatatttttgaggaacctctgaactgttttctatagtggctgtactaatttacattcccaccaacaatgtgtgaggatttttctttctctgcatcctcaccagcatgttattccctgtcttttttgataaaagctattctaattggggtgagattatatctccttgtggttttgatttgcattttctggataattactgatgttgagcacttcttataccctttgttcatttgtcctctgttgagaaatacctgttcaggccttttgccctttttaaaatcagattaatgactttttgctattgagttgtttgagctccttatatattctggttatttatcttgtcagatgggtagtttgcaaatactttctctcattctatgggttgtttcttcaccttgtttgagtgtttcctttgctgtgcagaagcttttcagcttgatgtaatcccatttgtccattttcgtttttgttgcctatgcttttgagaacttaaacaaaaaatttttgcccagaccaatgtcctggagcatttccccaatgttttcttttattagttttataatttcaggtgttagatttaagtctaaatccatttgtatttgatatttgtacatggtgagagatagaggtctagtttcattcttctacatacagttgtccagttttcccagtgccatttattgaagagactgtcctttccctgttgcatattgttggcacctctgtcaaaaattagttggctgcaaatggcatggatttatatctgggttcactattctgttcagtcggtgtttgtgtctgttttttatgccagtaccgtgctgatctggctactatagccttgtagtatatttttaagtcaagtagtgtgaggcctccagctttgctctttttgctcaagattgctttggttatttgtggttccatataaaatttaggattgtctgctctgtttctatggggaatattgttggtattttgatagggattacattgaatcagtaaactgctttgggtaggattgtcattttaacaatattctttcaatccatgagcatggaataatatcttctccattttttgattcatcttctatttatttaatcagttttttatagtgatccttgtaaagatctttcacagctttggttaaattgattctcaggggccaggcacagtggctgacacctgcaatcccaacacttcgagaggccaaagcgggagaattgcttgagcccaggagtttgaggccagcctgggcagcatagtgtgacctcatctctaaaaaaaaatcaaaatattagccagacgtggtggcatgtgcctgtggttgcagctacttgggaggctgaagtcagaggatcgcttgagaccaagaaatcaagactgcagtgctcactgcattggtgacagagtgcaaacctgggtgacagagcaaaaccctgtctcaaaaaaaaaaacaaaatattcctgggtattttacattctgtgtagatacrataaattagattactttctttctttttcagattgttcactattggtatatataaatgctactgaattttgtatgttggctttgtatcctgcarctttactgaattcacttattacttctaatagttttttggtttttaaaaatagaagatcctgtcgtytacattcaaagcgaatttgacttctttctttccaatatgaacacctttatttttttttcttgactaactggccaggacttccgctttatgttgaatgaaagtagtgaaagtgcacccccttgtcttgttccagatcttagtggaaagccttttaggttttccctgtttggtatgatgttggctgtggatttatcatatatggcctttattattttgaggtatgtttcctctgtacccggtttgttgagggtttttatcaaaagggatattgaattttattgaatacttttcagcacttattgaaatgatcatatggtttttgttcttggttctgttaatgtgtatcacatttactgatttgcatatgctgaaccatctttgcatccctggggtgaatcccacttgataatgttgaatgatctttttaatatcttgctgaattcagtttgttaatattttttgttgaggatttttctatctgtgttcatcagtgaaattagcctattgttgtcttttttttttttttttttttttggtggccttatctggttttggtatcagggtaatgcccgccttgcaggatgagtttgagcattccttcctcttcaattttttttttttttgaagactttgagtagaattattatagttcttcttgaaatgtttaatagaattaatcagatcctggacttttctttgataggagagttttaattatagcttttatcttattacttgctattggtttgtcgaggttttctctttcttcgtggttcaattttggttgtatatgtccaggaatgtatctttgtcttctagatttttcaatttgttggcaattgtctctaatgattctttgtactcctatggtctctgttgttttgtatcttttttgtttctgattttatttatttgggtcctctctttttagttagtcttgctaaagttttgtcagtttttttttaactaaacttttgttttgttgatcttcagtaatgttctaatctcaatttcatttatttttgctctgatctttattatttcctttctcctagtaaatttgggtttggcttggtcttgcttttctagttccttgagatgctccattattagtccattattaggttgtcttttggtagtctttcaacttttttgatgtagatgtttattgctataaacctccctcttagtactgtgtttactgtatcccatagatttggatatgttgtgtttctatttttatttgttttgagaaatttttaaatgttcttatttcttcatcaactcattgtttattcaggagcatgttgtttaatttccatgtttttgtttaatttccaaaggttttttttttgttttttttttttgagatggagtctccctctgtcatccaggctggagtgcagtggtgcaatctgcaacctccacctcctgggttcaagtgattctcctgcctcagcctcccaagtagctgggattacaggtgtacaccaccacacccagctaatttttgtatttttaatgagacagggttttgccatgttrgtcaggctggtcccgaactcctgacatcagatgatccacccacctcagcctcccaaagtactgggattacaggcatgagccaccacacctagcccaaaattcctcttgttattgatatctagttttattccattgtggtcagaaaggatacttgatatgatttctacttttaaaaatttgttgagacttgttttgtggcctaaaatatggtttattctggggaatgttccatgtactgatgaaacgtgtattctgaatagttgagtgaagtgtgttttataaatatcagttggacctatttggtctgatgtgtagtttgatacaatggtttctttgttaattttctgtctagatgatctgttcattggtgaaaatggggtatttgacgtcctccactattattgtattataatctctctctctctttgtatctattaatgtttgctttatakacttgggagctgaatttcagtccatcaartgtattaatcagttctaagatttctgtttgattttttgaataawgtctctttgttaaatttctctgataaatttctgaatggagaattaccgttttgtttcttgttttctggttgttttgtaactcttctcctcctttcttcctgtcatcctttatggttaagtgactttctctggtactatgttttaatttgttggggttttttttagtgtgtttatcataggtttttacattgtggttaccatgaggcttatagaaaacatcttatagataaaacaagttattttaaagagatgacagcttatcttagataagcagtccccagtctgttttggcgccagggaccagtttcatggaagacattttttccatagatcaggcagtggggatggttttgggatgaaactgttctacctcagatcatcaggcattagatcctcataaggaacgctcaacctagatccttcgcmcttgcagttcacaatagggtttgcactcttatgagaatctatgctgctaatgatctgacaggaggtggagcaggcagtgctgtgtgacctggttcctaacatgccacggaccagtactggtccatggctcaggagttggagatccctgtcttagatcacaaaaaaaagaataaataaaaaactttaaaacaaccctccatctttaattccatcccctgacattttgacttttgtgggcctgaatttacgtattttgatattgcctatctcttaacagattgctgtagctgttagggtttttgatagatttgtcttctaggtgtcatactagaattatgggtaacttatgggtggactgcacatgacaattagagtatttgaatattctgggggtttctatacttgatgttacctgtaggttttataccttcaaatgttttctttttgcacattaatgttttttcatttcagattgaagaaccatctttaacatttcttgtaagacagatctagtagtggtaaattctcttagcttttgtttgtcagaaaaagactatctctccttcatacttgaaggatatttctgctgtttgctggataaagtatttgaggatagcagggttttttggggttttttctttcagcactttgaaaatatcattccacttcctcctgacttacggtttccattgagaagtgtgttgccaactgaagtggagtttctttgtatgttatatcctccttttttcttgctgcttttagtatcctctttttgtccttgacctttgagagttttattattatatgccttgggtgtagttttatttgggtcaaatctgtttagtgttttctgaccttcctctacctggatatttttctcatattttggaaagttttctgttattatttattgagtaagcttttttctacccctcactcttgctcaactttctcttgaacaccartaattcttagatttggtcttttaaggtaattttctatatcttgtaggcaatctttgtataatatatttccattcattttactttttctcctctatgtaatttcaaagagcctgtctttgggctgactgattctttcctctgcttgatgcattctgctgttgagagcctccaataaatttttcagttagcaaatatatttttcaatttcaagattcgtttgattttttatcacttcaatctctgttaaattcctctgataagtttctgaattgcttttctttgttgtcttggagatccctgagtttctgtgaaactgctattttgaattcttggtcagagagctcatgaatcaccatctcattagggtcagtcactggttccttgctttatacatttggggaggtcatggttccatgttcttatggatatatgtctgtgtctttgcattaaaggatttattatttattccaatcttctctgtctagtctgttttggtttttactggtatgtttgcttagagattatttgtaatttagctgttgaatttcttacacatttttcccgctaggtcactgcctctttttcagcactaaatggtacttaaaacccaggtttgcctctgttcttctagcaaaggatcagaggattgcctggctggaatgggggaggttgcaaaggagctatccctgtggtatggaaaggctggctaggagttcatgcccaagagacctgtggaatctacctcctacagcatagtgctgccgaacacccactctgatttggcgtctcctttggttgagttacagagcggagcttccagggctggagatggtaatcctgcctccttcctttgtgtccggctgtccacagggtggtatctcccttcaggcactcctgatgcttctcatgggttgaggcatggataggtctcctgccaaagaagccaagatggtaggcaagttgtgtgtccaacttaatctcactttttccagtgtagaatctgagttgggggaagttttacatgtgcttgataccaagcagattgggggaagggtgtcacagatatgaaaatctgattctcttactgtctsctggagttttttttttttkttttttttttttttttacttctcagtggccccaggaactgaccgattctctttcatgagttctgagagattgctggtgataatctcgatggtgtatatttattttggttattctgtggggagaagtgaagccagctttcatctacatttttaaagtataattcttattttgagtggcaagaatctgattccagtatcctgccttagtttttatgcatttttgaaattcctaccattgcatttagaaccttctacctggtggagtttttttttgtttgttttttgtttttcagttttggaagtatttgattttttgaaacagttgacattcatataaagaacaaggttgataatcaagcctgctctagtaattctgtgcagtctagaaaagagtgtactggggccgggcgcggtggctcacacctgtaatcccagccctttgggaggccgaggcatgcagatcacaaggtcaggagatcaagaccatcctggctaacacggtgaaaccgcatctctactgaaaatacaaaaattagctggacgtggtggtctgtgcctgtagtcccagctaatcgggaggctgaggcaggagaatggcgtgaacccgggaggcggagcttgcagtgtgccgagatggcgccactgtgctccagcctgggtgacagagcgaaactccgtctcaaaaaaaaaaaagagtgtactggttaagtactgagaagcatttcctgtgtgtctcatgtaagtacttcaggctcttaaatgtgttactccaaggaataaggttgcaaatacagttgctctaaaaacatattataccagcctggccaacatggtgaaaccccatctctactaaaaatgcaaaaattagctgggcatggtggtacacacctgtaatcccagctgcttgggaggctgaggcaggagaatcacctgaacctgggaggcggaggttgcagtgagctgagatcgcgccactgcactccagcctgggctacagagcaagactccgtctcaaaaaagaaaaaaaattacataaaattccgagatgcagctttcttatctaaaaaggatttgcgcaaagcctccttgcagtaagcatataggtaactaaggtgtctaccttacgtatatgcatcactcatttatgccctaagttctcatttgttaaaacaatagtgcccttactctaaatcacataatcacaagagccctagggctgaattgctcagctttaaatgtcagcactgtcatactagctgtgtgatgtgagcaagttctaaaactccctgtgcttgtttcttatgtatacaatggagagaaggggtagtactttgtagggttgttgtgaagtttaaacaaggtaataactgttaagtgtttttaaaagtcccttgaatgtaacaattgcatcagtggtaaggtatgcatttttctcatatggcctctgaaatgaggatgtgtcttataatgaatgtaatttcttaataagcattttatcatttagtgacatcttttttattagtagtacttaatgttacactttgggtgacattttatatttcaataactaatagtaagaggtctattaacattagctgccatcaacattaccatcaatattatcatcagcattatcttgtttctaactgagatagtggcatttgatagtttagcagtgctagagtatatatcaaatctcaattttatctaactacttgtttgcattggtgtatttttatcaaagttctagtgtgctgtttttcatatttgtatcattttagctaatgtaaagtatttatggggtcagctcatgcaatgtttccgtcattcattgtaccttacttggcgatctactaaaacatgcatcagcatccttcagtctcccgaaataaatagacacaaagacaaattctttattttctctgttgatgtattttcctaaatcstttcgcaggagtggtttctttcttagctaggagaactaagccaccattgtaccacttaagatttactggtttgcactgtcctctgagggagaaaagaagcaatttattgatctgtaacacaggaatggactgtggccaaaccttttctggtttatacaatgcaccgacataagaatctgcatagcattaakaagaatgagcactcacaatttgaggccgcctgtcagcatgaataataactgagaaaaatcaatacacaatatacaactgttctctttgcacagacactgccaggattcacacccagtgacagtgtcttcttttttttttttttttttttttttttgagacagggtctctcactctgctgtgcaggctggaatgcagtggcgtgatctcggctcaccgcaacctctgcctccctgttcaagtgattcttgtgcctcagcctsccaagtagctgggatcacaggcgtgtaccaccctacccagctaatttttgtagttgtagtagagatgggattttgccatgttggccagcctggtcttgaactcctggcctcaagtgatccacccacctcggcctcccaaagtgctgggattataggcgtgagccaycrtgcccggccaacagtgtcttgttattttaccartgatatgcttayagttccyaattttaggcttcctccttattttggttttattgttcagtttggggaagggtgggaggcaccaatttggatctgagaaaaagatcttctgccagatgaaagagtttcaataacaggagaggaccttgggccaaagttwattaagcttgactaggaagattctgggcacatctccatccaaataccttgacacatacttcattcacccctagcacakgcagcttgtcccttcttgtcttctgtttgccttcaaggttttacatggtggtatttacaagccgttatggagcaagagtgcaaacacacaaggctagcaaggggccagtaaacagggtttggcttagggttttgtggttgttagcttttaaaagcatacttagttgaataattccagaaactgggcttctttcctttgccccttcatttgccmctccctctctggtcttcccagtctccactttttttkttgtttaaataaaactgcgtttgtcagaaatgtatagacattcactcctattcttaaaagacagtgtttatccctaatgcctgccttttgattcagccagcartgactgtgcacacagaggttattgctctccaagttcaatgttgtggacctgaaccagtgcctctgtttccaagagaaagtcaggtgattaccccttcatcagggagattggagccatcctatccttctggtgtgtcaccagccagaaactaaggrtcagcagggagtggatggtttagaatctcctctctccaggtgaacacaatgctagtcagtgtagctggaaaagccacgcagcgggcaggcttgtcagaagcaatctgtttaaaaaaaaaaaaaaagagagagagaaaaaagggtccttttgartttacactgagttgctttcacagtagttagctttgaactgtggtgcaaacccatttaaacaatgagggaaatttcactaagtggcaagaaattctcaccctgtgtgatcaaagcaatcagccatttccttttctttcctttttatttacttatatttctgaccccttataatcttcatgattgtagcctgatagtttccttttttgaatagcatttaaaaaaataccttttcttttccctgagrgttttaaagcaaataagacagaaggggtctaaatttttagttttgttttttgagacagtctcgttctgtcgcccaggctggggtgcagtggtgcaatctcagctcactgcaatctccgtctcccaggttcaagtggttctggtgcctcagcctcccgagtagctgggattacaggcgtgcaccaccagccytggctaatttttgtattttttagtagagaagaggttttgccatgttggccaggctggtctcaaactcctgacctcaggtgatctgcctgcstcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgtttaaatgtgtacatatacacatacatatttttaataaaattaggtttaggatagtatacagttttgtttttcttttaaccaacatactttgaatattttgccttattaaaaacttatatgatttcaatggctgcattagaattagtgtatacagatattattttggcattctgttgttaagaggtcatgtgggtttctgaattgacactttaattctcaacttagaatttatttctcccaacttcttctgayttcatgggtctagagtcagagtttgggcacaatggaaatggratttctatatrtactgttgtttactgtttgctagtatttttcgraaggtatttgcaaaaaccaaaggggaaacagtatacttttttgtatttttttttctttttttgttttaaattttgtgattgaaatataagtcttattatggtaatctcaggtaacttttaaatagaaatatcaatgcaaaatgaatatattgcccaatgtggaccccggtgtttcagaactatgtgccatgctctatcattttgttactggaaaggggtcttaatccagaccccaagatcttggatctctcacaagaaggaattagaggtgaatccatagagtaaagtaaaagcaagtttattaagaaaataaaggaataaagaatggctactccataggcagagcaggagcgtaggctgctcaactgattatacacacagttacttcttgatgctaaacaagaggtggattattcttgtgttttgcaggaaaggggtgggtagttcctggaagtgaggggtcctcccctttttagaccatataggataacttcctgacattgccatggcatttgtaaactgtcctgctgctggtgggaatgttttttagcatgctaatgcattataattagcatataatgagcagtgagaatgaccagagatcactttcatctccatcttggttttggtgggttttggacggcttctttaccacaacctgttttatcagcaaggtctttgtgacckgtatcttgtgctgacctgtctcatcctgtgactaagaatgcctaacctcctgggaatttagacttaaaataaaggtctcagccttattttatctagcccctactcaagatggagttgctctggtccgaatgcctctaataatttgaagtttatccaacggcacagtgggagataatgaatttttgtttaagaggaggaggactgactggatcagatttgtgctttagaaaggtggttgcatgtaagaaagaggcgttggtagaaagacttcggatatctcaaaagaatttccatgaagttaatctttttaaaaatgtaaacatttggtgcaataattgctttgaaattgcagttgaataaatgaactttttgaaccagaatttggaaaggaagatatgcttaaaaaccaaaaatatttygtagagtgctacacattaggaagtcatttgtatttggtgaccactttcctaaaatagtctcatttctagagaaccaattttgtttcccatagattattatgtgtagagaccccctttcagtatgtagccactggtacatccgtgggtgttatctccatactgccaggtccaatgcrgtcacctcctggatctatagtctttctccccccattccgatttcctttctctgttagcagtcatctttgtaaacrgaagtctaagatttagtttgtacattttttaaatgatccattttgatggggctctctttattgtttcaggttgaatgcctttgagaacttgatgcataaaatttgcatgactcctcactcctttctggatctcycattggactcaagccagcatggctcacaccacaaaggttaacggcagtgcctcaggtaaccctgtgctctggagtttgtgtgttaaatgtatgtcttttctcaaastaattttttattctctttaataatgaacrgataatagcaagttgcctagataactaggatttcaaagcaattttctgtccrttgaagtttgggtttgttttgttttactctcagaaaatttgcttttatcttagagtcttgcactgaaatcaattgagtaaattattacctaagtcaattctgttgaagtgttgaaagacaaatgtaaatactgaatgctgatgcaaatgtaatgtatactcctcttgcacttctttctgagggattgaatgaggagagaggaaattagtttggatgcttaaaaccaattcctagtagccactcccaagcagcttttgtttgatgttgctaaacaaagagaaaggagggaagagaagtatatattctgtaaaatgattctcttaggaatatgcaacaagccatattatgaatcataaagacctgtatttgaattcttattttggttatattagagacttacatagtttcactttctgttccaatattgcttctgtgagattcgggagaaatctgtacacgaaatgcagagaagatcctcctaagagacacatcaccatagggacaacctgcccaaaatggcgtgccaagtgttcatttcttttttgagttatgtgccaaatagctgaatgagtaagaatagtaattgtctatgcagaaattttttctgagcgtctgagtccagactcctacgtctgctggctctgaacaccttcaaatgacaacattatatactggagcaagtgtagaattggagccaggaaacctgaatttgagtcctagttccagcactaaccgtgaaatattgggcagggctatttctccacatgtaaaccatcggtaagtatatccacctgccggtttaggaccagtgagcgcaccagaaacatacttagaggagctatgtaagccgtaaagcacttttgaagacaacagcaggaagtgacctctaaagtgggcattcccagcccatgaatgtgactttttattctagcggtctcagctgcaattatctcctctgggtagaacactataacccaaacccagataaactcagttatttgttctgggatgactgatctttccctgtccattccatttttgaccttttttactgcccagcttcttgagacttttatagattctgctgtgggactgctatcaataataaagacatgaatgataatatctaacattcattgaacacttaaatgcaccatggtgcctaaaatgctttgcctgcattttcatacttaatcctcacaataatctaatgagattaagctattattttactgtcatcatcatccctatgtaatgtcacagagaagttcagggacttactgtaaatgaagtaagaaaaatcagaattatgggcagtggctcacacctgtaatcccagcattttgggaggccgagggggatggatcacccaaggtcggtagttcaagaccagcctggccaacatgacgaaaccccatctctacaaaaatacaaaaattagccaggcatggtggcgcatgcctgtaatcccagctacttaggaggctaagacaggaatggctggaacctgggaggcagaggttgcagtgggcccagattgcactactgccctccagcctgagtgacagagtgagactccatatcaaaaaataaaataaatcagaattatgatgactttctccagtaaaatatttggtgagagaggagattgaaacattatgaaatttcaagtgtagtgggtgggttttaattccctctgatgatgtggtttcctcccttgccctccatttgcttccattcacatgctcaggggaaggggtgtttaagattgttggtgcctcaagacctcaaccttcttctggtgccttgggcaaaatcctttcttcatgggtttagatacctaccccactaattcctttccaacttggtttgttctgtacttaccttttttctttgttcctgagatctaataagcaagctgtaacttttccttcccacctggtatcctgcctaacaggtctgggcattgaggttgaaggcaaaagaaagctctccgatttgtgactttcagggtgtcagagtatgaattgttactgcagacagttatctggactgtgcaggggaagattttttacttattctagtcaccatgacccatgtacatctataagcaaatctaattagagactcaaccataaacagtaatatatatgcaaacatacatatatgtgtgtatgtgtctgtatatgtatatacacacatagtaatatatacatacatatatgtatatacaaacacaaatgtgtgtacaccatatatatgacactcatagaaaaaaaaaatttttttttgagatggagtcttgctctgtcacccaggctggagtgcagtggcacgatatcggctcactgcaacctctgcctcctgggttcaagtgattcttgtgcctcagcctcccacgcagctgggattacaggcccatgccatcacgcctggccaatttttgtatttttagtagagatgaggtttcaccatgttaaccaggctggggttgaactcatgacttcaggtgatctgcctacctcggcactttgggattacaggcatgagccaccgcacccagctgaaaatttaaaagtatagatgygtgttgtattgtctgaaaaccaaaacaaaagcaagaattactggtgataataccacctagaaataaatgtcttcctattttttatatagttgtcaaatgttatatatttcacatggttgagaatatgttaataaaaatcattcctttaccttttcccactttgtattacaaargaaacacctctccaatgtttaaaaaaatactcaatgtaagagatgcgggttataaatacacttctgtgcatgtaaataacatttagagaacctagatgaagatgagataaagagggcttcatggcagctagtgagggccaattactggtctcctatgagaaaaggataagctatttgggtttagtaggagtttcagatgtrgagtaaattatatgtttcttcaatttccaaaaattgctgcttgggcttcatagagcatgaggggaaatttcatgtgacgatggagtcagggcagtggcaaaagaagcactttccatagtgttagtaataaaacaagcaaaagaggagcctctgggaaagggcaaaccatgcccttggcacaaaatacatccgacgactgatcatctcaagttgacatccccatgtaacatttaaatgggataaggggtgattcacaaccttttatactctgacttccccttggagtccctcacggaggctgggtaaaagaaactgcttttaaaacgagctattcattaatgctgtaatttgtaaaatgtattatgccacacttcagacatacaaaatgtgtgaaagttatataacaagcacctttgtacacactacttagcttaagamataaaccttattaatataggccagatatacatgagcacctactacgtgctgttttaggtactggggatacagcagtgaaccaaagaggcaaaaatttctgccctcaaggattgtacattctagggamagttaaagtctcctgtgtacacggttgccagaagaaaaaatactaarcacgtgttcatcgtttatctaaaattcggtttaatggtgctccactttcgtgcgcggccctacctgtgtaccccttgcagattgcacccctgcccttcctcaccgccagcccatcaaaatcaatcttccctcgtagtgttacctctttttcaccagatcctccatcctacttctcttgattggtacagtaytgttttcattaattcaaaacattttaggccagatggggtggcgcagacgtgtaatcccaacactttggaaggccgaggagggaggattgcttgaggccaggagttcaagaccggtgtggggaacatagccagactccatctctacaaaaaaaaatttttttaaattagccaggcatagtggtatgcacctgtagtcccagctactcaggaggctgaggtgggaggattgcttgagcccagtagtytgaggctgcagtgagttatgatggtaccactgcactccagcctgggtgacagagccagaccctatctctaaagcaaaaaacaaaaaacattttattatggtactgctaacagtactgcagcgtcttttgttaaggaggtaagagcatcataaattgctcttgactgttctctcatagccagctaggaagtaaatggtgattgttggttaggaaaatagctgtgtttctttggggtgtagggatgaggcagtctgctttttccccaagtttctgaatcatgttgtaaactgaatgcactgattgatacctctctaaacactaatgttgtgaaactttaattagagcttagatatgctttagaagccaaataacaagtggcttatttgtgaaagaaagataataatagctatcctaccttcttcacaaggtggttgtgcagggaaaaaaagaatagctgtaaaaacactttttaaaacacaaagtgctggtcatatrtcaggggatagcaccattccccttgttctcttgtccttgtcatgagccgctgatcaggaaacatcccaggtaccctcatgtcaggccctgctggacgccatgatattggggccagagttgtattaacatcctcattaaacccagttaaatgacataaatggatgagcactgggaggtgactttttatgcctgctcttatcatctttatttttgctamtagttgccttccccaattgattatagcttttccctcatgctctttctttttttgcagcctggatatatattttttcagacagatacatatttatttattaaagatgcttattgaattgcattaaaatgttatttaggctgggcacggtggcttacgcctgtaattccagcactttgggaggccgatgcaggtggatcacctgaggtcaggagctcgagaccagcctggccaacatggtgaaaacccgtctctactaaaaatataaaaactagctgggtgtggtggtgggcgcctgtaattccagctactcgggaggctgaggcaggagaattgcttgaacccgggagacgaaggttgcagtgtcccgacacagtgctactgcactccagcctccatgacaaagtgagactccgtctcaaaaaaaaaaaaagaaaagttatttaaatwaatgataacataaaatttgayaggaaaccagaagagaagaattactcaaaattccacactaggtcttatttttagtatttatttttcatgcttttcaggctaacaaacttaaacacagtttcaataagcttttataatttggatatcagctcttgactttaacattctttgcatttttccaagtcttcatggaaaatagttttcaaattattattttcaatgactgtataatattccttatggtgtttctaccagttgaagtattctttttttgtttggatgtttggactgcttccacattttccctatggtagatgatgttgcagagaacatcttccctggtcatttttctcctccttttttattatttcccaacaatttcaaagaagcaggatgactgggttaaagggcacaatgttttcatggctttagtaactgttgtggggcttgaatctcgttatcttggtcagttatttggctccagcttttgtctctatgctgatcttaaatgagtacaaaggccactgataagaccgggtcagccagacagagccaggctcatggcagggtaggcagaatgctgcagtgcggtgcaccccactctcgcttgtgtaaatatttttctgggcaggagcgtttctcaaacagaactctgagcccactgcggtgaacctgatagcaggaattacgtgctatttgtcaagtataagactagtttgcagtgactggtctggctagaacccacctggtgttttctgagatcatctgtaaggaaacacacagcacagcagaggcagtgtgcgcccgtggtggtgagtcttagacctgtcatctgtgttagcattaccccgaaggcagagagtttgctgattagaaactatggctgctttaattcatgggtaccctccgtgacttttcagggtctcctggttgaatgaatttgcagaaggattaaaatgtgtgttcttatttgtgctttgtattctcccataagtagtgtgttggaggctattagaatagctgagagggtaaaacataaacacataggtaggagcctgacataaacacataggtaggagcctgccataagcacgtaggtaagaactaaaagggtgtgtttccatttcagttgtccagccttccttccatactctcagatgacaaaacacaagttgctgagctcacacagctaatgactaagccagaagttggacatggagaacatttttcctttgttcaaggttatttattatgttgacatttaaaatcagaagtgtgatatctgtgaagttctgattaaacagatcaagtgaaaaggatgtanttcagaaaactgcataaaacyctaaagtacagtgtttaaaaataaaacgtcctccctgatagggattatgttggtaagttactttttttcttagtatggattatttcaaattaataaacatattgttattcctttatttattgcatcatacagcttcatcctagtattagtgtgtttaataattgcatttaattagattatgcatttcaactttcaatgaaactgtagctgttagtcttttgaaggctaatttcacgctgaaatttatagatgaaataattttcttatagtggtggtgtttgagaagataatgtaactacttcttagatttcaatttcataacccttaaaatgttgggaccacctacaaatgggggacaccctgggttttgaagtcttgcctgtgtggttaatcagaacctcagaattcacccagcccccggagaggttttgaaaagcccctsgctcatcagagcttgcttgtttcataaactcttaaggctttgttttaacctgtagccagcttcrccttataagctttcttgcyccaagccttgagccagtcataatggcttaagcatcagatttcagacaggcgattagctctccagctaagccaagaaaggatgatttatcttccagtgagtaccagcctatttgagtgtaggaaggagaaaaatctgtgctcctgctcctgggtactgggcaaagaaaccctttggttggggatttttgcctggtaccaactttataggtgccaacaagaaagaaagaaaaaaacacatacaaaataaacacccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgtgagtattggcatttatttctgattatgcacttcccctctttcttgaatgagttgggtgggctagctgagcccatcaaaggtatagctcatttgcttccttttccagggtttgccttcttcctgtgtctgggataatttcagttcatctcctttgtgcagtttctgagaaaggtttgtatgggcttagaggaaaatgatcgtgactaaagctcacagtcaccgctttggctccttttytataaaaggtggtttgatttgatctggcatgaaaaatattatcataattctcaaattcacagaaacgataagttcttgctctttcctgaccaaaaaaaaaaattaattgcattgggtagacttctctaataaaacctttaaggagacccatccaggaaatcagattttataagattcattcaaacagttgtagaaattctaagttcaaaaaccaaaagcagactcttttctttttccttccttggcttctctgttggatatttttggagtgagccttaactgagttactcatttccacatgctttaggaaaagtatgctcatgttttacaggctaagcctggttctgcttttgagctgcagttcattatgaatccggaaaacacaggtttttgaaatgcggcccatttgtacatatagcattagtcatctcagctggtagttctatacgatgagttatctcaccacttaaaaataagtacgctgctattttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcctgaaagttaaatctttgtactcttaccttgtttatggccagatttgcctgatccctgatttccctcccaactggatcagaggttgtggaattggaatttcaccatacaaacctttacttaaaggaggtagtactagagtaaccatttatgggaacagtttgctactaatagttactagtactgagtttattttagttcctttttcatgattttattccattggaaaagttttctctcagggatcttttctactttggacatgatctctgttaggcagaatcaaaagatagctgtgtggctttctgaatttagtctcamaatatttggtttagttgataaatcccatccatcagctttgcaaataattttgtgaaaacattgattcagcttgtcctgcccarttttcccatccctgcccagtttactgagtgccttttccatttgcatccactgtccattaggccaaggcgtttgaagtgtttctgtacagcaggtacatttaagactctccaggaagaaagggggaagaatattccaaactgaaaacatcaaagagagagatggggtatttccagtaacttatatgcccagtgcttaatatcttaaaaaccctactcatgtgcatcagctcttacttttttctaactaaaaccagaaaaaagttctctcttcctctgttctcagtatccccctcatgtaagtctgtctacccaacacggtgcagccgatttatttatttttccctcagcatttttaggtggattgactgggatgctttattcaactcagggacgcaccacgaatatgttttttggggcaacccgtttggcatgttccccctcagctgtgaggacaaagactggtttgtcttcttgtgacctggcagaggaggcagaagtacctgctgagcttatgcagcatgtaccccaaccggtgccccacctcttcaagtggtgaatcagcctgatgatacactgatttttagaacacgctagggtggagacctggaagtctgtacactggtcggggagggagggatggtttgcatgtcaaaccatttcaacaatgcagcttacaggaaaaaaaaattaattgcaaaacactgtgatgccctttgccaccagatttttccattagcaccacactttatacagcttccaagtctgccccagggacaactgtttggcagtgtgaggggaaatggcagcatcacgtcataagtgcaatgattgttacctatgagcctatccgrtaagggatctgagtgggcccaagcatcacacacgtgctggagctgagtgttctctgaggaacatgctaggatgttacttgggtgctagaaaacagcagctggaattcacaacacctcaggacactgattgtaaatgaagaatcctgagactaaacatcttctagaaaggtaaagggggcttagggctgggggcttttcctctgggctcttatcctttggtatgttgtccctggatgctttgagatgagactttgcagatactgctgaatttcttttcttttctttttttttaatactgctgcatttcaattggggtgttgtttggggactactggaaggaatgttatgaaactccatagaaatacttcaattcagtgagttcattcattcagtggctcacttttaaatgaccatacagatgtatttggcagaatacatctttgccattttccttctttgtgtaatggaccagccccgaggctgcgagcattggtccttctttgcctttttctccctgctttgtggttttgtgtatgtaaggatggctggcaagattaaggatcattgagctttgtattttctgttatttttctgtctccccaaacattttcactttcacaaactttaatctctaactattattcccttatcttaactctgaacttttgttttggacttattttgtctgaaatcatggtctatttccgtttcttcagttcttgtgtctgtaaaaatcacagtaggccttaccggaggtccatgactacaggtactcagagaccagctgtatccaaagagttgtgtaagataggggcatctgctccctcccagtgctgttkcccagccccaccctgccctgttccccagttagtgtctttgctttcttgacctggatatctttcccatatctattaatataagcccttcttatccttcaagtcttgctgcctctcttacctctcccaacaggcattctcagatactcccaatgggagttcctctcttcctcttctttattccttttattctgttattattctattattatttctattaaataattgccatcagttgcttttaattaagagttacggttgtgtgcgtcactaatcttataaacttgagtgttttaagaggcaagaatcatgtcatcttcttcgtatgcccaacaatgccttgcttagtagtccttgtagagtcaacagattcaatgttcaaccagcaaatatttgcagagcacctactttgtgctggcatgatgctgggcatataatacaggtcaaaaatcaggcccagcacctgcctaagaatttgtgggcctgagccctgccagttgccaatctgatgtgctatattctttgcagttttcttccagccttttcccgtaagttcccagttggtcgctctgtgaattcatgtgtgacacttcacctgggtgtgtttcctgggtgaacagatggcttttactgtgtcacacacacactcttgcgttctgcctcctctcgtgaaagttgtagttatctgctttctctccctcacttgctctaaggcaggcttaagatggtgttgttgctgggtgtggtggctcatgcttgtaatcccaacactttgggaggccaaggcaggcagatcagttgaagtcaggagtttgagatctgcctggccaacggggtgaaaccccgtctctactaaaaatacaaaaattagctgggcgtcgcagcgggcacctgtaatcccaactacttgggaggctgaggcaggagaatagcttgaacccgagaggtggaggtcgcagtgagccgagatctgcacttcagcctgagcgacagagcgagactctgtctcaaaaaaaaaaaaaaagagtgagaaagaaagatggtattgtctgttaagtgccttgggttccagagagaggtgaccaggtatgttgtggctgtcttaaggggaagattattgtcaggggccatttggaaagttcttcctggctgccatggcctttcattgctttttgtggcatgttagcagcacaaccagatagggaggaggtggtactccagttggttccttttgtctcaggcttattctctggtgcagcttggtgggctggttgcaaccgtaggtaagaacctgagctggtagcccctgggggtatggctggctggcctgctttccttctttcccactgttttcttgggaaggtctctacagacctcacctcttttaggtgtgaggagataaatagtscttattatcccttatttacagccttcatagagtctttgtagtaatctaagttaaggtcttaatgttcttatttagttctgtgtccccccaattcatttggtattggcttttcttaatgctgatttcaaatcttggatgaaaatatattatgagaccatctcttctttagatgtgacaaaggtaataaccatggggcaatccagactgtgaagaaagcctaaggtgtagaaagcccwtgcgacactagttttaagccttcacatgtgtttggggaaatgcgtttgttgaataaaggataagaagacagaagactttttatttttcttgtcttttaaggtaggaccatcagatagcatcgtcttcctaaagtcactctcctgacaagaatcagacccctctgccggggcacaccctcctcatgtggaaggcagggtggcctctccttggaaaatctcccctcatgttaagtcttctgagcggatcctgctaatccaggcatgtaaaggaggagtcctcatccaagacccaacatggtgcacacctcacaggaggaggaatggaaaagcaggcrcctttgctggactttccttttaatcccctaaatcctgtcacaccctaagactatgaaagagatgggtggagaagagccttggtgctgtggaaagggccatacccactttctccctcattgcagctcacagtgtaggtctcacacccatcccaagcacctaaggggaggggttggttaaagcagcacaatacagtatttgaactcttcaggggtttggggaagtccaatataacagaaataacccaggccctcagcgtggggtagcagagcatcctcctttcactctgtctctttctaaggcaaatactcataggtagagtttttgcaaggtaagcttacctgagccagaaagggtgggaggaatgtgagattgttttgattgttgtccttgggttttgttgttgctgttgttattgttgtttataagaactacaagaggctgggcacggtggctcatgcctgtaatcccagcactttgggaggctgaggtgggtggatcacctgaggtcaggagtttgagaccaggctggccaacatggtgaaaccccatctcttctaaaaatacaaaaaaaaaaaaaaaaaaaaaaaaaactagctgggtgtgttggcaggcccctgtaatcccagctatttaggagactgaggcaggagaattggttgaacccgggagggagaggttgcagtgagccgagatcccgccattgtactccagcctgggtgacggagcgagactctgtctcaaaaaaaagaaaaaaaaaaaaaaggctacaagagagaatgtccctagtttatggcttttcagtaccaaaatagtatgcattcagcagtagagtaagcagtagcagtagaatagcagcatgcttatgcatgacataagcttcatctgtaaaaggccgaagtaatcataccttgctgtagggttgttgtgaggattaaatgagttcgtgtatgtataaggcacctgcagcagtggagtccagaagaattgtgcacagtgggtggtggggaaagatgggggcagggaacattgggggaggaaagtaaattcaatggatgtcaggaaataggcatcttgacctgtccacagtgtaattcaggccaccactcactacttaatttaactttgttcttatctctagactaatggagcaggctctctgggggaaaagtgttgctgcagtaatcctgttaagtgtaagaactgaaggttcaggttgaagtctcaaagttccaaagccaccatcccagggataaagactgtgctggtatackctcagccagcctggtaccacagaaggcttttgtctccagcaggttccttttctcactgggcgtcaccttttctggctactctccgcctgtcagaggccaagccttgagtatatcttcatcttcccacatcttacttggcttctttctttgtatgtatattgaaagagtaaaggcagataggtgtgtgtttctctcttcagtgggaacctttgtgactgatggtttccaggcagaagaggttcaaatttttaattgtttcccttcccaacccttgtcatcgtctgataaaggactaggcatttatttgcatacaatgactttttctggtggacctcaccttcacagaagcacagaggcaaacacccatagggtcagatacaagctactttagcaaaatgattgactttgactgctttatgtaatctaaactcttaccagaacacaatatttatgaatgtagcagatttttttttttgcaggatcaagaaacactacattcagtactttattcgtttaacttttaagaacaagtcttttgatagttttaaaattgtatgtgtgtgtgtgtatatatatatatatttatttattattattttttttaatagagacaaggtctcactattttgcttaggctggtctcaaactcctgagctcaagtgatcctcctgccttggcctcccaaagtgctaggattgcgggcatgagccactgcacccagccgatattaaatcttagtttggaatataataatgtaactaaataataccagaatttttttcttttttttttttttttttgagaccagagtctcactctgtcacccaggctggagtacagtagcatgatcatagctcactgcagcctcaacctcccaggctcaagtaatcctcccagtctcagctcccgagaaactgagactacaggggcaagccagcacacctagctaatttttttttttttttttggtagagacagagtgtcactgtgtcatccaggctggtctcaaactcctgggctcaagtaatcctccttcctcagcttgccaaagaattgggattacacgcatgagccaccatgcccgccaaaaagggttcttttaaatgccttcttcacctttgtctaagtacattgggtaaatgtggcactagttgaacaagatttactgaattttatcacagggcaggcaggcaaagccagttctaaacaataaaacagagatcaacaaagatgacggatgactctaaatagcctgctttgtaaaattcaaaacaggggacagctgtgtagagagaggcacagttttataagaattcactggacctgcctagtttggctcatcttggtgcctgcacatgccctgccttattccatttactttccttctgtctcatctcctactggtgaccacagttactgatgggagaccttaaaggtgattatctttgagacacatactttcctgtgtgaagacacaaagattaaactctataagaccatggcacttatttgggcttggtttataccaaataaaccaacagattaaaaaataacaaactaaaaacaaagtttcaagtgccaggtattttgaaatagcagatccaaataatttcatattactttacacaacaagacctccattagtaagagatttgggttagattttttcttcctttttttttttttttactttaaactttattgagctgttttacataccatagaattcacccattttaagtgtatggtttgataagttttagtatatgtggacagttgtatatccacaatccagttttagawcatacccataacactaaaaattctcttgaggtttatgttatcatttacttttgacagaaatgttttcttctgcttttgaaaaaaaaaaaattctgggccatgtgtggtggttcatgcctgtaatcccagcactttgggaagccaaagctggaggacttcttgagctcaggcattcgagcccaacctgggcaacatagtaagaccccatcgctacaagaaaaatacagaaattagctgagcatggtgtcgtgctactctggaggctgaggtgggaggatcacatgagcccaggaggttgaggctacagtgagctgtgattgcaccgctgtactccagcctaagtgacagagtgatacactatctcaaaaaagaacttttttttttttkaggtaatgaatttaaatcattaggggaacataccattcttactaactttttgaaacaaaaacaaaggttgctcgaagatgttatgaataaaatgtttaagagtatgagggtacagagcaagggaaggaggcttgggcctatggtttacgaatggtgattgtttttagccttctaattatatgttgcattaaataagaagaaaccaaaaaggaaccacttgcctccattccagcctcggttcagcataaaactcaatcatttccttcacaagccagctgctgtgctatagctcaaattgtaacagagagcctttctctgcagtggagggttagggaaagagggagtaagtcagcacaaacaatgaggaaacatttgctgcctttctgatttcttcctagaattaacaggcttacagctgcatttctaggtcagcatttcatatgcctgaagagtatgaggatagtttgaaaaatcagaaggaagatgagagagggctttgcctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagctcctgggctctttgcctgctaatgtgtggagtccctttaatgctgagggaagtttgcctgagacctggcttcctgctcgctgaaaatcacagttattttgtttctgggtgggtaagtaagaatgcccacaaaagaaagagaggaggagagcatgatgtttgggtgggggttggtgaaatataaactcgagctctgtgtgttgtgaaaaagatttgcttttacttcaagctagaaagaataacccagtacttgatttttggtccagtgaaaatttcagctttacctatggctttaacataaagatgtcattgttgcaggagtgaatggttgtacatatatatatgctaagatttgagtttttgagtttaaggtttagttcaattcaataatttccttttttgttgctaaatccatctttgggtatttgttttcagctctgtttttccaatagggagttgctcaatattcattaaagctggcttcttgtataaacactataaaacaaaataaggacagggattcatacaaatactagctttccactaccaccccacctccccctggccaaaaaactgtaatgttttgttagaaaagcctgttttatccctaagttagccagtgctccttttctgcttttcacagaattactctctgaactggcacatttcttttttacgcttagaacagcatgttacttttgaagaaagtttggaaaataacagtccaagctcattctcttctgtgcatgcatgattgatttgggctgtatttcagcaayaacttttaaaatgagacagtggacattagagagcagcatagttggggttgcacttagragcccatggcattttggctgttttgagacagatttggggtaaagagttgctgcatcttgtagttggcactgaacactggagaagagggccactgtataaaccgcaaggcccctgttaccatcacatgcctccctagcacaatgtgccctttattaagacaggccgttccactactgagaatagtaaccctttccgctgtcttcccctcactcttacgtgcagcctggcttctggcctcttaacccatgcccagagtagaattggcaatacccaggagggacactgcactggggattgttaggtcatgccagttasgatgcagctggaaaggtgctgctgagtgggacgtgcagaggggaagactgcaggctctgtctgcctgagctcatctggtctgacacctgccgtgattcatttttcttcatgccatgttaagaaattttgtatcaagtctagtcgacagttactcatagcctggaagcaactttggaaatcagagttccactgacccccctcattttaagggtatgaatcacatcactgcattgtatgattccagggctctcttgcccatggctcgtscatgaactaggaagtgatcatagttcctgttcttgttttatgaaaacaawagtataccttcccccaacctaggcaggccattcaggacgactaccctggaggtgctctgggtggcttaaagcaccgtctttgcacagtgtgttagagagcactgtgccctgaggacttcgggagagctgcagaatgagtgttcagaatartcggcactcacctttgncctcatgttgtgagatggagatattttaacctggccataatatgctttaaaagttggggggtgtttgtctgcttttgcttttatttccttcctgtgctggactgggactcccccttatctaactggtacataccactctgcccaagcagtgcgtgtgcacacttgaacacatcccctacagctccctgctggcatctccttcatacactcttaagaagaagaaaccaatgtagaactcaagattttagcagacttacttggtcttgaacaagtatcacaaataccttaaaccctgacttcrtgggggkgggggcaaggtatagaggaggaagggttctggatcctctctggggggccagggttgtgttcttctccagacaacagagggtgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctsttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctcaaaaaaaaaaaaaaaactgcttgacttctgcctcccctagacacttagagtctggtagagaaacacaggcatgtgcttgctaactgtaacacagttccgcgtatataggcaaagtgacttaggaaacaagagggaagaaggggaccagttattcccaggacagagcagttgagggtaagtagggctttacaaaaatgaggtatctgggttgggccctttaggacaatgcagctgattttgacagatgggagagtgtggggaagggtgtgctgggtagaggggatagaatgagcaaagatagataagcttgaaaatttctcagtacgttgaggtttggggtggggaggaacctggraggtgctggattggggctaaattgttgacatttcgtgccacagaraagagcttttaggctttcttctttaaagtggagctcctggcacatcactttgcaaggatagtgattgagaagttgtagacgtttccaggaatacctgaaacaaatgtaaaatttctcaaataatatgtaatacaggaaagcaaagccatctgcccctgaaaacaggctgcatatttgcagtatgagtaacagcagagtctgggctgtgctccctagtggcaggctgactgcactcgtgcaccctaaggacattgatgcacagatgaagaaaggaaagacagaaataaaatttatttttaaataattttaatcgtacataaaaagagctctcatgtcttcctcacccagactcagatttcccagtggttaacattttaccgtatttgttccatctgtgtgtgtgtgtgtgtctgtgtgtagaaatgcagttgtcatgtctttttggcctccttccatctgaaaagttctcgtttttacctttttttcatggccatgatggttttaaaaagagaggcctgacattctgtagaatgtgtttcaggcagggtccaggccaygccttcttggcaggacagtgcaaaagtgatgctctgctcttccccatgcagatacatgatgtcaactttgatcacctggtcgaggtggttatttgtcagctttctcatcatagagtcaccatttttttttatgattgacatttcatgccacagaaaagagcttttaggctttattctttaaaatggagctcctggcacatgactttgcaaggatagtaattgagaagttgtagacgtttccaggaatattttctggtgagatattctgagaccacatcagtatcttagtctttagtaggaaatctctacccactagccttagctagtgattcctacctgaatccgccactgttctaataattggtccatggtgattttctgttgacataattccttgtatatattagttggtattcctacatatttattatagcatgatggactcacaagtagatacctattctctggattgtaacttgttactatcattaatcatattattttcatgctcaaattatcctagatttggctagtgggggttcaaaagagtttgaatcaaatatacccttgacactggcattaaatagccaatctgatgtgtgctgacgattgagactaataactggtaggcggagggtgttatctgagttctagatatgtatttatctcagacagtatgggttacctgcaacaagatctgtggtaggcaggccaacagtaacactcgggaccctagaggcaagccaacctgaaattcagcttgtcagagaccatctggtgggtggaagttttgcgttttcagagtatattgtttaagttccccaggcctatcgtctacctttagctttccctgttggccaattcaggccctggtcagatgcgggtggakaggtacacaaagctggaaacagcgtgctgcccgcctttctctcctgcctccagagacacttgttggctgtcagggtcggtgttgtcttagcctcacaggcattttcagtccttgctcttcccatcctagagtttcaaacacagagcgagtctgtgttctgcatctcaacatgctaaatcagaacctggattccctaaaatgttgtctcctgtttcttcctgccctcactcatgccatatccgtccttcccaggttagatttctcatacttcagtgaccttcagaaaaggaatcccatcacttttctctgcggtgagtcatccattggtttaaagaaaaaattttcttttttaatagcagaatgaggtaacagagccctagaagacaagcccagagaccggatcctggtctccagctcagcccagagtagctggaatttgtcagaccttctcagtttcctccgaagtattaggggcagacagagtcaaggctacaggctggctagcccagatgcagacagtgtcaaagttctcattgtggaataccaccagaacttatcttactattaccacttaccatctaattgggtaggtaaaattcatatggtgcaaaggagtttgttatacctagacaaaaattcatggggacttgaataatccatggaaaccctaatggagaatgctgaggagaattttaatctccagcatctagccagagcaatcttattaaaatgcaaatctgatcatttcactcccttgtttaaaacccttcaatagcttaccaatgcatctatgatgcaaaaacttgatccccagggtcctgtggaattagggctctgtctgtcccctttctgcctcactgcagtctttgcaaagtcctcttcccagttcttaaaagtggcaggttttgcatatgctctttcctgtgcctagaatttctgccatccctccacacatccccaccacactgcccggtggactccttagctaccgctcccttgaagaaccctccctacccgtagcctaggcagcgtccctgctgtgttccaacataacgcctgcattttgctttcacaacacttaatacagttgttatttatgtgatcacttgtctgtctcctcctatacttcgtaagttctacccagacaggctctgtgtctgttttgcttagcacctagccgtgtttggcctattgcaggcacttaataaatatttgctgaatgaaagaatacatccatctttcagtgtaacaactgcatcttccttacatcagcaggaacaggtagatgtggaagatggagctggtatggagaagggtagtgatgggagacagtggaagatgtaggagtagtgtgcaggttaatgtctgttaaaaaagtccagataagattatctgtgagaggaaatccaaagatttgtggggagaagccaaaaggagttaggaagggttaggagtacacgaagcaagaccacattctaacttaatcatataaacaaaccaagcctgtaaaattgcagttatgctacatatgtgtcaactgacctgatatttcttaggaacttctggcatatacttttgctttctttaatgttacaattttatttgcatgaagtgtttaggtagctttttaaaacagctatactagcctgggcaacatagtgggacccccatctctataaaaaatttaaaaattagccgggtttggtcacacacatctgtagtcctagctactagagaggctgaggcaggaggatcgcttgagctggggagttcaaggctgcagtgagctgtgatcgtgccgctacactccagcctgagtgacagagcaagaccctgtctctaaaagaatgaatgaatacatacttacctacctacctacgtataacctgaagaggtattggtgaattgcagtaggcagtataaactctgtgaggagaagcatttcaggcttcttagaaaaagcctagcacgtggcaggtgcccatcatttgaatgcctgaatgaacgggttttatctgggagggaaaagagcaggcttaaaaacaactctttggtaaatgcaagagcaaaagaaaatctcatctgttatacatttcctttaaaccagaaggaggaacactcatattgctaccctttttattgtgtgttctctaacaaatggtgttcctcacacaaatttgatacaggtagcgaagctgctgggtctcaaagagcttagtgctaacagtgtcatcaggagataccacctgctaaacccgttcagaaggacgctgttgtacttcgctgtcttcttagaacactttccactcctggaaaagttgatgtgctaacttaattactctcatactctgagtaattagcttcatgagaacttgcctctcttcctgagttcatcctactggtttgctttcctgctgacgtgggatctttttgactgctttgaacagcaggatgcttacactctggggcttttaaatgtggaaatctgtgataattatgtacttctctaggactgactcagctcttcaagcaaaatcttcatgcttcatgtgagaggggacaataacattaatgggaattagcaaagttcttcagtttcaacagtcaggtgtggtatctggcgaagaaaaacacataaatagtgtgtgaaagttgtggcacaggggtgtaattatttttcacagcaccgtcagtcagtaactgggcctagagtgtgcagcagtgaaatcagaacaaagaagtcagtgtgtcctaattaatagataaagtaataatatcaaagtctcctccgttttaaagtccacaggacacattatttcaccccagtgctttttgctcatattaaagaatggctcattgtggtagagtatgtagaaagtattgaatgcttttctttactcaaaagtggcattttttatcacttgagcacttgagcgtagtgttattggccccaataggaaatgaaagacttgaagactacagatttttttttgaaatggagtttcactcttgcccaggctggagtgcaatgtcatgatcttggctcaccacaacctctgcctcacaggttcaagcaattttcctgcctcagcctcgcaagtacctgggattacaggcatgcaccaccatgctgggctaattttgtatttttagtagaggtggggtttctccatgttggtctcgaactccccacctcaggtgatccagccgccttggcctcccaaagtgctgggattacaggcatgagcctccgcgcccaatggaagaatacagattatatggccaaaatttcagttgctatctgtgaatttttattcttctcgctgtccccagcacaggctttctcagcctcagcgctactgacattatgagctagataattctttgttgggggaaggagggcctgtcttgtgcatggcaaaatgtgtgcagcagctctggcctctacacactagattcgggtagcaccccaagcagcgacaacaataaatatcttcaggcattgccaaatgtcccttcgcgggggcaaaatcacctccatgcctcgtttggttggtttaaaagaaaaattacctccagttgagaatcactgcaagcaggttagtactcgactagtttcctgcgatctaatcttcttcctggtgagtacgttaatttttatgtctttcaaaaccatgtattatttggacagcaagtttagtttcattaaaagttaaaatcatatagtactttatgaatctagatgaaatgatttttgaaatatccataactccatttcactttgttaatgcagaagaattgcaagcaaatttctcactgttcttgaggcagtaaattgggcccctctcacagagcactaagttttataggagatgaatatataaataaggagcagacttgccatcagtttgttgatttcaccttttctctgaacacagaggaatttggtctgaacttggagagttttctttaatcgatgccgttgcattggtgtttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatgtagctgtttgcttcacttctgcctttaattacttttctatgcaccccatccccactagactgtgagccttgtgagarcagagactttgtccattttgttcggtgcccccagctccgagaacagtgcatggtaaatagtaagtgaagatccatagaaaactagagagatagagaaagagagacagagacagaaagcagaaattaattcatgtgcctttattatcaatatcaattataaatgtaagtcgaatgtgtgaataaatgttttattcggtctgcacttcccactgggtattataacattttaactggtcctattgaatgtagcctctttccctacgtcagtctcacgcacgcacaattgtcaagacgatctttgttgatgccttttagcccctagtttcagtggaaaaacttgccctgctccaggatgtgagattggtggcctctcctgtactcatcttcttccccttgtctaaccttggcattccttcagcagcaccaacaggttctgtcctggctcttcacctttttactctggtcatttaccttgtcttcagaactcatctctcgttaactcggttctgttttgatcactagtttacatactttcatactgcattgtgttttggttttttggagtgggggcggggttgttgttttttggggttttttcagacggagtctctctctgttgcccaggctggaatgcggtggtgcaatctcggttcactgtagcctccgcctcccaggttcaagcgattctcctgcctcagcctcccaagtagctgggtttacaggcatgtgccaccacacccagctaatttttgtattttcagtagagacagggtttcaccatgttggccaggctggtctcgaactcctgatctcaagtgaactgcccaccctggcctcccaaagtgctgggattacaggcatgagtctccactcatggcctgcattgttgatatatgcctttgtcactgatctcaattagtgttaagggtgtttggtagtcatctctcagctagactatatctsattttatttcttaaaaatttttcctcttactccttccactgaataggaccattttctgtagccaattaagctttcaataaatgtttatataatgaaagtagaggtggtgccaggagcagtctccaccactggatttccagacattcaaaaaatttttgtaaacaccagggacagccctccaattccagaatatttagttggaagctattactctcaggatttcagttgcagatatagccagtggaattttgactgtgcaaaagcaggcatagttctgttagtccaaaaaggcttagttaagagtctctttataacccaggtagatttttttttttaaactgctcttttttttttgagacggagtcttgctctgtcacccaggctggaatgcagtggcgtgatcttgacacactgcaacctccacctctctggttcaagcaattcccctgcctcagcctcctgaatagctgggattacaggtgcacaccaccatgcccagctaaattttttgcatttttagtagagacctggtttcaccatgttggacagactggtcttgaactcctgacctcaggcaatctgcccacctcggcctcccaaagtgctgggattacaggcgtgagccactgtgcccggccaaaactgttgtttttatacttcctcttgatcctgaattaataatttaagttttattgtaacgcttttccagttaataatttagcgtctttctcctttttaagatctagtcttaatttttgagagggaaagggggaagaactgtagtacctgttagaattcagtgtaactccaagtaaacaagacccaaaacaaacgatagctaaaacaaaatagacctttatatctttttcacttaaaagtatagaggtaggctttttagaaatgttatagtagctctgatccacaaagtcctttgaggcccaagttccttctagtacatcgttcctccacccctagatatgaactcatgwttcaaagttacactagtgttctagtcatcacatctgcattccaggcagcaggatggaggaaggcacaaagaagaacataggtgaaaggattatttctgtgtttcttaatggaggttcctggggtatactacatgacacttctgcttacagacttttatttgcccctattagtgtggaaggaggggataatgcatactaaagaacatcaagctgtctttgccatggccacccctattcattcacctcccaagtgaactttctcattttattgcagtcaattccatttgccttccaaacagagacttcttgtaatatattttaagacaaatgcccaggccaggtatagtggcttacacctgtaattccagcatgttgagaggctgaggtgggaggattgcttgaggccaggagttcaagaccagcctgagcaaaatagcaagaactcatctctattaaaaataattttaaaaaattaaaattagccaggcgtggtgctacatacctatagttcccagctactcaggaagctgaggcgggaggatcacttgagcccaggagatagagactatagtgagccatgatcgcaccacctcactccagcctgggcaacagagtcggaccctgtctcaaaaaaaaaaaaaaaaaaaaaaaagagcaatacccacgtgttgtaaaaattataaaatataaagaataaaaatcatctataattccacaacctaaagataacaactgaaacaatatcatggaagaaatgtccttaacactaatatttaacgaacaacttctgtcttcagagcatcaagatgtttttcaaagtttattatcttattctgttggccaggcacagtggctcacagctgtaatcccagcactttgggaggccgaggcaggcagattacctgaggtcaggagtttgagaccagcctggccaacatagtgaaaccccatctctactaaaaatacaaaaagtagctgggcgtggtggcacacgcctgtaatcccagctcctcgggaggacgaggcaggagaatcccttgaaccagggaggtggaggttgcagtgagccaagatggcgccactgcactctagcaagtttattatgttatactatatattcagttatttattccttcagtaaacgttgtcagacatctcctttcttcccagcatgttgataattggtgtgtggttgggagaggaagcaatgaaaaaaaaaatgtatattttttttgggggggtgggggcggagatgaagttttgctcttgttgcccaggctggagtgcaatgtgtgtgatcttggctcactgcaaccttcacctcccaggttcaagcgattctcctgcctcagcctcccaagtagctgggattacaggtgcccgccactatgcttgggtaattttttatatttttagtggagatggggtttcaccatgttggccaggttggtctcgagctcctgaccttcaagtgatccaccctcctcggtctcccaaagtgctgggattacaggcatgagccagcgtgctctccaaaaaaaattttttttaattaagttttttgctctctgggtgcttatagtctggtacaaaagacaaaaaagtgttttsgtcttgttaaagttgggaaataaatcagggactcataagtgcctaatttatgttgatgtatgtaaacatacactagaaaacaggatattaaaaaaataatgacaccgggtagttttattgtagaataatttttaccatggacaattgtttgtgaaaatgacaccttgaaaacacatcttacttttttacttgctggagaatgaaacttgaattacaagtcctttgggtagcctggtttgagcagtattaggaaataagcaagcctaacttagttaaattctaacctcttctgattcccagaagtccaaagttcatttgggggtaatacaacgtgatacatgctttttgtgatttctacaaggtgaactaaagaaataactaaagatggaccagttaggttttggtaaaaactgtgataagttttgttgtgttttaaatactgatgttgagtcagttcatctttcctactgaaaatccttaagtgggaaaagtatagaaaaagtaggagttacaccaaaatattaacgcttgccacttgatggtaggatctgagtgccctttttttacgttctttaaattatctgtatgtggctttttttttttttaatgttttacaagcatgtactactttcgtatctggaaaaaggtttgtttttctttcattttttaagaagaacttttcatcagtggcaaaggctcagttgaaattaatgataaaggataactacttgccacgtgtcataagcccagggctgagaagagtcaggcagtgctctggaaccagtgagtgctgcccggatcctgagaacccgcagagaacagtggggctgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgctggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggartttcagacagtmctggagacaggtctggctgctgcagcttctctcctgttaatggartttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcascttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaractcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtctttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacwagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaaaaaaaaaaaaaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatrttctcagtggagaccaggacaaggaacagaaagacccttactttgtggagaccccctatggttatcaactagacttagatttcctcaaatatgtggwtgacatacagaagggaaataccatcaaaagactgaacatccagaagaggcrgaagcygtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcascagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttsagatgmgaaattgtggggtcagcgtgacagaggccatgcttggagtgatgactgaagctgacaaagaaattgagctscaacagcagaccatagaakccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaatgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaayacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggrtcactacattgagcgtatccagaagctgctggcagaacagcagacactgctggctgagaactacagtgaactggcagaagctttcggggaacctcactcacagatggsctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattcttwgtctttcagttatttacttgctcattatttatagaactgcctttaaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagrccagcctgggcaacwtagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttttgagacagagtcgctctgtcacccaggctggagggtggtggtgccatctcggctcactgcaacctctgcctctcaggtacaagcgattcttgtgtctcaatctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtratacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtctgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtattatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagamgatggtccttcatgaataatctctactgcctgttccccaaaccatcatttgggcttaaagagtgaattcatgctcgagccctttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacasgccaccasgcccggctaaatttttttttattattatttttagtagagacggggtttaaccttgttggccaggctggtctcgatcttctaacctcatgatccacccgcctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatattttttnaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggccgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggarcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccawtggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggcyatatggcaaatacttactcttgctgcactttatgcaaataattagcccaagcataataagactaaaacttattttggaaataaattggtccyactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacatggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcargattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctckattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcytcagtagaatccycatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacartgatggggaaaaaagacatctctgtggaatggttggmatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatytaccaaattccatccgacttacacttaaaatcagtgcattttcgtggggcatgrycacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcraacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaaagaagccaggcgtggttttgtacgtctgtggtcccagctacttggggggctgaggygggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttctcttagggacatatactgaaatatttatggatgaaaatgattgaatctctagctgttgcttcaaaataatctagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttygtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaamaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtkaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggayargggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcrgtctctactaaaaatacaaaaattagccaggcatggttgtgcacacctgtagccccagctacttgggagkctgaggcaggagaatcgcttgaacccgggaggcggaggttgcagtgaactgagatcaygccacagccctcactccagcctgggtgacagagcaagactctgtctcaaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggtkgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctacttgggaggctgaggcaggagaatcgcttaaaccgggaaggcgcaggttgcagtgagccaagatcgcaccrctgcactgtascctagcaacagagtaagactctgtctcgaaagaagaaaacttgaacggagacaaaaattaaaaataaggccaggcrtggtggctcatgcctataatcccaacgctttgggaggtcaaggcgggcagatttcctgaggtcacaagttcaagaccagcctggccaacatggtaaaacccygtctctactaacaatacaaaaattagccaggcatggtggcaggtgcccataatcccagctactcgggaggctgaggcacaagaatctcttgaaccaagaaggcagaggttgcggtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgkgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggargtgtcaaacatgcctcattataccctcctccctttggaattcaggcacaactgaccagcattaacattaaaacagagatcttaggagtgacaaacagactctttatascaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaycccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgaaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgartggcaagaattgtttttgttgaagcctgctttttcagtcctagcatcacacactctgtacctttctttttcctgataggcarttatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaatygacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacrtttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgmtaagccggagatgccattattttctttaacaagtgttacatgataccaattggttatatgataccgataaccagtttaagttagagtccattcaaaacyaccaggcatttaaatagaccttactttgaacttctaagtgcaggatctaaaaccactagtgaaatttctggagtcaattagcaaaycccttcatagaaatttctatcactgggtcttcgtgagcacaccttgcatctcctgaaatcccaattgccacctaggtatgmaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaataytgaaggtttgaagtctgccagggtggaagatgaaatgcaggttcaagaatgtgaacctgagaaggtggaaatcagagagaggtgtggtacatyccccttccctcccttgcccctcccacatttaatgtactttggcaatagagttggccagttcagagcttttgtaawtaaatgtttgcttttatctgttcctsagaggtatacacatcttgagatactaatatatacaagtgcagagtattrcaactcttagatctcttatggtagaatggcctggtacctaatcacccttgttttctgaaaccttaactctgctatataatttaacatatggaaccacaatccactaaaacttscattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcgcatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagacgattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaacacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcsagaccagcctgggcaacatggtgaaaccctgtctctacaaatacaaagccgggtgyggtggcacacacgtgtaatcccagttacttgggaagctgaggtaggaagattgcttgagcctgggacagcaaaactacagtgagccgtgattgcaccactgcactccagcctggrcaacagagtgagaccttgtctcaaaaaaaaaaaaaaaaaaaaaaaacttaaaaatggcaaaaaaaaatctctaaatgttattccagaatgtcataaaggccaattggtgaagccgaatgtcaccctcgcaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcracagagcatgaccctgtctcaaaaaaaaaattakatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaasaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcrtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcgtaggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcrtccaccacarcgcccggctaatttttttgtatttttagtagagaccgggtttcaccrtgttagtcaggatggtctcgatctcctgacctcgtggtccgcccatcttggcctcccaaagtgctgggatttacaggcatgacccacygcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatacatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaattaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacgggcttcccttttattttccctttccgtggttgaacagttgtatttgggattggggtgggaattgggttggctatacacgtacrgtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcaraaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaayggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctyttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcagtcctgacaggaacagcttagtatacccttagaagttgataaaacatcttggcaaattaaataattttaattccactgctggatggtttgggttaatcacttatcttaatggttactgctcccccttctaggctgagattctggctccataaggtgtagatctaggatgcttcagcatctatgcagagcaaagtccgcaaagtccgaggtgctaaggagccccgaagcgcacacgaattcacctgcttctccgccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcrtttattctcaagagcaaccagtagaacaaccaccctgacttccaagccattgcatttcagccaccagttgcaaacaagatacgctgtggaagcttaccgttgtttctcttgcttcaggtctcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttyggctgtggggatgtgaatgccaaagctagtcaggttagtgcgcctggttcctgtgctcaggaatgcacccctaaccagcagacaggactgcggtggccactctggcagagcaggcatagatgccacgcttccaccacagggcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgggcatccccatcagatgctcagtgctgttgcttcctgtctctgtgttgtactgtcttcatagcaaacagtgtcccaggtccaaatgtgttcacagcttgactttttttttttttaagagacggtcttgctctgtcccccaggctggagtgcagtggcgtgatcttggctcactgcaaccacccccggctccctggttggagtgattctcctgccttagcctcccgagtagcagggactaacaggcacacaccaccacacctggctttttttttttttttttgagactaagtctcattctgtcacccaggctggagtgcagtggtgcgatctgggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccgcctgactcagcctcctgaagtgctgggattacaggcatgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccycactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacgggcacgtggagattgtcaagctgctgctggcccagcccggctgcarcggtcacctagaggacaacgtaagctgtctccattgggcctcctggccaggggtctgggggactctggacgggagctctgggagtgccttttggccaggagcsaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaagtcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacarcatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttctgcgtgtctctaggccaaaggacaggagtggtgataggtagaaggtaggaactggtatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacacggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagwtggatctgtgcaacccactgggattgcgtgcttacacacagatgttacttgtagccttaaaccgaggtggtttagggttttaggatcacagtgccctctctragaggaaaggtaaaagatctttggcaaattgcagagtctctaaacacacactactgctgcttgcctggtcattcataattaattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgtttygttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggytgaaatccaccagactggtggacccccttcctccaggaattgacgggagacagattttatgttgattcagaaaatggaagttttagtctggagcttaagagttcatcctttccrcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgtwctcagccagagctctcctggctcgggctcacagctgcttgttgcctgtggtgggccaagatcctatgtcacagggtacacatctgcctgaggtcacttattaacccccagtttttttsctttcctggtctctagggcacccctaggcttggaaggaagacgtctcctggccccacccaccgaggttcatttgattgattgtatgcaaatagccctttatttacatgccactattaagctgctaattgttcytgttggggtgacagatactgaatgtatacgtattgtgcctgagctcaccagcaaacagaagcatcaagcccaggggtaaaggctgaagctttcacagtgcagagactgctagcctgggcacacgcacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttayggattcctttttaccgtgtcacatttactttggtcctctatgtatttaaatgtttgaagtgccttagactcttgccatattttcaaaataaaattccattaagctcttttccttgtccctgtttcatctctgatagctgtccgccccgagccgattgacttacggcagtggcagcacacgctgatggattgagctgagcagggagggtgagtgcgccagctggctccgacagggagacagcatcttccgagggcgcttgtccacttgcacagcttggctcctgactcagattgcaagtcgggaggctgaagtttgaggcctccttagacaaagcgctcttccgatgggtagccggagatgcttcttctcaggtgcagaagcactagtccttgactctgagtacaactgctgggtgactaggtgatacgtgtagtgacaagaaaggagagatgaagccggacactttttttttttttttttttttgagaatggagtctcactctgttgcccaggctggagtgcagtagcatgatcttggctcactgcaagctccacttcctgggttcacgccattctcctgcctcaacctcccaagtagctgggactacaggcgcccgccaccacgcccggctaattttttgtatttttagtagagacagggtttcatcgtgttggccagaatggtctcgatctcctgacctcatgatcagcccacctcggcctcctaaagtgctgagattaaaagcatgagccactgcatctggcctcaaattctttttaaatagtaaagtaagttgggaccatctcattaaatgaagcagcatggcagccagaattcaaaccaggtgttctggcacaatcgctggtggtgagttttggccaaggccatctatgagagccaagtgcactggagaaatatcagagacttctttccctccctccctcccccgcttttaaaaattaaacattattgagctcaggaaagaggccagagaatagacttttcccataggtgtttcattatgaggtctgtttcagagtcaagatttgaacctttcagaggaaaacaatttggggggctgtgagagccatgctggcagtgcaggcaaacctgggcagcaacagaccagctctcccaggaccacaaggatgactttcctctgcatgaactgtgaaagtgaggtcacagccacctggaggcacatccctctcgggacataacctaaacctactagctgatacatgctgaatttcagatcatgtagctcttcaagcccaagttcctacagatccaaaatggcacaataaaagcaggagagagagagagagagtgtgtgtgtgtgtgtagagagagagagagaggtagagccatgcgtggtctgccccttatgggcataacctaccttttgagcaaataaggtagtacctctggtggttcccgggcctgggaattttctttgttccatctgagaaaggaaaggcatgaatgtaaatgaatgagcaaatgaatccccctgtctgcatgctgcccttctgatttctcatgctagattttgaaatagaaaatgagtgcttgttttatcagatacaagatatgtatctgacctctaagtaatgaatgctagatggtaccttgtttgctctaatcacactaggcatttagaatgccttttatcttgggatcctggtatactatataaacaagcctgattatgcccattggtacagctgcagtttattgaggcacaaactccataaaagggatttgtgacaggaggcttgggcaaggttcccaagtaagaccagcatggggttggcaactcctgatcttattttccagcttaagagaagtctaggtgggtgtggtggctcacacccattatcttagcactttgggaggctcagtcaggcagatcacttgagtccaggagttcgagacaagcctgggcaatatagcaagatctcatctctacaaaagaaaaattagctgggcgtggtggcatgtactgtagtgccagctacttaggggttgagatgggagaatcaccttggcccaggaagttgaggctacagtaagccatgattgtgccactgcactccagcctgggtaatagagtgagaacctgtctcggaaaaaaaaaaaaaaaaaaaaaaaaaaggaaggtttaaatctttaagtgatgaaaagacagcttcccagaaaccttgccttggaagttgaaccacggacagttgggagccaccccaagacaacaggagtggaacagtgggacttttgagagtttaaccttaagaaagtaaaactaagccaggtgtggtggttcacacctgtaatctcagctactgggacaaaggctgaggtgggaggattgcttgaatccaggagtttgaggccagcctggccaatgtagtgagacccccatctctttaaaaaacaaacaaacaaaggaaaaaaaaactggcaacttgtcgtgacactattacgactaaactgacaactaaatgtctcaccaagggggaggaagggtgcttctggagacgtttactaggaacacttcatctagctctggtatccaaaataaatgaagctctgagcgctttccttgtaagttaatacttgggagaacaacattatccctgatttttgtactactgaagtactgccgatatctgacaatccttgcagatggaatcacataagaaaactatttctccttcaaaggaaataatgaccaaacataacctttctttaaattctgctagatcttttgtgggggaacttgctacaagtagaattacatttttatgattttgtataagccttcccttcacgagacacttaagaatttccagagggagcaggtagaaaatgcaaatttcagtcggacacggtggctcaggcccataatcccagcactttgggaggccgaggcaggcagatcacctgagctcaggaatttgagatcagcctgggcaacatggtgaaaccccacctctactaaaactacaaaaaactagccggacgtgatggtgcacgcctgtaatctcagctactcaggaggcggaggttgcagtgagtcaagatcacgccacggcactccagcctggccaacagaataagactctgttctcaaaaaacaaacaaacaaacaagcaaatttccagcctggtctgagaatccccatccttaacaagcatcccaggtgtttctgaacatagcctttggtccacactaagaagctgttgctcccaaagtatgagacatgatgcatctgttcttccccacacatgttaggcaaggtgggggaactacatcaaaacaaacattggctttaccttagctctctaaggagccgggcttccactggtgatcaggatcccacataggttttctgtggtgctgcacatccatgttcagtagcatttctgcatctcctggaatatagtcatttctagaagtccaggaaccatgactgccacagatccatttttctgtgcttgtaaggaccagagaaggtggctcagtatataggtgacagtggctgggcaggcagacagcccttagaatattttcccaagctaatcttttccatttccacttcctcgtggagttggactattactgctcagaaggaggccatgaaccattgctttggctttggaataaagaattttccattttcttttttttactaaaagcaccttttttttaaagccctaggccttagccagaaactgttctactttctgcataaggaaattactaatcatacgttttctctgctcttattcagcatggctgtaatttaaaagccagctgattataaaaatataaagtacattttgttgcagtttcttaccacaaaggatgtggctgaaccgtagaccacaacgttcctgagctgctcacgctcgaacccctccccactgaaggcaccagctactccctgcagggaccagacagtcatggcttttcaagcatgaaagatggcattatttggaacttgtaatgatatccttgagatacctatcctgaattctggcaaggatcttgcagtgaagctggaaaacaacatatcatttttgcaggtgcatgcttagacagaaatgtctgatttagaggatgttgggaaggagctggcattttaagaatccagctgcccactgcatctccattaagacctttgttgattaaataggtaagaggatggaaaacatatccctcattttcataaaatggaagctgcataacaaatattcctatttctaaaaccaaatgtcaatcttgtatttgagccaaaataacttttacacttgttccccattccccaacccagaaggaactagttacccagccctagaaaccgcctggaaggctaaggctgtacgactgagggcgagagaaaatccctgagctgcagacaggcaggtgctgctttgctgtcactggtgcaggcagctcgatgccttgttgaggctggttgtaggagagcaagtgccagctgggcaggccgcttctcatgtgtcgggcagcaaagagattcttgctatggtcccatctgctcttttaggaagtactggatgtgcttaaacaggtaataaggaaaatatttattaggtaaaatccctgagagttcagagagctcacccacccccaatcctgcctaaaatatgtcacccccacccccagaaaaatccagtcttccaacaggaagcttattaggatgaaatctcatgcttcggtttgtaacaccatctgccaggactgagaagttccggtgcctagctgagaaatactagttgaatgaatgagtgtaaaaaaataactgatggtgttagaagtcaggagtgttgccatgagggagctggaaggagcccaaatggggctggtgggctcctggtaatggtcaatttcttgcctggggggtagttgcactgttatgctcactttgtgaccattcatcaggctgtagacacacgtgtgtgctttcctgtatgtatattaacttcaattttttttaaagtttaagaaaatgaaaaagtttgatcaaaaaaaaccttgggaaggaaggtgcagatttgagagtcaatataatcaaagagatagtgaaagaaggtaaaaactggaaactcttagccctgctatttcttgaatgtgaccacatagttttgcatgatggccattgtggcccactcgtaaccttgaatagcagtcacgagggctgttctcagatactccagttctttttctgggcacaacaggatcggatgtactacccacacacttttgaagttacacttggccatgtgacttctccaatgaaacagaaaaggttatgtgtcagttccagatggaagcctcaaaagccagtgcagtttaccgtatcttgtactccccttgtcacagtgatgatcacggaagcaagtgttgacacagacatcccattagtgtcgaccctgagtgactacgtggaatagagtttccttgccaagctgtgttgcaggtgtattaggaacaagaaatagtcctttattatgctaagccagagaagctagggagtgacttgctggcacagcgtaacttagattttctttatccatacaaaaactggttcctcgaagtgaagtgctgctgtgtaaccaaatggcttagttgattggcggacagcaacaaaactgtcactggggacttaatcatagaacaatgacaactatttggatgactattttcttaataatccccagggatggtacataccagtaccatcctagttgcagagagagaatgtaacctattatctacagtggatgccttagggcactagggactacatatttttgtgaaaggaaagccatttcctgtgtacagtctgcctagattgtctcttagaaacgtgtagctctcaaactttggtgtgcatcggaatccccaggagggtttgtgaaaacacactgctgggcctcaacctcgactttccaattcggtaggtctggaaagaggctcaagaattggcatttctaacaagttcccaggtggtgctgatgcttctggtccagaaaccccactttgagaaatgctgctctagaggaagggctctgataagga

SEQ ID NO: 10886 - DNA, 23359 bp, Homo sapiens
tcaaacatatcataatttatagattttatttttgttgttaagacttcttttcttactgatactctgtttttgtttgttttgagatggagtctcgctctgtcacccaggctggagtgcagtggtgtgatctcagctcactgcaacctctgcctcctgggttcaggcgattctcctgcctcagcctcctgagtagctgggactacacgcacatgccaccacacccagctaattgttgtatttttagtagagaccgaatttcaccatattggccaggctgctcgcaaactcctgaccctgtgatctgcccacctcggcctcccaaagtgctgggattacaggcatgagccactgtgcccagcctactctgttatttttttatctgccagttgctggtaagttccagggtagagtgataaactggcaaaacaaactttttatttctggactccaaatagcaccataaaaaaaggttattttctgggaccattgagtctcttgaaagaatactccagtatctgcttaggagttattccaagagcagggctggagaaaaattggaggatgaggagccactattcagcatacagacttttgtttaatctgcttcgtttaagcactgtgctttacttccaatttccaaagtaccatatacctccaagttctgaacctctccttcactcaaggaccttctaccttgcaaaaatacatctaccttgtaggtttgtaactttattcctttgttttatttcaatgagtgttttggaagggagataagtacatgcggtcaattcgtcatgcttttacagactatttttctcaaacttgtttaactcaggaattagtcttgcagggtctaattttcataaagtcatttatttttgcatctcactccatgcttctcagttgcatttccttcttatgaagtatatatctatatatatctatatatatctatatctatcttttggagtttagagtgagggtatatgagtagaaaactcctcatttttgtcagtttcttcaacagctttatggtttattataaggtggacatccttgtaatcacttcctaaaccaagaaaatcgaactttgtcagccacaccagaagcctgtccatgtgctccatcccaatcacaaactcctttcacccccatcactaccctgactttttaaataaccacttctttttgcatttaagtatatccctagacattatagtcttgctcattaatttaatgtcttttatgcctcctttaagctataggttctatttcttccccccccccacttataatatatatattgaataacccagttgtttactttgcagggttccccatggtctggattttgcagattgcacactcatggcatatttcaatatgctcctttgtcctctatttctgtaaactggcagttggatcaagaagcttgagcacactcaggtttaatccctttggtaaaactacacgttactatgaatttatatatttaaacatatacgatgggtttcagtccattctaattattacctttattgaaactcaaattgtcctatccatggccaataggagcctcttctagttggctgggtcctttggacatgactccagaagtctttaatcatttctctgctctctagtataataagatatttcgtgctcattccatacatttcctgccctaaacctagaaccccttgtttcttttagtgggacttggcatttcatactatatatctatatatctatatacatatagatatatgtatatagtcatgtgctgcataacgacattttggtcaacaatgaatgtcatataccactgtgatcccacaagattataacagagctgaaaaattcctattgcctaatgacatctttatttcattttattttgagacagggtcttgctctgtcacctaggctggagtacagtgtcgcaatcacttagtgacattttgatgatcctgaccctgtgtagtcctaggctaatgtgtgtttgtgtcttcatttgtaacaaaaaaagcttaaaaagtaaaaaaaaataataattatcaaaaactttaaaaataaaaagcttatagaataaggatacaaagaatatttttgtacagttgtacaatgtgtttgcgttttaagccaagtgttattacaaaagagttgaaaagtttttaaaaaatcaaaaactttataaggtaaaatgttgcaataaactaaaggtaatttattatggaagaaaaaaaattttaaataaatttagtgtagcctaagtgtacagttttgtatcaagtcttcagtagtgtgcagtgatgtccaaggccttcacattcactcaccactgactcacccacggcaacttccagtcctgcaggccccatttatggtaagtgccctacacaggtgtatcatttttaaccctttatactgtatttttactgtattctctatgttttgatatatttagatgtacaaataccactgtgttacaactgcctgcagtaatcagtacattaatatgctgtacaggtttgtagcctgggagcaataggctataccatatagcctaggtatatagtaggctgtaccatataggtatgtgtaagtagtacagtctatggtgttcccataaggacaaagtcgcctaatgatgcatttcttagaacatatccctgttgttaagtgattcatgactcagagtgtgtgtgtgtgtgtgtgtgtgtgtgtgtgtgtgtaatgttaggacacatatatatatgtatttcagaaaaaaatttttttgaattataatgtgttataattagttctgttacctgtcttgggttttctttatcaagaacttctaatctatatgttggatcttctttgcctattttcaatatttatcatttctctcaaattatttctgtttacatttatttttgattaaaaaactcattttcaaattgtagttcttttcagacactattgtattttcttattcttttattccttgtattttagtcctcttttctgaaatcagtttttcttttatttctaactctttcccaagttctgttacttcattcctgagtttttcttctggcttgttttgctgtttcatgtttcatatcattttatatctttacagtgacactgtgccaggtgttacagaaacagtggtattcaaaacaaagtccatgtctccaataatcatatttcactcattccaagccacatttatttctttgtttctgtttctctttcttccctcaccccaacttggaatgcttgtttaaacattaaaattttctcatagttgattttaaaatgaaatctgtaagggtaaacttttctagctataggctaccataatctttcccttattttgaattcttgaataagttttcagttttcttgacagtctgtcccttgaacctagatcattagctttttaaggaaaaaaattatggctttttatatctcccagaataaagccaacaatgactctggggctgggcgtggtggctcacacctgtaatctcagtactttgggaggacaaggcgggtggactgcttgagctcaggagtttgggaccagcctgggcaacacagtgagacccccatctctacaaaaaatgaaaaaaatgagccgggggcagtggcacgtgcctgtagtcccagtcactcgggctgaggtgggaggatagtttgaacctgggaggtcaaagctacagtgaggagtgcctacactgctgcactccagcctaggtgacagagtgagaccctgtctttaaaaaaacaaagaaagaaaaaaaaaaagaatgaccctgggcattgttggaactcagaaaaccataccccaaaatgaagacctcagaagcaaaagatttttcccaccttctccaaccctcctgtctcaatcccattcttccccccacccccacccacaaggctagtcatagaaactggaatccgtctttcccaaagcagggcatagaaaccaaaaccccaccctttcccaaagccagccacaaacctaaaaatattactctaacctccctgcacccctttctgtgcaaatattggacatagagaaattatctggcagagcgcagtggctcacgcctgtaatcccagcactttgggaggccgaggcgggtggatcacctgaggtcaggagttcaagaccagcctggccaacatggtgaaaccccgtctcaactaaaaatacaaaaaaaattagctgggcgtgatggcgggcgcttgtaatcccagctacttcgggaggctaagacaggagaatcacttgaacccgggagggggaggttgcagtgagccgagatcgcaccatcgcactccagcctgggcgacaagagcaaaactctgtcaaaaaaaaaaaaagaaggaaaagaaaaattatctgacctaccttgtttaactgttgtaggccacagcccccattccagagggtcctgttccatacccagaaggaatgaatgctgcagacaggccaaggagaatccagataggccttgctgggtttcttgcctgtttgcatcagagtgttttttgtccagtcattttttttgagacggagtctcgctctgtcgcccaggctggagtgcggtgacgcaatctcggctcactgcaagctccgcctcccgggttcacgccattctcctgcctcagcctcctgagtagctgggactacaggcgcccgccaccacgcctggctaatttttagtatttttagtagagacggggtttcactgtgttagccaggatggtctcgatctcctgaccttgtgatccgcccgcctcagcctcccaaagtgctgagattacaggcgtgagccaccgcgcccggccttgtccagtcatttttttatacggctgtccatgctttgttgaacctaagcatacaaatacacgatttcccttgttatctttgggtcttcattctgaaggctcccgtgtcacataaaacgatggtcaaatcaatgtctatgtcttttctcctattaactgcctcctgtcagtgactttcagcgaaacttcagaaggtgaagcggaagttttcctttggcccggacagcatcatcattaatatcattaataaatattcccacagtatttggcccttgtatgtcctttgtatggtgctggggatacaataacatatcgctgcagagattttcaaatgtaaaagaagagagattatactgatttaaaagctagattctgtcctcaccctggagctagtctgcatttacgaaaacttactttccactgcggtagacagacgctttctactccagcgcaactgtgcctttcctcaaatctagtctcaaatttaggttccttttcattttctgttatggaaaggccctcagcgtatcccaggctttggagccttttgttagtagtctggcccatgcataatttccccttcctctgaattatacatagcacctcactagttatattttaatacactttcctatgtctcagtggtagtttcctatattaatatatatcccagtttagtttggcttttaatttcttttcttctaaggggatagatgcgttctgtaccaccttctcgagtactaatggttaactggaatgaacacaagcaacaaaccctccggcctggatcccaaaacaacagtcgcggttctgcaacagaaaaggctgcgctggccctgggacctgtctcggaaatactcctcatccatctagtttctcccaggacaactaggcccaaccccacgggaatatacagagaggcctcgggtcacagacttaaagctgtaaaagggaggaggcgacggtctggtcccagtcaccgaccagccaccgactactagggcccgaacccgggactgcagacgcacctccccgccctcccttcccagctccgcctggcggcgggcgttgctcctgaggggcggggcttccgcttccggcgggggattgttgacgcctgcggttgctgcggtggtgacggggctgttggggaggggccattgggggagggaaacggagcagtracargtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaragcttcccttcgggcggcgctgcagtcccccaggccgcggcgccgccgcccccgcagctgggctattacaaccccttctacttcctgagccccggggccgcggggcctgacccgcggacagctgcyggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggtgagaagcgcgaggtggaggctgggcggagtagaagggttttcgggggcctgtggggtagagctggcacgctttttagacctgtaactgctgcttctactctgattgactatcctgcccgttcagttcactagctatcgtttgtccaggccctaaattcccaaaatgtacaaggaggcaatacagtttcttcttcctttagacctggcactccaaattgactcccttactcatgggactagttgtttattcgtgaaaagaaattgctcttcaaaccatcctcttcctttggttttcacgctctgcagtgagggccaaagctaaattcgcaaatggcaaacccacttttggaggggctcgactggtaatgctgaaaattattcagacattggctacttaggacagtggaactgaacggatataaaaggagatcgacatggatacaagtggagttaggaagttttgattgggtcaaagcttcacttcatttgatcaatatcttgtatattgtgtaattgtttttgcttctgtgtgtgaactagaatattttgaattagttacacttcttagtttactatttaaactattagacttttagtttattttagttagccacagatagatgggacaagaactagttgatgcctctgatcccagtcagaatttaggatgacagattgatactcactgggtttattttaaagaaagcaaaacaaactaaaaaacgggtggggggggattacagggatttactttatactaattgccaatatttaaccttgatttgtactaaaaaatgtttaattttgtgtgacttagatgtgatcacctggattctcctcattagaattcctagtgaaatgtagtgggtaccctaatcaaatttatctgtgaaatcagttttctagggggaaagtggggagggtggggacaaggtctgcttctatcgcccagcctggatagtgcagtggcgatcttggctccctgcagcctccgcctcccaggttcaagccgtcctgccacctcagcttccctagtagctgggactaaaggcatgcgccaccacgcccggctaatttttgtattttttgttgagacggggtttcgccatgttggccagggccagactggtctcgaactcctggcctcaagcaatctgcccgcctcggcctcctaaagtgctgggattacagacgtgagtcactgcacctggccgtgtgaaatcaatttttaaacgttaaggtgatgaaagcaaactttaagctcagtaaatagtggattctctgttactctattttagtaacatggattcttggtggaatcaatatcaatagttgctgcacggttataaatattttttaagttgtaccttgactttctttagcaattcattacatggcttgtgttccaaggcttatgtgaaatgattcgtttttcctaacttttttttttttttaatttacaggcagagaatatgttattccatccttggcccacagatttatggcagagatggtggatttctttattctcttctttataaaagcaaccattgtcttaagcattatgcacctcagtgggataaagtaagttgaggacatttgcagaagggttttaatttctactgtttaatgatcttgttttattacattctgtttgtctacacgtgactatatggataatgggcttgtcagtgtcatgatttctttataagagctttgttagatttattgttttcttgttgattttaagaaataactagaaaggaaaaaaaatagcttactgaattctataagatgtgtgggaatctcacctatcaaaaataggtaaaaagagcctccaaamctgctttgattttattcacctattcttttaggccaggaactaatttacctctcactatcctgttccctcttgctatcttgtggagtctctaaagacaaaggtataaagagcttttggtaggtgaattaataatcaactagatggcatttccaaatgggattgcacatactgtggggcaagtcccaagtgaacttcaaagtgagacgtttatttgagtaatccttccagattaacaataatcataatagcagttaccacttcctgagtactttctatatgccatgtattgagcttgctcacttctttatgtggattcttatttaatcttaataccaagatgaggtgtagagattaataccaccattttatagagtttgaaatttgggtttatgaaaagttgagcacagaacctaaaatgttacaaaggtagtaagtgacagagtcaagatacaagcctgtgcagtcaaatttcagggtccttgccagaaacctgttactgtgattcctccctgtccctccctctcactccactccacatccagtgaaataccaactcctttatgttcaattttctgaatagctttcaaccccagacctcctcactgccagatcatttttctttttttgagacagagtcttgctctgtcacccaggctggagtgcagtagtacaattatggctcactgcagccttgatctcctgtgcccaagtgacactcccacctcagcctcacaaggagctgggaccacaggcatgctccaccatgcctagctaattaaaaaaaaaamttgttttttgtagagatggggtctccctatgttgcccaggctggtctcaaactcctgggctcaaatgatcctsctgccttagcttcccaaagtgctgagattacaagcatgagccaccacacctggcccattttttatcatcattgcttctccctactccgattactgtcgtctcttgcttggattatagcagaagccttctagtggtaactcagtctcctgttttatctcaatccagtctctgatataaaaccaaagtgatcataaatcctggttctgttcctttcctaccttaaaacccttcaatggtttctctttttaaaatgtttattgtttttttagagatggggtctgtgttgcccaggttgctttcaaaatcctaggctcaggcgatcctcccacctcagcctcccaaagtgctgggattacatgcgtgagccaccatgctcagccccttcaatggtttctctttaccagcaggataaagtctgaatttcatcatgtggtttatactcaggaggctgtctcaacctcccaagtaggtgggactgcaggtgcataccaccacaccctgcctttatttcttaatcactgccacctctcacatttagtatatgagccacaccaaactgcttacagcttctatcatattctctctttctccaagacattctctcctgctgttccctctttctggaacgttatttcctcttcttagtctggctaacttctcttcatccttcagagcctcatctaactgtcttttctgggaaaccttcacaaggttaagtgtatctggtgtatgtttccatagtatcctargttccccatcacagcactcatcccactttattattgctatttatttattgttctgttttctttgctaggttagaccctccacgaaagcagggaccgtgtaaattcattcacccttatttcccccgtgctagtacagtgtctgctcatgataatgctgcttatttgttgaataaactaatgaatgctttatgatactagatggttgggaatctaaagattagtttagaatttcaattaaaatgtatgacttgcactaatgaaaaaaaagtcagtgctactgttctggtaactaattmtttataaccccaaactattattttgtgtagggatatctctaagtttgctatgcattatataatagaagaaatagatgaagacacatcaatggaagacttgcagaaaatgatggttgtggcacttatatacagattattagtttgtttctatgaggtaagctactgacttcagcaagaattaatatttaacaatctaattttatgtttttacatttatttttttgagacagagtctcgctctgtcacccaggctggagtgcagtggtgtgatcttggctcactgcaacctctgcctcctgagttcaagtgattctcctgtctcagcctcctgagtaggtgggactacaggtgcataccaccacacctggctaatttttgtatttttagtagagacagggttttgccatgtaggccaggctggtctcaaactcctggcctcagtgatctgcccaccttggcctcccaaagtgctgggattacaggcatgagccactgcacctagccaacaatctaattttagattatcagcccaagacgaaaaastaatcgaaatttataattattcatgtcttttccacatgtctacttttctgttttttttcccaaattttaactaatcattaagtaaaaacttttggaagagagacattttacaatttctttgtaatatttttcagtcttagaaactcaaataaaatttcacttatagattgtggtccaaaaatatacttgtaaattgcaatgtagttttctgcagaagcagcttactagaargtatagtagtcatagagaaatattacaggagacagacatcttgtggtattggacatgttagagacctacagaaatgcataaagttaaatggttaacttttgagtattctatgcaattctttcaacttgaaaaatttaaaacatgaaataatatggtgggaaaagtttatctttaaaattggtatagttgagccagtaatttttaaatcatccttctttccttagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtaagtccttttcttagcttaatctactacatacttaatgaaaataatgtgttttagaatattggggtttttttcttcatagtagataggcttatatttattaagttaaaacaaagtttgaatatttatttcagttgtgttacatgattgtagacctcttttacagtayacattttcaagatgatttttttttttttttttttgtgagacggagtctcactctgttgcccaggctggagtgcagtggcacagtctcggctcactgcaggctccgcctcccaggttcacgccattctcctgcctcagcctcccgagtaggtgggactacaggtgcccgccaccacgcccggctaattttttgtatttttagtagggacggggtttcaccgtgttaaccaggatggtcttgatctcctgacctcatgatccacccgcctccgcctctcaaagtgttgggattacagacgtgagccaccatgccctgcctcaagatgatcaytttatgaattataagtcacwatacgagaggatgatttgggtgttgatggtgtattagtgctccacaatcagctttattattctttggacctgtggatgtkaggtcaggtactagtctgccttgagtctccatttggccatgcctgtcattattccatcttgaataggcagcagagttttgacagctatgcattcgtgcatccttctcctgctgttaggtgagagcttgtaatactgccagtattcaaggttagctgttggcatctagcgctgggggaaggtacaaccagtgataatggaaactgtggaggtcagtggctggtagtcagttgagccaaacaaggtattggctgcaatttttgccagaatgattcagagctggattgttacatcaagaaatataaacaagtgattctagaaaccttggttttgccatcttcaaatttttcttaaaatttggtagttatagccgggcacagtggctcacgcctgtaatcccagcactttgtgaggctgaggtgggcagatcacgaggtcaggagatcgagaccatcctggctaacatggtgaaaccccgtctctactaaaaatacaaaaaattagccgggcgtggtggcgggccctgtagtcccagctactcaggaggctgaggcaggagaatggcatgaacccgggaggcagagcttgcagtgagctgagattgcaccactgcactccaacctgggcgacagagtaagactccatctcaaaaaaaaaaaaaaaaaaaacaaaactggtagttataaacctactacttcttttaataagagtcagtaatggctaatgtttattgagtactttttatatcacctgcactgttaataacactgcatatgtattaatttaatgctaaccacctcataagatagagactattgatctatatctatagtatcataagatactataggtagtctctatctatatactataggtagtatctatatactatctatagtatcataagatagatactattgttccctttttgcagatgtggaatacaactagtaattggtagacgatggatctgaatttaactagtctggattcagaacccacactcctagccactgtacttttctgcagcccttcagtgcactaaaaggcagaaatctaacataagtaggataattctccatcctgagtgattgttgaaagcttttaaaagctttgcttaatcactggatcccacaaaggaaaatgctgattaaagaacacacagtactttaaaatgcatgttttttctataaggtagacaaatgggactacagtaagcatactcagaaagtactcagaattaatgttcatttcttctgagaaaatactagaaagctctgtaaaccattaattcaatattctgagacatgtttattactgctttttatgttgttgaagtcttattagaaatagcccaggtggtttgatcatgatacagtgctacttgaaaatatatcaaaggtaaaaattctctcaactataccttgaatgtctttttccctgtagacttctgtagagaagtacaattgtgttttaaatgtctattttgaacttgatgggataccattaatctatatgtggtttgatgtgtaacttacctgatatttttgttttaactttttaggtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctmtgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcrtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtaytgcccaactgaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgcatctgtattttgtctatttctttgagacagtttgctctagaatctgcttagggagaccttgcctccaaatacaggttttccagtgggtttagcagtaaactagaatgctttcagaaatagagatctatgaaaaaagaatcgcccatctttaaggatatattcttttagcaggcacactcagaagttacctgtacatgaattaagcttactattaaactaatccagtccttcaagagttgttaaccatcacaaccaccacacaagtctcatctgggcaatttaaacccagttctgaccttaaaagcctttcccattctaacaacttttatgaacaggtccagagagaaggcaggaagcaaaacaacgggttcctcactcaacaggggcaaagataataaaggataaactagactgtagctaaaagatggtccaagtcctgtagacaatgtgctgctgttatgagcctagccacaaacttgttttagaactacagtagatttttgagacaagtttacaaaggtgccctatattacaaaaggaagtctctgaccgacatggtcatacagctgatgcgtgtagctagacctactacctccattttctcaattttactagaccaaatttttgtcagtttccattaaatgcaccggctaaaataaccactataaaatttccattgtattttacttttccaaagtaaaataatactttccaattgaaaagttctttccaggcttaaccagcatatggcctggttatatgttgttaaaattagttcaataactaatttcaagtaataaaataataattagataaacaagtaatttcagaggagaatttgtaacaagtattaataggcagcttaaagacatttttcagtggtctgaaccgtacctttttctcaatgcccggaatcgtaattactcaaaaccacctagcactttgcttaaagtgacacccccaaacctcagtgcatcagtctgccaggtgcttatttgatgatgcagacttttggaacctatccagtcccagtttctggtgatgggggtcctagaacatatatttgacataccctgccaactactactaacggtacattcagtgagagccaccagtcctctcgtcaatcgaccaaattataaaaacacctacttaattattcaattaaactttctgaacatgactttcctcccttagagattctttttcattaaaaacaattcctggctgggtttggtagcttacacctgtaattgcagcatgttagaaggcaagaggatcataccaagaccctgtctctataaaaaataaaaatcttagcatggtggcacatacctgtagtccccagctactctgaaggctgaggcaggaagatggcttgagcttaggagttgaaggctgcagtgagctatgacagcaccactgcattccagcctgggtgacagagggagaccctggcaatctatcttcattactcattggcccagcataagaagtatgggcttttattactttctttccaacatttgtttccctgccatccataaatatcctcaattttcacttgtgtatgcagtatacaacccaaagcaaggttgggcatgtggctcacgcctgtaatcccagcattttgggaggccaaggcaggcggatcacgaggtcaggaggtcgagaccagcctggccaacatggcgaaaccctctgtctactaaaaatacaaaaactggccaggtgtggtggagcacacctgtagtcccagctactcaggaggctgaggcaggagaatcgcttgaacccaaaaggcggaggttcccaagaaataaagtagtcagactgaaaaaagccccaagttctgagtgcagttctatagactaatcaggttgggggctaaagattccatttttaacaaacagattaagtatggttttagtgagttttaaacagtactaaataaaagtaaacatcatttcttgcaatttttagagaaaagcagaacacttcagcgataggggcctagagaatggctaagaaccttcaaagtaagaattaacttctcagcagtaagacacaaattcccagttacctcttccagtattcatcacattttgccccctcaacaggtgtcaaatgtatactgctaataaagcaaaatttctacccccaaccagcatttgatgatggactaaaatatctcaagtaagaaaaataccttgagttctaaatttaaactgcaaccaggccaggcgcggtggctcacgcctgtaatcccagcactttgggaggctgaggcgggtggatcacaaggtcaagagttccagaccagcctggccaacatggtgaaaccgtgtctctactaaaaatacacacaaaaaattagccgggcatggtggcgggcgcctgtaatcacagctacttaggaggctgaggcaggagaattgcttgaacccaggaggcagaggttgcagtgagctgagaccgcaccactgcactccagcctgggcgacagagcaagactccgtcttggaaaaacataaactccaaccaaccagaagttcagtaaattaaaactgagcacaatttaaataactgtacatttccaactgaaaaataaaattaccaaatattgttccaagagctcttttatggaccatgggaatccagtttaaaaaaaaaaaaaagaatgcagtaaaataatacaaaagaaagtgcagctgacccttgaacaacccgggtttgaaccgtgggcccacttatcacgggttttttttttttttttaactcaaccaaaaacagatcaaaaacacagtattcgtgggatataaaacctgcacattcggagggctggcttttggtatactcaggttctgcagggtccactgctgaaatttgtggattgtggtttgggggcgggagaactgggggggggggggagtgcagttctgggaacaatctcctgcacacaccaagagacaactgtagtttttgtgtatgtatttccaagaactttaataaacactatccagtaacttaccaaggaagatagaagcacaaagagaaatgaatgtgtgtattttcaacttttaaaaaaggtacctaagtcgatatgcaaattaggcatgattcctagcaccaggcaagaagtagggtaccttctatatgttgtgcattcagatactttcagatactttccctttctcttaggagttgtctaaatcatgtcaatgtattcttctaatgagacactgttaatctttattttacaaagtccccccaataatactgtgtgccttcattatgaggtaaaactagaacaaaaagtatgtcataattttttattgatggcatttatcccatggtttaacatgttaattatactgtaataaacatggctttaatattaaacttttccttattatccaaagtcaccacagtccattttagtaaatataaaaatatatgcttaatactttgtacaatactggtttttggtccaaacaaaactggatcagaaaagccaataaattcaactttaagaatccccaattttttttttaaagatttccaaatggatttaggcaactttgaataatgggatttacataataaaatctgagacaagactaaacaaacaacaaaaaaatctctaacacaaaattcaaatttcaagttcacagatttatgttatgccaaaaagtacagaaacaaaattgtatttacacaagtttcataataaaataatgaaaaaggcaagacaggtgataggagaatgaaaatatagaaatagcatataattattaaatggagagtgaactagatctaacaagtccttagcacggaccattctttaatcaggcttcctctatcagaaaagtttagcgcacaatacacccaactcactcacttcacacatacaccagcacaaactcagcatagaaatcatccgtttcaacactctctaatctatacagaattctaatctatacagaattcctcagatataattacaatttcaacgcgttccatgaacgcttatcagcgcacataatggtgtagacaaagaggttctatacaaagccattcaccgtgcaggctccattcctgggtacagccagactatgtcaaatcagtgaataatctgctggatcataaaatatttttgctgaagaatcagtcaccagtctagctatttatttatttaaaaaagggtgggtgaggcagggtggggcttctgtaacgaaagagaaaggaggaaaattccaaaattaaagaagtccttaggcagatctgacttcagataaccccagcacaaagtacaatccagtatctgaaagcagggcaccagctgttgttaaaattgagtacaacaccaatgtgacctttatttcctgcgtctaacagcagtctttatcttgcgaccagagaatgaagttccagaagaagagaacacatttttcccatttgacctgtgaaaaataaaaacttcataatgtgacatgatgctctgagcaaaatttccaaatgctaacatttaccatgagcagcagaagggtaaggggggtcgggtggggggggagtagactcacattggtatatacattttctgctacacctaacacacacgctactgttatttttttctcaaactgtaatataatcctccagaattatagtatggtaaatttatgttggagaacatatttaattttacccaaaccatacggaatcttgatgacttttaaaaacaaaacatatacatgcacatacccttaccaatgtaacttctccatttcaataaaaaattctcttaccccactgtaaatgctgctggagactggttaaatggaaagccccccgagcctgaaggctgggctgaggctgcaggtgtgctagaatttgcaccaaatgtgaacactcctgatggactgttgtttgtgaagttgaaatttgtagtgctgctgccaaactggaaagccgaacctgcaatagttaaagcagaaatacttcattagggcaaaatgataggtttttttgtttgtttgtttgttttttgagacggagtctcgctctcttgcccaggctggagtacagtggcacaatcttggctcactgcaacccttgcctcctgggttcaagtgattcccctgcctcagcctccccagtagctgggactatataggtgcgtgccaccatgcctggctaattttttgtattttagtagagacgtggtttcaccatgttggccaggatggtctcgatctcctgaccttgtgatctgtccacctcggcctcccaaagtgctggattacaggcgtaagccactgcacccggccgcaacatgataggtttttaaattaaagactctgacctttacatataaaaacatgcaaagaattaaaatattctggtcttttaatctaaagaaaactattttctccactgacacatagtacatacttgacacctccaacaaatcacacaacttacctatgaccaaggggaaaagggcaccctggacttatggttaaagacagtgaaatcaacaaatacacttagctctatcttctttgaaaagtgcattaaaacaacaagggatttttacaaagatataggtttagaagctggaaggctgactagagttgatactaaacgagcagtagggaaagaacagaagcaattgcatttacaccaaacatacccaaaatgtttaggttccagatacctatggaagtgaggatgtagtgggaattaaaaaaaaaaaaaaaaaaaaaggatggcagagtatgtttagaagcagatacccagaatcaatccctcccaacaccaacacaaagatggtaattatcagtgggtgcagtgactcatgcgtataatcctagcactttgggaggccaaggcaggtggactgcttgagcccaggagtttgagaacaacctaggcaacatggcgagatcctatctctataaaaaatttttcaaaattagccaggcgtagtggcgtgcacctgt

SEQ ID NO: 10887 - DNA, 14399 bp, Homo sapiens
gttttctatctatcctgccccttctatccttcatatcacaatggagcacaaattataattaagagatacaaaagcattcagtcacttccatttttttctttagatacttactatattaagtcttaaatgaacatattggcattccaaattattaagataatgtcatgctggtcattgaaatgctaaattaacatgaagactacatttcaaaaatacaaaagtataaataggagtgttttgtatattcataccacgatttttgcccttagaggaactctgaagtacattgttatatgtctgactaatgtattcaaccctggaatttttggggaagcatttgtttttttctgaaatatactgtcccactaaagtatcaaattgggcatacatgatgacatgaaaagcatttcccaaaccatagttaatttaagtaaaatgaacttaatattatacagccttaactagaaatgagatgtcttgccacactaccagttctgtcaatagaagttgagtgaatagatttatatctattaactagaaaaaagtataggcataaattaacatgtcatctgatgtgagcagattgagaaagccaacaaatttctagttattcaatttaaaggacactgaagtaccacaatgtatacattcaatttgactacataataatagctgctatttacttagcacttcttcatctacatattctgtaatcttcattactatcctgtattagtccattctgacactgctataaagatactatctgagactgggtaatttatacggaaaggaggtttaattgactcacagttctgcatggctggggaggcctcaggaaacttatgatcatggtggaaggggcaggggaagcaagacacgtctcacctggcagcaggagagagaaagagcacaagggaaactgccacatttaaaccatcaactctcctgagaactccctatcacaagaacagcatggaaaaaacccccccatgatccaactgcctcccaccaggtccctcccccaaaacatgcgggttacaattcaagattagatttgggtggggacacagagccaaaccatattattttgcacttgctccctctcaaatcccatgtctttttacattttaaaaccaattatgccttcacaacagtcccccaaagtcttattacagcattaactcaaaagtccaagaccaaagtctcatctgagacatggcaagtcccttccacgtatgagcctataaaatcaaaagcaagttagttacttccaagatacaatgagggaacaggcattgggtaaatgttcctgttccaaatgggagaaactggtcaaaccaagggccacaggccccatgaaatctgaaacccagctgggcagcccttaaatctaaaagctccaaaatctcctttgactccatgtctcacattcagggcacactgaagtaaggggtgggctttcatacccttgggcagctccgcccctgtggctcagcagggtacccctgtggctttcacaggctggcattctgtggcttttccagacgtatactgcaaactgtcggtgaatctacctttctggggcctggaggacagaggccctcttctcacagctccactaggtagtgccccagtggggactctgtatgagggatccaaccccatatttcccttccgcattgccctagcagaggttctccatgaaggctctgcctccatggcagacttctgcctggacatccaggcgtttctatacatcctcttaaatataggcacaggttcccaaacctcaactcttgtcttctgcgcacctgcaggcccaacaccacgtgaaagctgccaaagcttggggcttgcaccctctgaagcaatggtgcgagctgtaacttggccccttacagccacagctggagctggagcatcagggatgcagggcaccatgtcgtgaggctgtacagagcagcaaggccctgagcaggaaaccatttttccctcctagttctcaggcctgtgatgggaggggctgccccgaagatctctgccatgccctggagacattttctccattgtcttggttattaacatttggctccttgttacttattacttattactttttacttattattacttattactccttgttacttattcagatttctgcagctggcttgaattcctccccagaaaatggggttttcttttctactacatggtcaggctgcaaattttccaaacctttatgttctgcttcacttctaaacctaagttccaatttcagaccatatcttcgtgaatgcacatgactgaacgctttcagaatcagccaagtcaccactaggatgctttgctgcttagaaattttcttctgccaaataccctaaatcatctcaaagttcatcagttctctagggcaggggtaaaatgctgccagtctttttgctaaagcatagcaaaaataacctttgctccagttcccaataagttcctcatctctgggaccatttcagcctggacttcattgtccacgtcactatcagcattttggtcaaaagtattcaaaacaagtctctaggacgttccaaactttcctatatcttccagttttcttctgagccctccaaactgttctaaccactgcctgttacccagttccaaagtcacttccgcattttcagattatctttatagcagtacccaaccctgccagtaccaattctctgtattagtcagtttttacactactataaagaatatctgagactgggtaatttataagggaggtttaatttactcatagttctgcatagctggggaggcctcaagaaacatacaatcatggcagaaggcaaagaggaagcaaggaaagtcttacatggtggcaggagagagagaaagcacaggggaaactgccatatttaaaccatcagatgttttgcgatctcccacactatcacgagaacagcatggaggaaatcacttccatgatccaaacacctcacaccaggtccctccctcaatatatggggattacaattcaagataagatttgggtggggacacagagccaaaccatatcacatcctgaaagtaggtatctctaatcccatttgacagatgcagaaactaggactcagaaatgttagagaattggtcccagaacactatattatacatttattaagaggcaaaatctaaatttgcattcaagattccaagtctactgctgctttatttttttgcacatgccaatagtaaaagcttggttttcaaactgtatcacagattaagatagattaaattagaacaatattataataattagaggatgttagaactcctctatttcacagaaataaaggttaaatgatacccaaagtaacaggtatcataggtaagaaattaacacctttttttaaataccaatactcatgtattattcctttaccctgcattctccagatacagataaaagggctgactacattttttttaaatatgtgaattgttctaaaattcaatacttttctacattctggtgagatcctcttggtaaattatataattaaatatcagtcaaaacatactaaaaaatgtattgtggtgctgcatataatgtatatgtactctgattttcacatatttgtctacatatacatttgtcaattcacaataacagagtgatgtgccaagtaaactatcgtgtagtttcacttttgaaaatttaacaatagaatataagttttgtttttcacagtctaagtaagtataggttactgtggttcattttagaacattcattagaaaagtaacgtgtctcttctaaaatgctatttgctaacattttagaaactgtatgttaaataaagaagaaacatttaaagcaagtgatgatgtaatttttgttttaaaattttagggatattctgcacaatgtaaaaatttcaagggcacacttagcactttttttgagaaagaataaatggtagctactgttgtagtgggagatgtgcaatgtggaagctttaaaattgataaacatttataagcaaaataatagtaaataatattttccttttttctaaaataattgtcagatttacaagtgaaatcaatactgtattctctcaaacttgttttaaaagctttgtcagagtttgtatcttcataaaagtattgcaaaaattaattttaacaaaccaaatccctcttgaaaagaatcaaaaggaataagaatgtgaatgtcagccataagaaagcatttttaaaactgtgttttcatataagcagttctgcatgcaggaaacagaaactgctgagtaccactgcagattggacactgctgttaacagctccaaagtctaagagaagtggaatctctgaaaataaaagtcattacttaaaattttaattaccaacataatttttagagttgtcactttcaacaaaatcatccctgaaaaaacttcacaagtaaaaatagttaaatacaacaacaaagaattgcaggggatagaaagaatcgatattgttaaaatcgccatactgcccaaagcaattagcgggttcagtgctattgctctcaaaataccaatgacattcatcacagaattagaaaaaaactattttaaaattcatatagaatcaaaaaagggcacaaatagccaaagcaatcctaagccaaaagaacaaagctggaggcaccgtattacccgacttcaaactactacaaggctaaagtaaccaaaacagcatggtattggtacaaaacagacacatagaccaatgcaacagaatagagcccagaaataagaccacacacttaaaaccatccaatcttcaacaaagtcaacaaaaacaagtaatggggaaaggactccctattcaataaatggtgctgggataccatctcacaccagtcagaacagctattattaaaaagtcagaaaataatagatcctggtgaggttgcagagaaagggaaatgcttatacactcctggtggaagtgtaaattaatccagccattgtggaaagcagtttgatgatttctcaaagaacttaaaacagaactaccattcgacccagcaatcccatcactgggtatatacccagaggaatataaatgattctaccataaagacgcatgcatgtgtatgttcactgcagtactactcacaatagcaaagacatagaatcaacctaaaagcccatcaacagaagactgcataaagaaaatgtggtacatatacaccatggaattctacacagcgataaaaagaatgaaatcatgtcctttgcggcaacatggatggagctggcagccattatcctaagcaaactaacacaggaatagaaaaccaaataccacatgttcttctcagttataactaggaactaaacattgagtacacagggacacaaagaagggaaggacagacactggggcctacttgagggtgggaagagaatgaagactaaaaacctatccatcaagtactgtgtttatttcctgggtgatgaaataatctgtacagcaaacccctgtggcacaaaatttgcctatataacaaacctgcacatgtacctctgaacctaaaataaaagtttaacaaaaaagaattgcagggttttttggggagtgggcaggggagaaaaggaaccaataaaacaatgattatgacaaaacctttatccatagtttaaaattagaacacaaaacatctaaccacctgccaaaacatgaatcacaaaattgatattttaaggacaagtcattaatttgtagcataaatagctgacaaccttagactaaatgtgtcattgctgataaatgattcacatcttcaatactgaaagctgacaagcattcagaacattaaaacaatatatcacaacacagactgttaaatattaggtggacagtcagtgcatgagtttagctgtaccaggattattttaagaaagttcgggcactttgagtgtttttttttttttttaatccataactttctgtaagaaccacactgtggatcataacatctgagctataaggattaagagtgtaactggggcccgttgggtgggggggcgggacagcattaggaaaaatagctaacgcatgccgggcttaatacctgatgagttgataggtacagcaaaccaccatgrccacatgtttacctatgtaacctgcamatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgatggcgtgagtttacgggtgcagagaaccactgcaagacttcgcctaaagaaaatttttagtggtatctttgtaaaagttaccccctagaatctaaaaatgctgcatatagtggaaccttatgtgacctggggatttccaaatctgaagtctgtccgagaactcattttgaaacgtggacaagccaaggtcaagaataagaccatccctctgacagacaacacagtgattgaggagcacctggggaagtttggcttcatttgcttggaagacctcattcatgaaattgccttcccagggaagcatttccaggagatctcatggttcttgcgccctttccacctctcagtggcccatcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaaagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcacgtgcctgtagtcccagctactcgagaggctaaggcaggaaaatcgcttgaacccaggaggcagagactgcagtgagccaagattgcgccagtgcactccagctgggcgacagagcgagactccatctcaaaaaacaaacaaacaaacaaacaaacaaacaaaaaactattgctgcagtcattcagatggaaatggggaaagaataatattaataactgatttcaaaaaggacttgaagatgtgaatcatctattttgctgaagaaatcttaactttttgaaattactttttattgctgttgtcatactcttaggtgacaaactgcggtaaattttttatcagtgaagtggaagcatgcgttttgttgttttgggaatttttatcaagtatcttcagagaagattatttcctgctttatcttcaaaaactggaaaggaagggtcaaagaaaagacagtagctggccggtcgtggtggctcatgcctgtaatcccaacactttgggaggctgaggcaggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcttatgttcatgtcaagcacctctcatcacagtctagttccaaggaaaaattccagcgttttctacattgggtgctgtgtcatctgaaatcggcacattccatggaggaaggagtcctgctttgttgcatgtatcctagggtttaatgttggtaaatgagtcactctagcatttgtagaaggctccctgagactcctacagcagtcgaccaagcccaaggacataattgaatctggagagtcctggggccttgttttgataaagacttgaaatacacataggaagaaaggcataaaaataaatgttcacttgtctctgctgtgaaaaaaaaaaaaaagaattaagagtacagagagcaatagaaagagggagatcttttaaattacattggaagcagtaagttttcttagttagcctgaggaggaactctgtccctgtccctgcctcccaaaagggagcaaaagggtataaatagtttataagaagcatccacttgaaagtttaatttttctcacagtgcgaaaaagaataaaataataccagaaaaggttattatgatttctgaaatgtagcataaagccaaaacctgaaaagaagaagaaacactgaattagacaagggtatgcaatagagaacatgaggggttcacaccttcttgacactgcagggagtagctgaaatgactggttgacgctatttgtgggtcttggtttgaataggaggcaatttgattctctccctactagcatcaagaaatcacatcatacacagtacagtggtacatgccgaggcccttccagttgtaggctggccccatttttcattcatgtgggaaaggaaaactgaataaactcaatacagctatgatccccacactgaggaaaactctctgtaaccataaagcccaactcatgtttttacatctaatccgtagtctactctaagattattgttgtaaattcatctgctctaagattactgctgtaaattcatttagaattacatagctagatagaatgaaaaggtaatttgtcaaatgaagctaaattggaagatacttttacattataaaaactataactatttagacaatttagaaaacagcaaaaagtttaaattagaaaataaagtcgccattcttttgacagaaaaccagcaaacacttccatatatagcctgcatcttttaaaaaaactgcatctatttattttggggataacaatataaatggctaatttgcaccttgctttttatgtgtggtactattcatctgtatacttcacattttgataaaactcctatgtcaatagatattttacatgattctttagtagttgtaaagtatttggctgtaacttccattctcccgttattggtcattctttggtttttcactattataaataccactgtacacacctttgcaaatgtctgattatttccctaagttaaattcctagaagggactggaaagccgatggacaactttagggtttatcacatggatccttaaactgcctctccttacctgctccaggaaaagtaggcaaaacatggacacatgtatttccccatattcgcttctaacagaaaacaaatctggtgaactggctattgataaaatttgcctatttctctgttggggtgtttgtcttctcttgattagtaagaatgttttggatgttaagtacttaaacacttagtccattgaggacatagctataaagctctcattttgaatcaaaatttcaaatatttcaagtatgatgatataatctgtgatgttcagagccctggctgttgttcacatgataattcctttagccatatctctgtttgaagtgtatgtgagcttgaaaataaaatgaccagtcaaatgtagttctggttaaagatggtatatttaacacatgcttttatttcagctccctctcaaacccagtatatgtttttaaaagcatacacctctaagaataaagagaagagacaataccagcaacagttcacaagacagaaagcagatggacaaggattgttggcttcctaagatctgttaagtcaccagtggggaaagctaagaagcaacctaattattatgaaaaaaaattctgaaaggctcaaaaactgggggtaaaggtaggggttcaaaatcaggaagactggttcaaagtctgtttaagaacatttacaggtttctttttatagaaatggtaggtcagactatgagtgccaacctgcctgccaaaaaccaaagtgctagataaaaaatatttttaaaaaatatccaggccaggcgcggtagctcatgcctgtaatcccagcactttgggaggctaaagcaggcagatcacttgacgtgaggagttcaagtgaggagttcaagtccagcctgtcaacatggcgaaaccctgtttctattaaatacaaaaattagcgggtatggtggcatacctgtaatcctagctactcgggttgctgagacagggaaaagcttgaacccaggaggtggaggctgcagtgagccaagactgtgccgctgcactccagcctgggtgacagagtgagaccctgtctcaaaaaatacatacatacatatacatatatatatatacacacacgcacatgtgtgcgcacacacacatatatatctccttaaaagcaccatcaagctgacaaaatgataaagaattaggctaaatctaaaggaaagcatcccaagttacttgtgctcagagaataacagatttaggcaaatttggatttcaactaaaaggacagaaaactagaaaaatggacaaaaaaacttatactttacaatacaggaactccaaatggccaataaacatatgaaaagttactcagcttaattagtaatcagggaaatgcaaattaaaacgacaataaaataacttacatacccatcagactgacaaaaattaaacatttgacaataagatgtgtcctgagtttaaggatgtaatcattttggaagacagtttggtattatccagtaaagtcaaagacaagaatgtcctatgatgtagcaactccatcaatagatatgtattcaaaaagaaatttatacttgtaaataaattaatgtgcatatacagtaaaatgtgtaagaatgttggcagcagcatttttttggttaaataaaaactacaaactagtcaaatgttcataatagtggaatgatttataaacatccatatatcttatctctgaggatataattctatacagcaatgaataaacgacagctgtacactacaacatgaatgaatcctacaatgttgaatgaaaaaagcaagatgcaaaatgacatatataatattctattcacataaaattcatatacatatgatattctattaacatggaattcaaaatatacaaactgagttatattgtttaaggatgtttatataggtagtaagaaaaacaagaaaacaacgatcacatttgtcagggcagtggttacctctggggaggaggaacaaaataggatttgtaaacttatatggtcatactggaggcctccaaggtattggcaatattctatttcttgccctggttggtaattacacactgctagctttattattattatttttcattaaattgtatgtatggtcatgcacgacataaatttcagtcaatgatggacagcatttatagtgatggtcccataaaattataatggagctgaaaaagtcctatcacttagctgcagctgtgcattgtaatacaacaccatgcttatgtttgtggtgatgctggtataaacaaacctaccgtgctaccagttatagaaaagtacagcaaatacaactgtgtacagtacataatactcgataatgataataaatgactatgttggtggtttatgtatttactgtattatacttttttcattattttagagtgtacttcttgtccttttttttttttgttaactgtcaaacactctcagccaggtctttcagtaggtatatcagaaaaaggcactgttatcacagaaaacgacagctctgtgtttgttattgcccctgaaggccttccagtgggataacatgtgaaggttgaacactgatgacactgactttgtataggcctaggttaatgtgtgtgtttgtgtattagtttttagtaacagttttaaaaataaaaacatcttaaaaatggaaaaaagcttacagaagaaggacataaaattttctttacagctgtacaatgtgtgtgttttaagctaagtgttactaaaaaggagtcaaaatgttaaaaaaattaaaagtttacaaagtaaaaaagttacagtaggctaaggttaatttattattgaagaaaatttttctataaatttagtgtagcctaagtctacagagtttacactacagtagacttcatataataaatgtcctaggccttcacattcactcactactcaatgactcacagcaacttccaatcctggaagccctattcacagtaagcacctatacaggtgtactatttttttcctcttttatattgtatttttattgtaccttttctatgtttagatacataaatacttaccgatgtattagaggtgcctgcagtgttcagtacagtaacatgctgtaagtttgtggcctggaagcaacagctataccatatggtccaggtgtactgtaggacataccattcagatttgtgtaagttcactctatgatgtctgcacaatgatgacatcgcctaatgatgcatttctcagaacctatctctgttgttaagcaatacatgactgcatatttgttttgttcattctcatgtacatatgcttgtttcacagtaaaaaaaaatgtaactcaaaataaaaaatagaaaaagaaacagatagcatgacctcccctactccagtctttgatgatttcttaccttttgttgtctacattttctctttctagaactcctaagctggttctctaattctcttatcttctcccctattttacattgctgtctttttgctcttatttctgggatattttcttacttttatctttcaatccttcaactgagcttttcatttatgttatcatccttttaactttcaagagtttagttttattctctgaatgttccctttttcaaaatcctttaatttgataaatgcattatttttcttatttctgaggatataagtaataggtttgagggaagtttccttatccaagatgactgctctgttgtttgttctgatctctgtcctgaagctagaagctctccccttcctttcaccctatccttctcctccttccttctaggctgagggttggtggggctccggactaaaggattccagacacagctgagagtagaaatatcttaaaaacaaaaggaagtttaagtgagccattacataccaaattattaatggcattcattcagttgaagaacacagagaaaaagaagaatgaagaaaaattaacagaacttcatggacctgagagacagtatcaaatggccttacatatgaatggagtcccagaaggggaagacaatgaaaattcaagagaaagataatgaagacataatgactagaattagttaatttagcatggtcacaggacacaatatttttaaaacattctatatatgcgacaaacaattggaaaataaaatttatattaatataatttaataactagcaaaacacatatacacaatagatatgggacaaaagatgtgcaagagctttacaggaaaaatgagaaaatattgctgaaaggaactaaagatctgaaaatattgttgaaataaactaaatatctgactaaatggagagatatacagtgttcctggattggaagactcaatatagactcaatccccaaattgaagtctcttatacccaaattgatttaatttcaatgcaataccaatcataatcccagcaggctttttttgtgtgtgtatagaaattgacaggctgactctaaaatttatagggaatacaaaggacctggaagaaccttagactttggccctgccttctggggaagggttagttatctctttaaagatgattttttttttttttttttttttttgagacagagtctcgctctgtcgcccaggctggagtccaatggcacaatcttggctcactgcaacctccgcctcctgggttgaagagattcccctgcctcagcctcccgagtagctgggattacaggtgcgcgccaccacgcccagctattttttgtatttttagtagagacagggtttcaccatgttggccaggctggtcttgaactcctgacctcgtgatccgc

SEQ ID NO: 10888 - DNA, 39566 bp, Homo sapiens
  misc_feature (1)...(39566): n = A,T,C or G, or insertion/deletion polymorphism (see Tables 1-2)
cctcgcaaagtgttgggattacaggcatgagccaccactcctggccatagcagcattattcttaatggcaaaaagtggaaacaacccagatgcctatcaactgatgagtggaggaacagagtgtgatatatctgtacaatgaaagactattcagccatatgaaggaataaagttctgatccatgctacaacatggatgaaccttgcaaacattatgctaagtgaaagatgctagttacaaaaggccacagattgtaggattccacctacaggaaatattcagaaaaggcaaatccatagacaaagaaagtaaattactggttgccaggggctggggagaaggagaattgtggagtatctactaatagggatgaggtttctttctgtggtgatgaaaatattctggaatgagacagtggtaatggttgtacaatcttgtaaatataccaagaaccactgaattgcacactttaaagggggagttttatggtgcatgaattatatctcaataaacattgcataggaataataaacaccaaatcaggagagtctttacttcttgggttggggggtcagtcatggagggaaacaaaaaggtctttatattagcagtgttttattttgcaagctggatggtaggtacacaggtatttgttctgttaatttttatacctttctcagtggtttcataataaataaaatgtaaaagtatttactgggcatcaacctggattaggcactgggctacatgggtggtacaatgttgagtcaaaacagatccatcctgccaaaaagtaagtggatacataagtatataacaagtggagaagagggtctataagtaagttatctcccctttctaaccttctgtgtcctcacggatgaaatgagagccggactgggaacctgttagtagaaggtctctgaggatccctggagccttgaagtgtgtcttccctttttcagcccacacacctcaaacacgaccagggcacagaccctagagttggccctcgtgccatcaaccaccacaagagggcctaaggcaaagcccaacttcaattagtctgtttcttctcggtaaaataggcagagtaacttctccctcccaggatgactgtgggggtgtaaatgagataacacatataaagtgtcagggacaggcctagcatacagtaaatcctcaacacctgggacagtcctcactttgattccacaggcatttcctgagcagcaatgctggcccaggcctgtgctaggggctggaagacagaggaattccactctgaatggccaaagcagtggcccccagccaggtggggagatggcctcataaacaacagtatgaggcagggtgatatcactgctaaaaagagacagtagccatgtgcacagatgcagaccatgtgtgatgcagaccctggggctgacagagatgttccaatcaaaaggcacagtccagtggctgggtgcggtggctcccgcctgtaatcccagcactttgggaggctgaggcgggtggatcacaaggtcaggagatcgagaccatcctggctaacacggtgaaaccccatctctactaaaaatagaaaaaattaggcgggcgtggtggcaggcgcctgtagtcccagctactcgggaggctgaggtaggagaatggcatgaacacgggaggcggagcttgcagtgagccaagatggcgccactgcactctagcctgggctacaaagcaagactccatctcaaaaaaacaaaaacaaaaaaaacccacagtccagacttggagagaggccctcgcagggagaaaggcaagacacaaaattaagggattggcctccattcacagtgaagtacatccctgcataccttttttcacctaattcagacccaaatgttcccacaaaccccaagaacagaggatgaaattgattcaacagttagctttgggaagtctgagcccatggcatgtcccaaggtacatatgtgggaacaccatggctgacactgctgctgtgatctttggcaagtcaggatacctcttcaagccttcctttccccggctgtaaaatggaggctataaagatactgatgtgatagggaggtaagggaaagtgagataacgactgtaaagtcattagccaagtacctgacacttagcgaccagatcaataaagggtagttattgttaggaaaaaacagatttcactttgaaagtgaggaaagccaggcgcggtggctcacacctgtaatcccagcactttgggaggctgaggcaggcagatcacgaggtcaggagttcgagaccagcctggacagcaaggtgaaaccctgtctccactaaaaatacaaaaaattagctgggcatggtggcatgtgcctgtaatcccagctactcgggagactgaggcaggagaattgcctgaacccgggaggcagaggttgcagtgagccaagatcgtgccactgcactccagcctgggtgacagagagagactccatctcaaaaaaaaaaaaaagaaagaaagaaaaaaaataaaatgaggaaagtgggattcggagaggtgagatgacttctgcacagtcaggattcaaactcaggtctgagacaccagaggctcagggcaaatcatctccctctgctccggaatcttcagcaggttccctacagtccactacatggactccatccttgccagggagtgaggatccagcaaaggcctggggccaaaaagaccctgggcaagttccccaatcctatgtgtcttgatctgagatccccaagtgagcctgagaaggtctgtgaattcctccacgtagctgatgcaaaattttatactaatggatctcagacgagtctatagcctcaaaagtaacaaaccacagacttgacctgacttagcatggtttcttattcacccaatggagatacgatttctaccttgaaaggctgtgaagggattaaatgaggtaatttgtgagaagtacttgaaacatcctcagctttcattaaatgttggtttccttctctttctctctccccaaactatttccatcagttagcaaatattattgagcatctgccacgtggcaggcaccagtcaggtcctgggggtaaagtggtgaacaagacagacatggcccattttcatggggctcacattctagcagagggaaacagcaaacaaataaaagcaacaatttcagatatgaataactgctatgaagaaaatacaaggccgggcacggtggctcacgcctgtaatcccagcactttgagaggcagaggcggacggatcacaaggtcaggagtttgagaccagcctgatcaacatggtgaaaccctgtctctcctaaaaatacaaaaattagccgggcatggtggcacgtgcctgtaatcccagctactcaggagactgaggcaggagaattgtttgaacccaggagacagaggttgcagtgagccaagatcgcaccactgcactccagcctgggcaacagagtgagactccatctcaaaaaaaagaaaaggataacgtgatagacttatagggtggggcagcctccagggatgaaacatctgaatgaccaaaggagccagtcatgccaggattttggaggaaagcacccaggcagagagtgcagaaagggcaaacgctccctggaaagattcttagtcaagagtccttcactcccagtcctaccacaaactgggtcaccttgaacaagtcacgtaacttctgaggctcagctgccacatctacaaaatgggaataaagacatcttacctgccacattgtgagaggtttcaaccaaagggctgttaaggtctgggatcctccccaaatctcaccatagacacctgatactcatcacttggcacccgtcttggaagaggggaacctgcacagagaaccctgggtcatgcttttgatttttaatttcatgctgcactagaaatagcttcttttgttcctggttgacccaggagcctcttcctgccacctggggcctattctagttaacagctgcttatcccctcaggtacaaaagccaacgaggaaaggacatcaggaaacattgttctgggaataaccagacacctatctgccaccatctccccccatcccgtgaccacacacgggagactggaggactcagcctgtcctgtagtcagataatgtacatggtttatttaaagagtcaaaaggggccgggcgcagtggctaacgcctgtaatcctagcactctgggaggctggggcgggtggatcacctgagctcaagagtttcagaccaatctggccaacatggtgaaaccctgtctctaccaaaaatacaaaaattagccgggtgtggtggtggacgcctgtaatcccagctacttgggaggctgaggcaggagaattgcttgaacctgggaagtggaggttgcagtgagctgagatcgtgccactgcactccagcctgggcaacaacaacgaaaactccgtctcaaaaaaaaaaaaaaaaaaaaagagtcaaaaggatcttggtccctgggttgggccactgatttacgatcactaggagttctcactcctaaatttctttgatctgttcgcttcgctccatctccacagctgctgcactggctacagcctcatgatctcacatcttaactctctctgctttctctggcccatctccccacttccaaaccatttgtcacgctgtaaccagtgcctaacacacaaaactaaccatgtctttcccctgcttaaagcccttagctcctgttgctcagtggaactggcgtctgaggctacctctccaagcctaagcgcctaagtcctgttgcaaccctcaggcccttcctcattatccacaccaaactcctcagtgtctgtaaaacaagccgagcaaccctcagaattatatgccttcgctgctcgtttgttttgtttttaggacagggtctcacgctgtcacccaggcaggagtgctgcagcgtgatctcagctcacagcagcctccgtctccggggctcaagaattctcacgccgcagcctcccgagtagctgggattacaggcacgggccaacacacccggctaattcttgtatttctagtagagacggggtttcgccatgttgcccagcctggtctccaactcctgagctcaagtaatccacctgcctcggcctctcaaagtgctgggattacaggtctgagccactgcacccagccagcctttgctgcttttgttcctgcaatttggaacactgtccccatcccagcctctcacctctacccctacctccttcactacctataccttcctatccatccttcaagaccccaaaaaccatccctgattccttcagaaaggcagtttattgcctatcttatcagactgaaagcagtggctgtgtcttatttatggttaattccctagaagctggactgatacattccatttaactaaaattcgtatcaggtgcttcggactgcagacaagcctatcacaacccagaaggaagaaacagggaaggcacctgggggctgccaagcaatgaggtggggggtaggaatcatgaatccgcatatttttaaaaactgccccagatcctgatgtaaacggtacaagagagtctgagaaacacagggctcccctcaaacagtcctgacttcagcattcctggaaaaatgaaaatcctttccttttgcctctaatgctttccctgctggtatcccaggttaaaaaaaaatagataaaatcagggggatttttctgggacttggctgggctgggaaacaagcctgggttctaatacaggctcagcccctgacgtactatgggcccctgcccctccttggggcctccattaccacggccacccccacccttatcaattgtgtgcccctgaggtagtgactgtcccgctctgagcattagtttccccatcttccactagtcgtcgtcagctctgacgctctatgagctatgcatacccgtagctccccgccgaccccgatggtcccctcccctccttcccaaggtccatccgccagggtgcagccgacgcactcctaatgctaaggccgccctctcatcgaccgccccttcctggcctcgactcagcgccaaaggtatgggtctctgccccgcctgctctttaagcctagccggggcggtcagcgcaagcgcactgggtcgcatcgaggccccgccccctgagcctgggtagcggcgcgagggccgggagaaccgttcgcggaggaaaggcgaactagtaggttggggcggccacggcggccggcatgggtcacgtttcctcgggaggaacgatgtgagggaggggtctggcaagagattggaattccggaggccgggagaccttgtggctgaaacccttcgtaggagcggggcaactagtgtctagtgagggggttgggctggcgcgcactgatcccagactttccggatcttctgcctttagatcgggccggtgtcggggcatgtaggccagtgagactggagccagttagagctacaacggggagcgattagggccaaactttgtccagggtggaagcgagcgggcccgtgaagtggggccagcctgggcagccgaccgtgtcgttgcctcggggcctttccaggcactggcctaagtcctggcgataaagtgcgaccgatttccttgtgggcgttttgaggctttcggtgatctgacccgtctgtcattcattcttcattcattcatgtgatgaatgaatacagtactaagcgcggctaattactaggtagagaagtgatcaagacaaacactgttcctacggtacagggaaaagtgatgggctgtagaatgtagaagcccggggcggagaacagggacagcttccggaacgaaatcgcgagcccagatcaggagtggtggcgagagttccaaagagaagacagcacgtgccaagtcctggaagggggacagaggccaacatatcctggtcactgaagacacctgactctgaatctgtttcacgcccagggaagagatgacagtggccggggctaggctacaaactctggaaatggagataaataaaggaattcaaagtactatatacttaggcagcaaaatccataggatttggggagagtgagatgtaggaaacaagtactcaaggcttgggtacctgggtggggttcatcagaggagaagcagatttgtgggagacaacaacaaattctattctggttgtatggagactcgcaggaaaaaattggatattctagtttgaaggtaggaaagtattgctgtgaagatgtagatttgaatgtcatcagcaaaacataaataaagccaagggagggttgaggctgtagaatgagaaaaacaaagggcccacttagcaccttcatctgatttcttttctttctttctttttttctttttttttttttttgacagagctttgctcttgttgcccaggctggagtgcaatggcacgatctcggctcactacaacctccacctcctgggttcaagctattctcctgcctcagcctcccaagtagctcggattacaggcatgcgccaccaggcccggctaattttgtatttttagtagagatggggtttctccatgttggtgaggctggtctcgaactcccgacctcgggtgatccgcctgcctcggcctcacaaagtgctgggattacacgagtgagccaccacacctggcccatggtgattatctttatgtcttatcctcctccatatccccagtacctagtcaagggagtggcattaaatgcaaatcagtgtttgccaactaaataaaagcccaacagcaaacagatgttggaatttcagagttgtggaacgatgggggctcatggagggtttcattactctaatgtcaaggtaatgggttcttgtcctggctctgccactaggcttctgtgtgacctctgacaagtctcctcctacctataaagagagtacagccaaaaaatggtctcatgtatagagcttcaaacactgctgataaatttcacactgatttttctcttttaatccacacagcaatcttacttgaaagggaagtcggctgggcggggtggctcacgcctgtaatcccagcactttgggaggccgagagtgggggatcacgagatcgagaccatcctggctaacacggtgaaaccccgtctctactaaaaatacaaaaaattagccgggcatggtggcaggtgcctgtagtcccagctactcgggaggctgaggcaggagaatggcatgaacccaggaggcggagcttgcagtgagccgagatcgtgcggctgcactccagcctgggcgacagagccagactccgtcaaaaaaaaaaaaaaagaaagaaagagggagggagagagagagaaagaaagaaaaagaaggaaggaaggaaggaaagaaggagggaagggaaagggaaagggaaaaggaaggaaggaaagaagggaaagggagaagtcgtattattatggactcaaacccaggtctgtctgtctgtctgacttgaaccttgttctttactatgattgccctcatgtatgtctcactcaacagggatattatcaggaccctcttgagatcacatgcgcattctttcaaagcattgtgctgaggctggcagactttcataattggcctggcactggctctgtcatggggacagggggacagagctgaatgtgatggaggtttcctattattctctaactcccttcctggggaccactgagttgggcaaccatgttctgttaaatggcaacagggcagaacaaaattagtgactgtgtttccagatttttacccagatcttaaactcctgaggcctgctgaaaaatgaatgagtatcagggtgtgagtttgtacacctctgtatgtctctgggcaaccaatcagacaacttctcctattacattggacacttgggtttcagcaatttccatcttgctaatgtgatttctcaaaaatattttctgtcttttggtgctttgatgataaatgtccatatatggaatgtagtcatttcctgctactaagattccttctggtttgtataagggaggagttcaccttattcgcatttcatggtattccacaaagagctccctcccccttcccatgtaatttatttgagatctgctgacatgagttgttggagcttgaagggaattaataatgtactgcagtgactcctatcccaggaaaacttgttaaaaatacaaagcctcggctgggygtgatggctcacgcctgtaatcccagtactttgggaggtcgaggcgtgtggatcacaaggtcagaagatcaagatcatcctggctaacacggtgaaaccccgtctctactaaaatacaaaaaattagccaggcgtggtggtgtgtgcctgtaatcccagctactcagggaggctgaggcgggagaattacttgaacccaggaggcggaggttgcagtgagccaagatcgagccactgaactccagcctaggcgactgagtgagactccatatcaaaaaaaaaaaaatacaaagcctcaacccctccttcccmtcaggcctcttgcatcagagtctctgggatggggcccaggaatctgtattctttcccagctccccagaatgttcagccaggtttggaaactgatctatccgattcttcttgtttcacagttagggaatctgtagctctgggaagggaaggaacttgccccagtcacatctgatattagtgcttctttctccaatgaagagcctttaggctgggagtncagagacatgggttcaagtccaggctataccagtcatcacctcgggcaagtcatttcacctctccaagcctctgcttccttactgtgagaataatgccattgtgttgggaatcaaaagagagagtggcaatggaaatgctttgtcaagctttctattttgtgcacatggaagttgttaagagctagaaccagccagtgttcactcctgtataccacgctgttcccttccaacagaggtcagggtcctgctgtgttgggggtggccgccagccagtttcggtggttgctgggcttcaggccatctgttaccaactctcttctctccatcttttgcaggtgttgggatggccaccaactgggggagcctcttgcaggataaacagcagctagaggagctggcacggcaggccgtggaccgggccctggctgagggagtattgctgaggacctcacaggagcccacttcctcggaggtaagcccctagctcctccccacagcattcaccatggcccactgtctggccccggccaggctgagggtcactcctttgcatcagggaccatatctcttttgccttattttttccagtaactaaaattgatctctagaagtagaaaataaaaaggcagtgtcctggagtaatcaaatttaaatatggggtttgaagtgtgacttaggcaaattacttaaccgctctcagctgcagtttcttcaggtgtaaaaatgggataataataggacctacctcactggtttggtaagagaattacaggatgattcatgtgaagcactttgcccagtgagctattactgaaaaccccataatcactctaccttctctgtaactggtttgtgatatatgctttcaagcctttctctgtgcatttatatacatagataggtatatatagaaatacgtcttttttaaaaaacaaattgtatcatatatattattctatgatatgtttttggttttttatttgtctgtcttagaactttctaatgccttctattagggtcatcttcattctgaggcatagtattccagatgtgggtgtatcacagtttagcttccctctactcatgtctatttaggtgatttctcattattttatgaccataaatagcattatagggaacatccatgcatatgtctgttggggcacctatgtgagtgtttctccaggttcaatacgtaaaagtagaactgctgagtccaaaccacacctttttaaaacctcatccttagggaagaaaaaaaaataaaaaaataaaatmttttttaatttggtgactaggtaagacattttcatggttcaaattcaaatggtacaagagtttaccctaatgcagcttgtgttttggtttcttgttgatcctttcagatggcttattcataacaagtaactaataacaagtaaatatattccttggggcctcgctctgttgcccaggctggagtgtagtggcacaatctyggctcactgcaacctcygcctcctgggttcaagcaattctcccacctcagcctcccaagtagctgggactacaggcatgtgccactacgcctggctaattttttttttttttttggtagggacagggtttcaccatgttgtccaggctggtctcaaactcctgacttcaagtgatccactggcctctgccccccaaaattgctgggattacaggtgtgaaccaccgtgcccagcctccttttgcccacttttttttctttaacttaacagtacaccttaagaccatattggtgactaaagagctgccaacatctcttctttttttagccagacccattcttttttgtctctgtgtgcccagaacctacacaggcctgatggagtccacactcagtaattgtttgctaaggcccaagtaaatgacaatgtctgtcacctaaggcaggctgatggtatggaatagaattgcttgggctgtgaacctagattttgtgaattacttgtatgaatctaaaatgaagcattttctcttccacgcttttgtttcttctgttaatcaataggtaccatgtgaagatccaacacttggtctttctgggaggttatggagcctagaaaaggcgtaatccacaatgagatttctaatccagaaaaaaagtcagaaagtgtacgtgtgtgtgtatgtgtgtgtgtgtgtgtgtgtgagagagagagagagagaatgattttactccaaatctttaccaaatgcctgctctatgccgggccattgtaggcactgaggacagagaggtgagtcagccagagccctagcctctggggctcctggtctagttagagaacataccacaaaacaaaattaaataacatcagctctatgaggaaacacaggcagtctgctacacaaagttaactatcatttattgagtatttagtatgtgccaggcattattctaaacactttggaatcactgactcctcaccacaacagagataaggaaaccgaagcccagagaggctaagtaacctacctgaggttatttaaatggtaaaataattggcagagccaggatgtgaacccaaggaatttggctcctgagtccatgctctgaacatccatgctttttttcctctcccaagatactatataggacagctggaagaaagagtagttcattatgattagatgattgagatggggggtggtatttgaactagaccttaaaagacaaatagggaaaaggaacagcatagcaaggacccaaaagtaggaaaaggcaaaaaaaaaaaaaaaatgttcaagagaatgcagctgaaatgcagggcgcataagtggatatagtgggaaagaaggcaggccagcgtcagacagccgcggggccttagctactgggtggaggaggagtatgaactttatcctgtagatcagagctgcaaactagccatatctaggctgagtatttggctcctgcagtgtttggggagttaatttgttttttacaataagtaatacgttcaaatacatttgaacagggcgcaaaattcaaaagggtattcagtacagagtaagtccccttcctccagccactgtttccctgaccaggggcaagcattgttaacagttgttttcaccagagtatttttaaaaagtcagagccaacatttaaaaaaaaaaatcatgaaattaaaacaaaaaatctagcaacccaacttgtcttgaaaaattatatcatctggcaactctggcctactttcctgcatggcaacaattggctagagcagagttctggctgccccctttagagaagatgcaagtacttctttttgccacaattcctatcactccctgttgcttcctggctacaaagcagaattttgtcatgcacgtgctataggtttttttaaatagtagaaaaatgtttctttttttttttttgagacagagtctcactctgtcgccaggctggagtgcagtggcacgatctcagctcactgcaacctctgcctcctgggttcaagcgattctcctgcctcagcctccagagcagctgggactacgggtgtgtgccaccacgcccagctaatttttgtatttttagtagagatggggtttcaccatgttggccaggatggtctcgatctcttgatcttgtgatctgcccgcctcggcctcccaaagtgctgggattacaggcatgagccaccgtgcccggccagtaatgtcattttatgttaatgtctctatcaaaagtgagaagactgtgtgtttcagcctttagcctgtagatagcagagaacagctataaactattgatcctaaattcaggagggcataatgagccctgggacagaggcagagggatgtcttagcagaaaaactctgagtttttgaggccaagatgagacttgttgggggcagcagagctctatgtgttcaagccaaggaaatgctcctgtagtcatcacatagctactcagggtattaggtcaccccttatgtaatctgcagtcattcccattctaactcataaaggcttcagactgaataaaccttattctcacaaatagccttcctcagttttatcttagatgctgaggccagggcagtggtacacacctgcagtctcagctactggggaggctgagacaggaggattgcttgagcccaggaatttgaggctatagtgcactatgatggcacctatgaatagccactgtattccagtctgggcaacatagtaagaccccactccaaaaaaaaaaaaaaaagatgctgagaagggtaatttagaaattatctaccaaaatttaaaatagatttacctgaattacttgatatttttacttttagaaatttagaatgtatggactttctcatatatgaaaatatctagaatgtatattctaggatacccattgaaacattaatggtaataggaaaataaagaaaccacctatatactagattcaataaattatggtatatcctaagagtagaataatatacagcaattaaaaataatgaaaatgctctatttgaacatataaggaaatatttaaaaagcacaatgtagtatagtttgctatgggggtgaaaaaaagagaaaatatatgtgtatacatatatatcaatacaaagatgactggaaggatgtgtgagacactagtctgtcatttgcctctggggaggagaactgggtggctggggcccagtcttttccccaggagactggaatgagagtgagacatacttctcactatatattcttatgtctcttttgaattttgtatcatgtatttgtattacctgttaaaaaaataataatattttggctgggcatggtggctcatgcctgtaatcccaacactttgggaggctgaggcaggcagatcacttgaggccaggtgtttgagaccagcctggacaacacagtgaaaccccatctctactaaaaatacaaaaattacctgggtgtggtggcacacacctgtagtctcagctacttgggaggctgaggcaggagaattgcttgaacccaggagatggaggttgcagtgagccgagattgtaccactgcactccagcctgggcaacagagtgagactctacctcaaaaaaaaaaatagtactttaaaaataaatatctaaataccaagttctaacaccgtaaacttataccaccataatgacaaactgatattaactcaaaggttaaactcaggaatgctttataatacaagtcacaagattttcttttcatctcttacccaagttctagttcagttgttggcagggatctcagaatgcacttttcccttctagaatcagtgtccttgatggtatttgggtttctcgtctatgataaagtccaaagaatgcggaatgcagctgaactctaggcctgttaacctgagtcaccatcactaacattggtggaaaaaacactcctggcttctactaagggaaccagagttcacttgtcctacccagtaaccaaatcaaaatcaaaaggcaaggaaactggagtgtgagctcctgatgcatggaagggcctgggcttgaacatcaaccagcaaggagcaggcttccatgtatgtatgtgtgtgttgtgtttagtaaccatcctggttcaaatcccagcaccccgttactagctgaatataattttggatctgttaactgttctggttcaaatcccagcaccagttcctagctgaatataattttggatctgttaacctctctttctcaggtcccgtctctgttaagtgtggataataatagtatcttcctcacagggctgaatgatgaatctatgtaaagtatttaaaatagtaccttgcacatagtaagtgctcaataacttgtgggtttctttttgttatttgcattttgcttttttgcttctctctcttcaatacgtagagataaactatcacagaatctggaagctctctgggttccactctcccccttccactctcccaaggtaaccactaatctacagttggtgtgtcctcagtaaatataggccagactttccatgggattccatttgcaggaagacaacccgttcacaggtgccctacccctgtcccattctctcttcttgatcacaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccaggtaggggacagtgaagcatngggggrccaggagctgccagagccaaggaactggaagattgcagagccgtgaggtgttactgtgtcagctgacttggtgggatagaggaaaggtacctccaaagaacaaaaagtcataggagtcaggaaagctggcttctaatcctggctcgaccagttatttatatggcctcaagccactccctttccttctctgggcctaaggtttcttcatctgaaaaatgaagagactggcttaaatccaagatccctttattgttgacattctgtaatccgtgacaccctactttgaagactgatatttccatttggaattaggggaagtcagcctggttttggaggaaaacagaggtagggaaggttattgggttaaagtcagattttctacttctcctaagcagcgacactttcttgtcacctcaggcctctcatctttggatgggatggggtacagactgggccacactcagggcatgaggaagcaacctctgaaatggttcagcccatccgcccttctctgtctctttcccttgatctttttttttttttcttcagattctggggcaatttcttaaaatttctttatttattttagaattaaatatatataggctgggcgcggtggctcaggcctgtaatcccagcactttgggaggccgaggtgggtggatcacttaaggtcaggagtttgagaccagcctggccaacatggtgaaaccccgtctctactaaaaatataaaaaaattagctgggtgtggtggcgggtgcctataatcccagctacttgggaggctgaggcaggagaatcgcttgaacccaggaggcagaggctgcagtaagccaagatcacgacactgtactccagcctgggcgacagagcgagactccatctcaaaaaaaaagaaataataatacatatatatatgtatatatattcattgtagaattaaatatctagaaatattatgtatttacatatacatgctagatgtgtatatactgtacaggttgagcatccctaatccaaaaatccaaaagctgaaatgctccaaaattcaaaacttgttgaacaccacatgactctaccagtggaaaacgccacgcctgatgtcatgtgacaggtgcagtcaaaacacagtcaaaagtttgtttcatgcacaaaattaattaaaatattgtataaaataatcttcaggctatgagtataaggtgtatatgaaacaaatgaattttgtgtttagacttgagtcccatccccaagatgtctcattacgtatatgcaaatcttccaaaatccgaaagacttctggtcccaagcatttcggataagggatatccaacctgtaattgcatgtctttgattaatttttcaacagaaattagacttttgttggagacaaaatcttttaaaaatgtgtgggtgaatatgagaaggggtcataatggtaagaagcttggaaaccattgacttgtagccaaaaacccaatgagtcatgaatgtatgaatctgcccaccaccttgcccctgagctgtttcttggaatgggcccagctttgtacctgcaatcctggattgtgggaaacatgagcagcctggcttataaccctaatgatgcaattatgaaggagacttgcagctcatctttgcaacccctgccttctctgttcctctctcctctcatacacatataaaccctagttcctaagggagaagagccccctacaaaacatgaaggggagcacctcttcagaaaaaggaaagtgtgtctcaacttccttggaggctgaagcccagctgggactctcctcctaaccaagggctggcatgagagagctcacccttgggagagagctggctgaggagcagaggaacttcagggcaggcctgggctacttggcttccccccactggtctgctgtgacgtttctgtaacaaggtgattcaggcttgagcaggtgtgcagaatccaccctgaatctcaaagggcagtaagtgtgatgttaatcacctgtggattccttcttactgtggctcttgttgagacttcagaaaaccatactggataggcccctaacacatgtcacatgtcatggcagtacactgagctgtgacgatgagcctgcatagacacagccattaccttcatgaggtttatagtcaaacaggagagatgacactaatcatcacacaaagaaaatgtaaaattgcaactgcagtcagtgctgtaaaggagtggttcttagttctatgagaacacatagtagggggatctgactcagatagggaaggcttccctgaggaaatcacatcatatgaggactagttgaagaagaaacaaacaaacaaaaaaaacccaggatatttagcttgggtcagaaaaatcttattggtgcacagggcataactgctgtcttctaatctccaagggctgctgtggaggaggaggagaaggctcaccctgggaggtcgcagagggtaggaaaagctatggagagttagtattaggtcaaccagaaggcttgccaaccatcagagctattcaagtagaatagatacatcatgtcattttctagctcttcttcggtgcagtatgttcaattctttgaatgtaatatcttattggctttttaccacaactctatgatataaatataattatattctccattttaaagatcagcaaactgagacacagagaggtgaaatgattccctgaggttgcctactagtgagtggtagagctaggatttgaacccaggtctagagttggattcttagccactgttctctaccacattggggcggacattcaagttttggccagtagactcagagaggattcaggagtcaatgactgaggatgggactccttgaaattttaggtccaattaagcctgcaaaatgttctctgtttcttcctccagcaccatcaaacaggatgactttaccgctcgtctctttgacatccacaagcaagtcctaaaagagggcattgcccaggtaaccattcccagccctactccagtctgtaacctgtccctcccatctctgtttgttttctgttttgcttgaagaatttggtccaggccctcagctcatgggaatctgcctctcactggtcctcactgggtttatcccagtgaccaattctaggatgaccagaagaatgattccactgggcttgggagtgtttgctggtacctctaatctctgtgtagagttcatggtacctgtgtgctctgtggctaggtcctcagagtcagtccctgggcaggtactgtcagccttcagttttccccacagactgtgttcctgggcctgaatcgctcagactacatgttccagcgcagcgcagatggctccccagccctgaaacagatcgaaatcaacaccatctctgccagctttgggggcctggcctcccggaccccagctgtgcaccggtgggtcccctgggcagcccccggcatacctgtggggtgacatgctgatgggtgtacagtcactggctaggccagggaactccagctatgattgtgctttcctgggccccgggtcacatgttgcccctggccaccccgacagcagtttccacttgtaatgagatccttggtatgtcagggagaaaaaggacctcatagctcatctagtcctgtccctccattgtacaggcagagggaacaatatcttgagagccccagagagaggaatgcagggacttctgtctgggggctgggcctggtagcatccatttctagccagcagtgatgctccaggttgcaatgattttagatggtctgcagcaggattccagacagcacctggaggcccagagtaaggggctccagctcactgggacactagggtaggttggggtggggacagaggctctcaggtctcctccaggcatatacaccaggggccaaggttagggcagcccagcatattccaacctgaagtggatcttkcaggaatgtgatgggaggatgctttttagtgctcagctgattctcagagtcatgttgctgtatatatgaggtcatgggcagaggggtcttccaggtccatccaattactgaacagccatctctcttccaacagacatgttctcagtgtcctgagtaagaccaaagaagctggcaagatcctctctaataatcccagcaagggactggccctgggaattgccaaagcctgggagctctacggctcacccaagtaagggtgtgaaaaggtagcaggaggatcctgctttagtttcagcattcatgggtttagcaacttcttttcttgccagccatcattagagaataaggggatttttctaggaatagaaacttatacctttacatgccaaaattattttaaggtttccttcttaaataacagatgctgactatgatttaactttttcttattgagtggaggtcatcattatgactgtcaacaattgcagcttgctgtaatacagtagtgctacctagggttagagaggcacgcaaggctgtttgcctgcgctaatagctctgactgctaggctttaagttcttagtcatttccttttttttttttttttgagacagagtctcactctctcacccaggctggagtgcagtggtacaatcttggcttacttcaacctccacctcccgggttcaagcaattcttctgcctcagcctcctgagtagctgggatttcaggcgcatgctgccacacctggctaatttttgtatttttagtagagacggggtttcaccatgttggtcatgctggtctcgaactcctgacctcgtgatccgcccaccttggcctcccaaagtgctgggattacaggcatgagccactgcacccggcctctcattcattttcttcatagttttcttgtctgtttcccaattctcagctcttacttttgactgctgttggtatgcttgaatttggaatcctccaccccccatgcccatgcctcccttctgatttgctgtggtttgggaaaacaaatgatccagattgttatgattgggtctgaagagtgtgagggcctcttggatgagtaaatgcataagctttgactacgaaattttatggtatcctttttaactgcttagaggcattttttgctttcttcctatttctcaagtgaagatgttaggtaagtgattttcagatcatcgaggggccgctatactaacagttattgcaatgttaatatagcattaatagtccttaatgtacacttactagtgctacaccttgtgctaagctctgtacatacaggatctcattgaattctcataataagctctctgaggtcaatactgttcaactccctcattttacagatgaggaaactgaggttctgagaaacgaagtgaattgttaaggctaagtgatgagttggtggcagatcccaaagtctacctccctctaaaacctccactcttaatcatgctcttacctccaagggagcctctctgtccttgctaagcctcactaagcccaaagaaacctcagactgtaagcatttagaagtcatcagacaaatattctttcaagtatattggctaggttgtattttaagagagtgaagccaggggatgggtcagctggggaactgctgacagacaaatgctgcagagggttttgcctgccagcctgtcagtaacgtggacagaaaatacttgtgtgtccaaaattaggcactggtaggtaggagttatgtggcacctgagccagaactggcttcccccattgtgagagtgagataggttcttctgctgacatagcacatgaccttggcaagttagttcttctctgagcttcagtttcctcatttgtaaaataggagtaataataatacctaaaggggtgttagtgagaattaaatgagatcayggatctgaaaaatgtttttaaaaatctgtgtggatcattatgtggtactttcaataataataataggccgggtgcagtggctcacacctctaatcccagcactttgggagaccgaggcgggtggatcatcagaggtcaggagttcaaggccagcctggccaacatggtgaaaccttgtctctactaaaaaatacaaaaattagccaggcatggtggcaggcacctgtagtcccagctacttgggatgctgaggcaggagaatcacttgaacccgggaggtggaagttgcagtggccaagatcaccccactgcactccagcctgggcgacagagcgagactccatctcaaaaaaaaaaaaaacaaaaaacaaacccaaataataataataatagctatcatttgacaagtattagttttaattcatacaacagcaaactgaggctaagagagtttgaataacttgcccaaagttacacaaccggtaagtatagaattcatctgcctctaaagcctatgttctctctacttccctattctgcctttaagagatatggttccacagtattgactgaaaaactgcattggtagagcagattaattttcgtcaattatctcatgatttttaaaatttcttaaaaatggaagcctgcaaaatgacttacaatttcaatttagacaaactctcaaagcatagggcctgtggttagaatgagtagaataagaaaaggggactactggtgataaaagtttgggaactgtgatctttttaacaccaatttttttctttttttttgagacagagtttcgtttttgttgcccaggctggagtgcaatggcacgatctcggctcactacatcctccaccttccaggttcaagggattttcctgccttagcctcccaagtaactgggattacaggtgcccaccaccacgcctggctaattttgtatttttagtagaaacggggtttctccatgttggtcaggctggtctcaaactcccgacctcaggcaatccgcccgcctcggcctcttaaagtgctgggactataggcgtgagctaccatgcccagccataacactcttattttatagatgggaaaaccagggcccaaggaacgaaattgccttacccaagtcaattaccaagacacactacaagtcactggcagagcctggactacctacgactcaggggtcctcacccccagcccgcatgcgtccttagctgacaactttcctactaggaaacagactgctgagaactgctcagaactgaaggcaggagaggtcaaatatgttttctgagcccagctctgattgtttagcagttggcaggctgacttaattagctggggcgtgcagttcctctttaacctccagctgccagccttcctcctccgcctctttttggaggtgggccagcctgggccaactgcctccctcccacacacaccctcacccatgagcgggacagtttaggctgcaaagtgaagagcaaagccattggcccttaggactctctcagggcaagatgacttgtgagagcaccacttttagtttgtctctcaggcacccaactcaaagccaagactcagcttaacatcacatctgacctcatgagatttcaggcaaaccaggagaggggacttactaagacctatattttggctaagcagaaaggagtcaggcaaacagagtttagactaagaggttcagccaaggtcaggagaagcagagatagacaagagaggctaagcagaggaggtcagggaatacacacttagaatcctaagccaaagcctagggttccatgggtctcaggaagaagccacagacacaaagcagtacagtcacagcaaaaatggagtttggaggctgagcgcagtggctcacacctgtaatgctaacactttgggaggccgaggcgggcagatcacctgaggtcaggagttcgagcccagcctggccaacatggtgaaaccccatctctactcaaactacaaaaattagccggcgggggtggtgcacacctgaaatcccagctacccgggaggctgaagcaggagaatcgctggaacccagggggtggaggttgcagtgagcctagattgtgccactgcactccagcctgggcaacagggggagactccgtctcaaaaaaataaataaaataaaatgtaaaagaaaaaaaatgcagtttggtactgctgagcattagccctaggaatctcttaggggactggacctatctttgacaacggaaatatgttagctggcagccaaacagatagttccctggcataagcttttccctgagccctcaagcccctgcctctttaagaaatacatgaataatcagagaggaagaagccacataagccctagtgatctcattaatactatgagatcaaatgtggccctgtgtacattataggaatcttgggagggcccaggagataatgtcgttgtttgtagttggccctgtgggtttctgtagggttccatcttgtgtaagaaccacattcctttattgtatcctttacaatctagtaatagagccattagccccggaccccctgcattgttcttttacaaaatgttcctcaatactcccacttgtttattcttccagaaagattttagaattatgttaagttctaagaaaaagtcctcttgggtttttgagatggttttaaatctaaattttaatttgcacagaaattcatcaacccatgacatcattacaatatttcatctgcccactggagaagggtcagaggcatcttcatttttgaagttttctattttcaggaaatcatatgtgatagcatcaggtgtctatgcctgaggtaatctcaaggttcctgagagagggaacatctgttctttcagggaagcggtgttcttattcttattccaggaggtggggcggtatgggggttgaggggagaaacaaaagaagaacaagttctatagtagcctygggccacctgtgctctttccccagtgctctggtgctactgattgctcaagagaaggaaagaaacatatttgaccagcgtgccatagagaatgagctactggccaggtaagtaaaggaagggggacttctaggtgtggctccaggattaggggtggggcactcagaacatagcatccattccctctggctcttgcccatttttcccaggaacatccatgtgatccgacgaacatttgaagatatctctgaaaaggggtctctggaccaagaccgaaggctgtttgtgtaagcattcccaagaatccagtggaaggctggtttatgaaactcatcctgccaccctcttccccaaaatgattctttcttctgggagatgtgatggcttgcttccttctctcataattcctgaaatatctcatcctcccaggaaattttggagaaagccagccacgctgtgcttctatcagagctgttgacattctggatcagggtctccttagagatcatcttagttttcatatgccctaagttcccaaaagttttcttgcctctcctagtaaggtgaggtcaggcctgagaagctgagctgggcagtcagggaggaagaggagcagctggctcatgctgtgattggtctggatgccactgtctgagctcgagcctggatttgtgttccaagccaagccttatccttttctctaggggccaccaccaggtagatttggtgctacatatttgggtagcattgcagcacatatatttagacctagacctttgtgattgttaaaattaaaactgtccatggaatttcacaataccactcactgtttttcaaaatgtgcttttatcataactaaacaaagtagttaatttacttttcagataaactagacaatatcaaataggtcaaagaaaaggaaaagacatttaaaaagcctgtgtcttaatcagactcatcattttacatgtttgcgttttcaccttcacccctgccattaaaaattttttcaktctggtttcagctgctttaagcagtggaaatataaagtgtgttttactacacatggcagtatgattctgctgctcggtaatttcgagccaacatttgtatgcatttaccaaatttgattctagtgaccttcttgttccttctggccttcttagaatgactctaaatctggcatattctaaagtattctgtatggcacacctccctgttttcagtggaagccctggtagtgtggatatctactttcactggttccagtgaacccctgaccaggctcccactgtgggctgaattttgaaaaagccaaattcatcttgatgcaccctgaaatagattgaaccactgaacaaatcagttataatttaacacagcagccttctccatcctgtgttccagggatggccaggaaattgctgtggtttacttccgggatggctacatgcctcgtcagtacagtctacaggttggtattttctgtgagaccattctttgcctcctgggacccacaagagctccacagagacccaattcaggcttataacaacctgggttttcygagtcctcacttcacttctttctcagggagcttgctgctagaacctcctatcctccctcaagccttttgctacctatcactctacacagtcttctagaatttgaatcctcaggaatccacagagcttcagmcatttacactgtttccagagatgtgctggcaaatgtttaacaacaatcagctctcactggttgatataagccagttccagcatactgctgaccattttttttcctgccaactcttacctttcctttatctgaatcagaaagttttatcatctcctcattcatgttaatgacagttatatcacctcattttgctatcctaccatgtagtttcattagtttccacatccattatttcatttaaccctcacaaccactcggtgaggcatataattatccccattatacngatggagaaactaacgtttagagagatggagaggcttctctaaggccctacaggaagttcccaggttttctgactttcaggccgatggtattcccattcttctcctctgctcctaacatccacatcatggagaggctaagaagctctgctctcagctgggagatgataaaggaggaaataagtttagaaataccatgggcagtgagctggaggtcatgagcttgactgcctctgtgtgatgatgggcaagttcctgaccctttctaggtctgtttctatgagcggggggagctacactagaaaactgagggggctccttctaggtctgtaattcatctaggactccccccgagggttgagctccacatgaggaggctctatagaggtggtatctcgatagaacatccttttctttagataggtggttagcagtggtggcaacttgctgactacaggagagataaactgtctattagaaaaataggtctaggccgggcacggtggttcacgcctataatcccagcactttgggaggccaaggcaggtggattacctgaggtcaggagttcaagaccagcctggccaacatggtgaaaccccgtctctactaaaaatacaaaaattagccgggcgtggtggcatacccctgtaatcccagctactcaggacgctgaggcaggagaattgcttgagcccgggaggcagaggttgcagtaagttgagatcatgccactgcactccagcctggctgacagagcgagactctgtctcaaaaaaaaaaaaaagaaatgggtctagatttcaaaacacgacaaagaaaacttagaagagtttgagataacaaggaaggaaagtagtgtttaaagaggtagacttttttttttttttgagacagagttttgctcttgttgaccaggctggagtacagtggtgcgatctcggctcactgcaacctttgacttccagtttcaagcgattctcctgcctcggcctcctgagtagctgggattacaggcacccaccaccacacccagctaatttttgtatttttaatagagacagggtttcaccatgttggccaggctggtctcgaactcctgaccttacgatccacccaccttggcctcccaaagtgctgggattacaggtgttagccaccacacctggccaagaggtagacatttttagggaactgagcagctcagagcaggtttagacatggagagagatctagaaggcttagtgacttactagatgaccctgggcaagtccttgcttatctttggttttgctttcctgcttctaccataatggggtatttctctgggtttatttctgatgttctggtcacgtgtgattctgcgtggaatgccagactagtagttgggttcctggggttattgatgaagatcaggtcaaggtgctacaggtggaccagtagtatcaaaggaaggacagcattgggtgggggtcacaggagagacctgatcctgctgtgtgcagtttgcagtggtctggagccaaggacagactgtctccccattgcatgagaatgggaaccagagttgggaggcatgatcccctgctgtttccttgccttttataccctcagctcttgtggtaataaaccattcatcctgtgatcatccacttgagacctgtgttcatattattctcttagcctgagtatcccttccctattgagtctcacttgtcaggctctacctgtccttcagaaccccactcaaatttcaacttattcagcaacaacaacaaatatttattgagcaactacaaagtgccaggaactgtgttagacactggagatacaacagaaaatgaggaaaatgataagagccctgtgctatggagctcacagtctggtcagagaaatgggcatcagaaagtaaacaaaaatatggccatttactgtggctcgtacctgtaatcccagcactttgggaggcctaggtaggtggattgcatgagctcaggagttcaagaccagcctgggcaacatggcaaaaccccatctctacaaataatacaaaaattagctgggtgtgktggcrtgcacctgtagtcccagctacttgggaggctgaggagggaggatcacttgagcccaggaggtagaagttgcagtgagccaagattgcgctgttgcactccagtctgggtgacagagcaagacccacgtctcaaaagaaaaaaaaagtaaacaaaaataggaaaaaaaaattgggatttgtgtgtgtatgtttgtgtgcgtgtgcgtgtatgtgtgcatgtgtgtgttttagtctcaggtaactgctttcaatgaaacaactgggtaaaaagagaattatgggaaatccacattaaatagagtggacagggaagccttctctgaaaaggtgacattgagctgagatgtaaggatggtaaggatccagctatgcatgggaaaagccgaaaggaagggggtttcaggttgagggaaaagcagtgcaggccctgaggagggaaagagctttgtgatttgaggaatgacaggcctgtgtgrgtagaatggcagagactaggagtcagggatggtacaaggttgaaaaagtagacaggagccagctcctgaaggatcttgaaggccatggtagggagtatggaacacagtgggaagctgagcacgtagacaaatgttctacccttacaccttctattgtttcccacagattgggggattcttgcctttgcaggggctcacagtctggcacaatgatacataactacaacatatcacacctggctcacaaggatgttagaatgatcctgggtgataatgagggtgaagatacaaatcatgatacctggcacctaatggatggatgttcagtaaacgtcagctgaagtaaaataaagtcgaattccttttgtcttcttccctctgcagaattgggaagcacgtctactgctggagaggtcacatgctgccaagtgcccagacattgccacccagctggctgggactaagaaggtgcagcaggagctaagcaggccgggcatgctggagatgttgctccctggccagyctgaggctgtggcccgcctccgcgccacctttgctggcctctactcactggatgtggtacgtgggcagcctgtttctcctaccacaggcctcctaggtggcagagacctacagcccaatgtgttggggagggtggagctggcattgtgacaaggggaaggtggagctggcaaggttggtgatgctctggagaacccctagaactctgagcagaagggcagcctcataatggaaggatgggggctggaatccattgtaagctccctcagcaaaggtagagatgaggatggcaaccagagggaagggactaaggcaggtggcaagaattgagaagtgtatcaggctgcctgctgcagagccctgagctgttgctaaagaaaggcctgttctcattgcatcggctgctgcagggggtttgttgggagtgtcatccagatagtagcatcctgcctgaaggaatttgtggctgttctccctcctgctcttcctctgatgctgctctgcataaccagctggacctaagcttcttgcctctttagcctttaaacttttgataactgctttctgcctcctgccagggtgaagaaggggaccaggccatcgccgaggcccttgctgcccctagccggtttgtgctaaagccccagagagagggtggaggtaggtggatctccctttgcagggctcctcaatgagagggactagcaggctgtggccagtgctcattggcacttactctgggcacagtcccgggcatgggggaaactattggaactgacacaggccacatgttggacagtgtcccctaagaccctgtgaccaagtccgggagcacaggggaatctgattaaccagcattgaagggtttggacaagttttacctgaggtgcctgtgggtagattgttgggaagtagagtagggtcatattaggagactggagagaatacatgtctgttttcctttctagtttgaaactccttgaggtcaggggtcatgtctgcctctccagaggagaggatttttttaatctttgtcttaagaggtgggtaggaatttcccaggtggaaaggaggaagagtgttccatacaaaagggacaacctcaagccaaggcaccgggccatgaaagtgtgagatgtttggaggttaatgagaaactggtgaggctggagggggagctgggaggggacagggatttaggctggaaaaatggtttgcatcctgattataaagggccttgaatatatactgagaaattggattttatcttaagggcagtgggaagccattagggagttttaagccaggaagggacacattgatccaggactcaagtggttagcagtggtgggaacttgcaaaacttacagtttctgcattgtagaagatgtcctggaatgaggggagacactggaagcagaaagaccgtggaagaggctgatacarttgttcagaagagcaacgtagaggcctgggctagggctatgactatggggccaactggagagacatgtcctagatagtgagagggtagtggaagggaggagttaaatatgactcaggggtaccttttgcctgattgggagtaggaaggtccaggaggggcaggttcaggcagaagtaataagttctgcttggacaagttgagtttgtttgggggccagtcatatgatgtctaagcagggagcctgcattaaatatttggaagttaacaattttttttttttttttgagacggattctcgctctgtcaccaggctggagtgcagtggcatgatcttggctcactgcaaccactgcctcccaggttcaagcgattctcctgcctcagcctcctgagtagctgggactacaggtgtgcgccaccacacccagctaatttttgtatttttagtagagatggggtttcatcatattggccaggatggtctcaatctcttgacctcatgatctgcctgcctcggcctcccaaagtgctgggattacaggcgtgagccaccatgcccggccggaagttaacaatttttagggtatagatggagactcaggaataggagagatctccttgggaaaatgtacatgggggagagagcaagcgtggaggaccaattcccctgggaccccagcatttaagagaaggagccagcaatggagcttgagaaggaacagctgtaggtaggaggagaaccagggcagaacagtgtagtggaagatgtgttcactgcatgagtaagggctctcctgtcaaagtgagcttccctcctgagaagccagatatgccctggcttcactgagcgggtgccaggaactgaggctgctgacttgcccatgtggccccaaaagtgagggcatgggatggaggaggtaggcagagggtccagggtgactggccagtttcattgcaggtaacaacctatatggggaggaaatggtacaggccctgaaacagctgaaggacagtgaggagagggcctcctacatcctcatggagaagatcgaacctgagccttttgagaattgcctgctacggcctggcagccctgcccgagtggtccagtgcatttcagagctgggcatctttggggtctatgtcaggtgagccaatcaggagaagctctttccactacctgcttgcaagagtgccagccaagtgagccagcctagaggggaacactggaaagagtcaggaatcctgggcttcggtgccagctctgccaatcactagctttattacctgtttctttatctattaaatgaggccaaggacccaagacctgcccacctnaccagggtatcagatgaagccctgatgagaagtcctttgcaaccgtgaaggaaactccaaatagcaccaagaggactcagaacacatggtttgacaacctaggactagaaggagactccagagaggcatagagactctaaaatcctagcactttcttggtatagacagttacccaggtactgctcagctgggtccagggaaggtcctgggtttggggctgagtccaggtgatgtgtgtcccctgcctccatttctataggcaggaaaagacactcgtgatgaacaagcacgtggggcatctacttcgaaccaaagccatcgagcatgcagatggtggtgtggcagcgggagtggcagtcctggacaacccataccctgtgtgagggcacaaccaggccacgggaccttctatcctctgtatttgtcattcctctcctagccctcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctyatcagccttttcagcaggttccagtgcctgacttgggataggactgagtggtaggaggagggggagtggaggggcatagcctttccctaattctgccttaaataaaactgcattgctgattcagtgatgattccttacttcgtgcatagaggggaggcgggagctgtaatctacgttagcccacttaagatgtattagagcagggaagtgactggtctgtaatcagggtccccctagaccagtctctacaggtggaaccctgaagtttcaatccttagccacccactaatgctcttactggatcacagggaggaatgagagtccctggcaggagcccaggagggaaggcaaccaagatgggacatacataacagttgtgaactggcttcagtcactttcctgcttagctcaggggcttgtcaaaggccctgtcagtgaagcctccttcgctctgcccaaaccaaaagttctagaaggaagatattggggatagtcctaggaaatacccctcccttcccatctgccacacaaatcagagccactaatgaatatacagcctcagggcacagatacctaagaaaacaagtcaccacttcttgagatcacaggctttattcctacaaccacagggcttgagcctgactggggcaagaaaacagagtttcatctgagaatgtctcttatgggctgggttctgttcaggggagggtgggaacagaggacaaggaagacaagctcctctggccctaggaacaaaacacatttactccttcaaagaagcagatgatctgaataccctctggagactgaatctgcccatacagcccctggagccaatgggcagacagtactggcatctggcacaaaagggaattcagacccagaacagaagcagcaaaatattttaaaaatagtaaattgttcctggactcacaaatcattgtttttaagggcaagtgcatgcccaatataagtactggggcttcctaagagagctgacataggattacacagctgcctccctgcttcagtggaggccctcacatcccctttgaacacttaacttgggtaggagaggtagccttttcgtctctgttctgggttctgagagctctgcagtctggaggcacagcagactgaggctgacctgggccctgtcctttctgcctggcagtcacaggatgttgtctctacctggagacaaagctggtttccggtcccagacagctggtcaagggagggtagtgtgggtcaacactggccctcagcactcctgagggggcaaagaggatgggcaaagtttggagcaggaggaatcctaggtaaaggtcaggatcatgttcactggatggtcaggcagcggtggctgaagaggtgactgatgacagatgggtcagccacagtagacatgtccccgaggtcatggtcattctgagcaatcttccgaagcactcgcctcatgattttccctggggaaccacagacctctagttacttggtgaaagcactgacccaccctagccctgccaaaggctttcatccacgcacaccccaccaccaccaggcctcagcccatcccaatccatggaggcctctgaacatacctgagcgggttttaggcaagccaggtgcattctggatgtagtctggtgtggcaatggggccaatcttttctctaactgtaaccaacaaatcatcaagcatttcttcagcacccttagccagacttttcaaaaatcaaagtagagatggctttgttccccacctgtttcctcctcaagtccctgcccacagagacagcctcaggttcactgcttctcttgctctcaacacacttgtctctttactctctcattttatcttatggaactcaggctgtagaatgagcctgctagagtttaaatgccacctttctagcagtgtggccttgggcaagtgatttaacttccatgagtctcagtttcatcatctttagcatgaaggtaacaataagatctgtttcatggaggtgactctagggattaagtggggtaattcatttaaagcacttagcctagcggtggcacaaagtattctagaaatgttggctattattattatcctagtgggagactagtggagactgaacaggaagagggcaatcagcccatggggccccctggaatctgtttgtggtttggggagcagcttgctctagcccctccccaacaacttgcagtgataactgggcctccaagacagaccctatagtccctgcccagggaggctccttactctgcttcttgagctcctcggtgagcttggggctgaaggtgtggccatcacacaaggtgacaaagcagtagaggcattcacccttcacaggatgagggtggcccaccacagctgcctctgcaacagcctcatgttccacaagtgctgactccacctctgctgtactcagcaggtgtccttgtcaagggaaaggaagtgccatgagagagatcccaggctctgccccagcccatgctccatctgtacccatggggcagtcctggtctggccaaatggagaagacccttcattcactcctcagatgacatgctttcagtcaccccaccatccaagttcccctactctaggcacattccagtgttcattactcctctaaaacctgggcccagaactgaatgctacacttagtacatggtctggccaaaggacactcctgggctcttgcggaaggcttcggctgggtgttgtcagaggagcagagttaataagatgggaaggtggcccctggccctcaccagatacattgagcatgtcatcaatcctgccagtgatccagtaatagccatcctggtcccgctggcagcctgggaagaaatgcaaaacctaataaataaaaaccctacggtaggatacctgatccacattaccaaactgctacaccttctgcaatagccttctaacaagtcttcctgcttccactcttgcccactgtagtagccagcctccaagagggcaccactgatctctgcctcttggtattcatagccctgcagtcctctttctcattgtactagggttagtctgtgtcatcataggatttggcagaagtgataggatgtcacttctgagattaggttgtagaagacacctagcttgtctcggttgcattgtctcagatcatttgctgtagggtaagctagctgccatgtattgagtagtcctatggtgaggtgaggaactgaggattcctgctaacaaccatgcgagtaagcatgaacgtaggtcctccaggctcactcaaaccttcagatgactacaggccctaccaacagcttgactgaaactcacaagagacccagaatgagaactacccagtgaaactgttcacagactcctgatcctcagaaactgtgtgagataatatttgttattttaagctgccaacttttgggataatttgttccatgccaatagtatactcacctaaactctattctccataaatccagcaaagttattttctaaacagtaaatcaattcttagcactcccctgcttaaaaccccaaaaggtggccaggcatggtggctcatgcctgtaatcccagcactttgggaggccaaggtgggtggatcaggagttcgagaccaacatggccaacatggtgaaaccccgtctctactaaaaatacaaaaattagccaggcatggtggcacccgcctgtaatcccagctacttgagaagctgaggcaggagaattgcttgaacccgggaggtggaggttgcagtgagctgaggtcgtgccaccgcactccagcctgggtgacagagtgagattctgtctcaaaaaaaaacaaacaacaacaacaacaacaaaaaaaaggtttcccactgtcctttgaataaaattcaaactcctcaccatggcccacaagaccctccctgtattatgtacatctccaacgtcatgtaatattcttccctttgcttgctacgctccagccacacaggcttcagtccattcttcagacatctcaagctgtgtccctctgcacaaaacactcttactctagattttcccatgcctgtttccttctcacccttcaggcctctgctcaaatgtcaattcagagaagtcttctccgacgatcctgtgtacagtagccatccctgcacacactatcatgctaccctgtttatttttcttaacagcatttatctctatctaagataagcttatttatgtttgttgggtttgtctgtctccccttactagaatccccatgagggaggagattttgactacattattcatgatcagtgcctgggcacaggatcacagtgctcagatcttatggatgaatggattggtagatggatagatggagaaacacagactccagacataaagacaaacatgacataatagtcatgcactgccacatgccccatctctttcaacacaggagcatacattgtccatctttcctcatacatcaaagttcggatggcaccattctgagacccctcctgctatactcattcctgcccttacagtctttgtagctctgcgtagaaaccagatactgacatgtaggacacattcttctctaattttctttacccctaaccaactgatatagtttggatgtttgtcccttccaaatctcatgttgaaatatgatccccagtgttagaggtggggcctggtgggaggtgttttggtcaaggccggggaggtggggggggcgggggggacagatccctcatgaatggcttggtgctgtacttgcagtaactctatgagttcatgtaagatctggttgtttaaaagaggctggtatctcctccctctctcccttgcttcctctcttgccatgtcaaacactggctttccctttgctttctgccgtgattggaagctacctgaggcctcaccataggcagatgccagcaccatgcttcctgcacagcctgaagaatgatgatccaaaataaacctcttttctttataaatcacccagtctcaggtattattttatagcaacacaccaactcttcctgaaaatggaagtggaaggtacatgtcttagtgggaggtgcaagagggggatagctaaggctcaccatctcctgtaacatagtatccaggaaacttcttaaagtaggttgtctcaaagcgttcgtggttcccatagactgtgcgcatgatccctggccagggctgcttgaacacctggggagtgaggaagggacagtgatcacatttgctatgctgtctcactggaagataattacagcttttctaaatgtgggggaaagtgtcctgaatgaagtacaggctttggagacagaggatcctggcttggaatcccagctctaccacttactagctaggtgacctcagagaagtaactttacccctctgagcttcaggatcctcatctgtaaatcagagaaaatactttctgtcttccaaagttattgtgaggattaaattaatagtatatggaaattgcctagcacggtgttctattattgataagtgtttagtaaatttgtgtctccttttgggcaatccttgaggaaagcaggtccagtttgatacaaatgaaaacactcatttaaaaaacagtggtgcccacacaccaagtaaataattattgcccaatcagtaacattctttggcagcagatcgatggaatggatggaattctaggctgagtcagaaggcctggatgtaagccctgtccctgttactaacttgctcttgggaaagtgaaatggggtggggttgaagggacaggtgaggctcctgcaagtatgaatacaataatcacaacagctaatgtttatcaagtactaattgttagtttctctgctaaccccttcatgtggattatctaactcaatcaagcaagcaaccataggagacaaaggcattatttttttctgagacggaattttgctcttgttgcccaggatgaagtgcaatggcacaatttcggctcaatacaacctccacctccccggttcaagtgattctcctgtctcagcctcccgtgtagctgggattacagacgtccaccaccacgcccagttactttttgtatttttggtaaagacggggt

SEQ ID NO: 10889 - DNA, 39888 bp, Homo sapiens
  misc_feature (1)...(39888): n = A,T,C or G, or insertion/deletion polymorphism (see Tables 1-2)
taattagaaactgccagaaacagggaaccattgaaagtttttgcagtgacatatgaaagcatatttccataatatcaatctaatggtgtcttgataaatctactggaaagactcaagttggcgaaactaggcaagagaggacaaattaggaggctgcttccctggtagaaattctgtatttgatggaatttggtgaaatgcattctgtggggtcatggaagaggaatagcattgctattaggatatggattctgcagtcaaactgtcttggttcaaatcccaactccaccactttacacttgattgaatcctgtcttgcattacttggtaattgcttgatttatattgtatcagactaactactatttattgaatgtgtactgtgcatcaggcatgttatagcgcatacttattacacactttagacctcatacaaacccattaggcaagtattactagacctatcttatagatggaagaaaaggaatctcagacaggcttaaaaatttgcctaagaccccacagtaaatgaacagcagagccagggtctaaatctagatttttctggatttgattcgtggcccatgtttgtcccacaaccaaacatcatgctgcctcccaatgggggtgcaattttgactccttggctaggcgcagtagctcatgcacatgtaatcacagcactttgggaggccaagtaaggaggaaagcctgaggccaggagttcaagaccagcctgggcaacatggcaaaacctcgtctctccaaaaaatacaaaaaagtagctgggtgtcatggcgtccgcctgtagtcccagctacccaggaggctgaagcggaaagatcgcatgagcccaggagatgcaggctatagtgagcctagaacgggccactgcactccagcatgggtgacagagcaacaccttgtctcaaaacaaactatctatctatctatctatctatctatctatctatctgtctatctatctgtcctttacccagactgagggcaagggtagggggattttccttataccttttttttttttttttttattttttttttgagacaaagtcttgctctgtcgcccaggctggagtgcagtggtgctatcttggctcactgcaacctctgcctcctgggttcaagcaattctcctgtctcagcctctcgagtagctgggattacaggtgcccgccaccacacccggctaatttttgtatttttagtggagacgggggtttcaccatgttggccaggctggtctcgaactcctgacctcaagtgatccgcccgcctcggcctcccaaagtgctgggattacaggcgtgagccactgctcctggccgattttcctcatacattttaacagacatggaaccatctatcagaacttctgaactattactaatacaatcccagcccaagttaaaaaaataaataaaacaacttgacatcgtagtaactcgttcagtcttataccgcgtaatttccattaggatgtccgatatactaaaaatagatcggggactccattactaatctgaggaccccaagatgggaaccagacccgttattgccctcaacagttcacaggttaagggtctcaggaggcagtggctgagctggtgtgaaagggaagcaaagaaagttctattcgtggccctcctcccttcaaggctcccgtcgccccttagagaccctcttttcgcctcaggaactccccttctcttcccatgaaactttcactctcttggccgacctccccgtcccaatctcaaggaacctcacttcttccctcacggaatcccgcgtctcctcgcaaaaacccgcatctccaccacggaccctccaagtctgcagggaactccccagctcccatggaaccctcgtctcctcccggaatcccttttccattttcaaagaaccgcaattcttccttcacagaacctccatctcctcacccacccctcagcttcccaagggagcccccgactcccccagggagcccccactcttctcctcactgacaccccaggcccgcccgggccgggcctcaccccgcggctcctccacggagcgccggtgcagctcgcggtagcgctgcagcgaggggacgtgcgcggagcggctgacctcgggcggcggagaccaactccgcgcccggcctccggctccagcttcctcctggccccggctcccgctgccgctccggacccgctcctcaggaagccccatcacgtcaagttcctagaaccgcggccgcctttgcggtcgcggcgggtgccgggactgagaaaacaggccgaactagaggcggggcctccgtagaggggcggggcctggtgagtgggggagtggcttagtctggcgggtgggcggtgccagagggggcggggccgtgtctggttggggagggatcgaggttggcaaggacagaaatactataaggaaaagtcgagggataggggtggagctgacttgccggaaggagtgacgccgtcgagtgaaagcagaaggggcggggccgggtgtgacaagggagagggtggaaccgtggagtgccaagggaggggcggggccaggcgggacaggagaggaggtgggcccatggagtgatggggagtaacccggctggttgtgacaggagaggaggcagagccatggagtgaccagagtggggtggggtcttggagtgacagataaggggttgggttaaggcaaggatcgaaagggaaagggatggactaaggagaggagttgagtaaggtccatcgcggagccgccccgtgatctgattgcacagtcctgactatcaccagttccttccaggtgacacccttccctccaggtcccccctctctgagccacacccacattctcgtcctccggaaaaacttctcccatgaccttgagggcatgctctggcgacagcacctcctctctgctcaccctggaaccagctcagattttctccctcttatgaggacatgtcttcaatctccttgccttcacaaatctccatccagatctaaagtacaagactcaataagtgaagactaggagacaccttcaggttttttgtaataagcccacctcctaattgcacaaatggcaaacccaggaaagggaaggaactggtgcacagtcagagagcaaataacgaccaagttagggccaaagctaggttctttgactccagatttggttttacttcctcgtcaggcttgaagctaaggcttgtaaaatatcaaagtctgtgcaaataggaaaaatcattcacattctctttttttgttgttgtttttgttttgagatggagtctctcgctctgtcgcccaggctggagtgcaatggcacaatctcggctgactgcaacctctgcctcctggattcaagcaattctcctgcctcagcctcccgagtagctggaattacaggtgcacaccaccacacccagctaatttttgtatttttagtagagatgggatttcaccatgttgtccaggctggtcttgaactcctgacctcaggtgatctgcccgccttgggctcccaaagtgctaggattacaggcgtgagccaccacacctggcccacattctcttctttccttcacaatctctttactccaccaagggaaacccccaccaccaccaccacaacctgggcttaattacctctagcttctctctagcccctccaccccagaaagaagtcaggcaggaccctcctccatctctcacctgcactcaccacaaagaagtgcccacctcaccatcatttcacagactggctgtcaaggcaggaaggattcttaaatatctaactccaagagtgattctgaggcctgaagcgggcagctcccacctcctgaagcctacacaggccttgtgaccccatctagcccagcctcccttcccagctacttccctgcactttgcccagctgactgtaaaccttgcacaccctaagctgaaaaaaaatctctctatgggagaccgagagtctgcccaatcccaaggagggcgggaatctgagggcccactgaaggagtacagacctcttggggtggacatagaccccaccaaggggtcagatactttcataaaggagatattcactgcaccgaagggacacacacttcactgacagtacatggactccactaagggagcacagatgttgctgggggttctcagatctgactgaagggccctgggccctgctaataggacatgaatggctttgaagggcacttaccctagtgaggagacatggatttcccctaagagatacagaggatatagactttactaaggagacgtggaccctaccagaggactcaaactccagtgaggagctgccaactacactgtgggagtggacatcactgagaaggtgcagacctcatcaagtggggaagggtcccaccagagggattagacctcagggtagtgtaatagaccctacaaacatcactgaggagataagaactctctggggtggggaaaggcacagacaatgggtacactttttggtgatagactgttaccctccctgggcactcttaccacacagctctgagtagccctctccttcctatcctctctcccaagtcctacacccaaaccccagagctgttcccgacacactgcttccccctcctgtctatagttgctactgcagctgctgtgtatatagtagatttttcaagcacttcaggccatccctgagactggtctggggttgggaagagaaaggatgtgtgtatagaggcttcaccagcccccctctcttcctgtggacttcacaatgaaagtttggaacagagacctcgtaaaagaaggaacctccctcatccttggatatggagaagtagtacaagctgtagtgtggttggaattttggagtggagagaggatggatgagtttggagggaatgaatctaccagattaaggcaatgatgatgatgatgatgatgccatttattgagtaggtgccaagccctatactaatcgctttccattctgttacttaatcctcatgacaaccctctaaaatgggtactattattctttccatttcacagatggggaaactgatagagagactaattgtcttgcccaagattacacagtgtttgagcggtggcagaatagaacccagacatccagaatatggagacctattccccaccttgccccactcctgccctaccatcactaccaccactccttctttctcaaagtgtcctttccagaaccacatcaaaaactcttaaaatgatggtaaatattcaggttccaaggacctcatcccagcctactgaatcatgatctctggagtggaatctggggatccgctttcaaagatcctaacacacactaaagtttgagaatgcggttgaaagaggagtcagaagtgtcggggtgcgggaagggatctgaggtcagaggagggatctgttgtccaaagaggcgtctgcagtcaaagaggcctggagatgaagcatgggctggggttttcaaaagggtttgggggtgaagacagagtctgaagtcgaaaaagaggtctaaggtcggaggaggagtctaaaatcggaggaggaggatctcggaattcaaggaggggtctggggtccgaggagtttggggtcagagacaggatctggggtcgagagggatttgcggtcagtgaaagggtctggggcccgaaaaggaagcctgggatttgaggaggacactagctgtattcaggctggaaggaggaaggggtttggtccctgagctgcgtaaagtgcagagccactgaagtctcgcttgccccgcgctctcccctcgaccctgcgctgccttcctggctgtccatctacgcgcacctgtgtgccagctgcaggctgatagcgctgagcagacgggggcgagtcagaccgggacacggccgagggctgggagaggcgccccctcccggctgtcgcgaagatcaggccccgccctccgccctcccactcccccgccgcagccacttccggcaggcgctgcgctgctggggggcgcgggcraggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccggtgaggcccgctgaccccgtccctgccctgccttgggaagtccccggtcttccttcttctgtgtcaagcatccacctccagctscatctccttaattcatccccatcttcttggatctctcccttcttctcccttgtctctgttaattatttggtgaggaagggggtgcatttctgccttggaggcgtaggatgcgacaacggagaggatgctagggactgcagtagaagggattgggcttaccttctgggaagaaccaactaacgatgaaggaatgttgaaggggagatcctaaggaaccrctgtgatcacccagaagagggctttctctagccacagaggacaggataggagaaaccaagtcagagactgcagcaagagggatccaatctgtgccttaagagaagttccccacagccagggattgtgagaagcagagggtctgggagaagcggagaatctcttcatgtctagggaggggtaaagagaatatgattcccctctgttgggtgttgggagacggaggcatggactgcatgacctctcaaaagtccttggggactagaacgccttcactctcctgtggattaccccacccctccctgagccatggatctggccggggtattagtaaggtactctgctccctaggaagcagtctccagaattttactgtgttcccctcagccctctgctggaattgtgagaagtgggggtaagagaaggaggagacagggattggaagagacctgggggcaaagagctctctgtgcattccttccctgctgctcttcctcctagccatgtggcccagcttcatcctcccctccattcttcatccttcatcccccatccctctgtccctgcacgtcacttcctggcattagagcatccttctacctcactctcgcttcctcgcagtgcctgcacttgagccttgtctcttaccagcctggcagatgctgcttttccggcttggcccttccctagctgctcccagcctgaaagccccaaattctctcctcctctacactttctggtcatctggccctgaccagcagcccttgccaacctgactggactgcactctgtatgnggtgggggtgaggagataatgaagatggagtttagaggtttatgggcgtcaaatgtcagggctgcggatcaaaacttattttccaaagggagtggaatcaggaggtagcagggagaggagtgggaagatgtgtcatgatggatatcagcctgaagctaggccttttattcagtagtcaggagtgagacttctggtcctaatacagccctgactcaccaagcgacaayaggcacacctaccctgtcctgggccttagtttcctcttccagctcaacagagaatgcctgtctctcttgacctagagattggaactgcctgacatgttttcttctggccctctgtaaatgtcttagcatttaccaaaatctatgattatttatttgtgcaattatctgattactccctgtctgtaagccccatgagggcagggatcatgattgttttgttcactctcctttctccagcatcaagaccttatccataggccgggcgcggtggctcatgcctgaggtgggtggatcacttgaggtcaggagttcaagacctgcctggccaacatggtgaaaccccatctctactaaaaatacaaaaattagctgggcatggtggtgggtgcctgtaatcctagctactcgggaggctgaggcaggagaatcactcgaactggggaggcagaggttacagtgagccgagatcactccactgcactccagcctgggtgacagagtgagactcagtctcaaaaagaaacaaaaaacaaaaaacaaaacaaaatacactggccggtgtggtggctcacacctgtaatcccagcactttgggatgctgaggcgggtggatcacctgaggtcaggagttcaaaaacagcctggccaacatgacaaaaccccatctctactaaaaatacaaaaaaaaaaaattagccaggcctggtggcaggtgtctgtaaccccagctactcaggaggctgaggcagaggttgcagtgagcgaagatcgcgccattgcactccagcctgggcaacagagtgagactctgtctcaaaaaaacaaacaaacaacaacaacaamaaaaaccctcatctctatttatttattgggcactcaataattgttgaatgaataaatgcatgagagagaagatctcaggatgaaagaatggtaggagagaggatgaaagaatggtaggagagagcaagttccaaaacctcagggagtattttgggaagttcaatacaggctctgccctcacccctgtatggaaatccagcagagatcctagtcatctgagcttctgggagtttataccttatgccaaatttatgtgtcaggtttgtgtgttgccatcatttcagtgtaatcatttgaatgccatatctcccaatcctacttccaagccccaaggcttcctcggttcacctggaccagactacaggctgacatggcctcctgtgttctcaacctggtggtaccatctagtggcacagcaccatcctcttagccaggaccttggttgtgcccagctagcctctagcctgccattccctaaacccaagtgccaggcaccccacatcaggctctgtgggaaagagagctagacagtgatcattccaaggttgggaaatactttctttcttctgagctccaagcccttgtgttcctttctctcccaggcctgtgtctccagatgtcctgcaagtgcctcatctatagcatgttctattttgaactcatcatatcccttccccatgcacctgctcttcctccactgccattctccattaatgacactgccagtcacccagtctcccaataatgaatggcatgctggactcctccttttcttctcatttccaaatggtgatcaagtgctctctgcacccctcctaagtatcttccaaattcctactcatcatccctgtcatcaccactgtagactaagccaccaacctctcttatcaatattatttataggcttctagctactcctcctgcctcctccctcttgcccagtccccaccccaatccatccatcgcttctggtcatgtcactccctggttcagacatctttggtgattctgccgggcatagtggcatacacctgtaatcccagcattttgggaggctaaggtgggcagattgcttgagctcaggaattcagaaccagccggggcaacatggtgaaaccctgtctctagaaaaaatacaaaaattagccaggtgtggtggtgcatgcctgtctgtagtcccagctactcgggaggctgaggtgggcagatggcttgagccctgaaggttgaggctgcagtgagctgagattataccactgtactccagcctgggcaacagagtgagacactgtttcaaaattttatatatatatatatttatttatttatttattttagtgattctccccttaagggaataaacaacaagccagggatgaccctagcctctagccaagatcactctcctaaactctggacttgtataatcaattttgttcaggattattttgttataaacccagtttaactgagctacatccaaaaagagaattttactgggtagcataactgaaaagtccagggatatggggtttcaggcatagctggattaaggtacctaaaaaggaatggacttttctccatcttttgctctgccttcttttggtgggcttcattggcagaaggcctcccattttattaggggcaagatgcccccagcagctacaggcttacatcctaccaacttagcaacttaagtgtaatagaaagaggagcctttctctttcccagtagttccagcaaaataacaaagtttgggtcttattggcctggctttgttcacattgcctgttactgcacagaggtacctgttctgactggccaagtctgagttatatactttggtcagggatgagggagttggctgagagaggagagagaatgttccttaaaagaaaattgaatgagaagtggtatccaagcagataccagggatgagccctgaaggtaaaaattagatatctactaggccaactgcctccagacagcttcttatggtgtcccacaaatttataataaccaaaattgaacttgtcatctttctcccaaaagacttattccttctggttgcaaattaatctttttccagtatcctgctgttgctcttccctatcagtaaaatcaacactgttattgccctagctgttccacagtgcacatagtaggtactcagtaaatatttttattgtataaatcaataactttatgatggactggtggagtagagagtcttgaatagctatgatagggacatgtcacctttacctcctggatccttatatctgactggagaaaacaaattaaaccatacctagggccgggcacagtggctcacgcctgtaatgccaacactttgggaggccaaggcgggcggattgcttgaggccaggagtttgagaccagcctcatggccaacatggtgaagccccatctctactaaaaatacaaaaattagctgggcatggtggtgcatgcctataattccagcttcttgggaggctgaggcatgagaaatgcttgaacccaaaggcggaggttgcagtgagccgagattgcgccactgcattccagcctggcaggaagattatctctcaaaaacaaagcaataagtaccaagaaatagcaacaaaaattagcttgtaaggttggtttctgagggtagaaatggctcttgatgccatgtggagcaatgggaaggaggctttctagttacacagactcttggtcctgccacttattcattttattttattttatattttactttaaattttttgagatagggtttcaccctgtcgcccaggctggtgggcagtggctcactgcagcctcgaactaccaggctgaagtgatgctcttacctcagcctttcgagtagttgggacaacaggtgcacaccaccattcctggctaattaaaaaaatttttttgtagagacaggagtcttgctatgttgcccaggctggtcttgaatacctgggctcaaacaatcctcccacctcggcctcccaaagtgctgagattacagacgtgagccaccaaacctggcccacttactcattttatgacctgagatgggcaatatcacctttcttggtcttagttttctcatctgtaaagtggcgagagtgggacttatttcataaagtcttgggaacacttcaataaaggaatatatgtaaaatgcttaatatgtagtcagcatcaataaatataagttcaaaaccctttcccacacttcttttgaaacttctaatgccgggtgctgtggctcacgcctgtaatcccaacactttgggaggctgaggcgggatgattgtttgagctcaggagtttgagaacagcctggggaacatagcaagaccttgtctctattaacaacaacagcaacagcaacaacaacaacaacaacaacaagacatttctaggggccaaggagagttctgtgcctacagtgggtgtttaacgtctgtttgtttggatgaattccagttttatttacagactctgtgatgctgatgttgagggttagaggcaagcattatgaagtgagggagagtctcagaagataacctttttttgaaaataaagtttaaaaacagcagggtgcggtggcttatgcctgtaatcccaacactttgggaggctgaggcaggcagatcacctgaggtcaggagttcaagaccagactggccaacatggtgagaccctgcctctactaaaaatataaaaaattagctaggcgtggtggcatgtgcctgtaatcccagctactcaggagactgaggcaggagaatcacttgaacctgggagatggaggttgcagtgagccgagattgcgccactgcactccagcctgggcgacagagtgagactctgtctcaaaaacaaaaacaaaaacaaaaattacatgttcatgataaaaaaaaaaaagcaatagtgaggaagaataaaaaagtcccctttcccattcctatctccctgtaatttttccttttcatttcaaaatatatgtgttaattttttttagagacagggtctatctatgttgcccagcctggagtgcagtggctattcatattgcaatcatactgcagctttgaacttctagactcaagtgatctcctgcctcagccttctgaatagctgggcttacaggcatgcacgagcactcccggtttatgtattgatttctaaaaaggaaatagatataagtggtaaaaatttcaaaccaaaaaaactcccaccccatctcattcccatcttcagtatcctttcccaagagtaacttctgtaataatttataaacatttcttgcatatatcatcattttatctatatatttggtttcttatttacacaaaagatgggactgtggatcatgaaggtctttaaacaccacaaggagcttagatgtttattatgttggcatcagtgaaccacgtattttaaacagaacaataaaatggtcagtttttaatattatcacatagacttttaaaggggttatagtcctagtgcatagtagcaggtactaaaaaaattgaatgaataaactttaaaaaacatattgtgagtacagcatgaggtcaaggtaaagtaaagactatttctttactgttcacaaacacctaggacctttaggccatttagggacctgggttcacagctaataacactcagaggagggagctatgggatggaagagggtctcagccctggtcaaggtggaaaaggaatagaaataacttggagtgagtacctacagtgcactgggtgcacatcacctcatggaatccttgtacccctatcccaccagttagggattagttccattactagaatgaggaaggtgaggtgcatgacttgactgacttgtccatagccaccagcaaatagtgagctttcagttctctcctacctccactcttatcgtcctccagtttgtctccagacagtagccagagggatcattttaaaacacaaaacaggccgggcgcagtggctcatgcctgtaatcccagcgctttgggaggctgaggtgagtggatcacttgaggtcaggagtttgagaccagcctgggcaacatggcgaaatcccatctctacaaaaaatacaaaaattagccaggtgtagtggggcatgcctgtagtctcaactactcaggaagctgagctgaggtgggaggatggcttgagcctgggaggcagaggttgcagggaggcagaggtttcagtgagctgagatggtgccactgcactccagctggggtgacagagccasaccctgtctcaaacaacaacaataacacacagaacagatggtttcacattcttgcttaaaactctctagtagtgggctgggtgyggtggctcacacctgtaatcccagcactttgggaggctgaggcaggtagatcacctggggtcaggagttcgagaccagcctggccaatatgctgaaaccctgtttctactaaaaatacaaaattactcaggcatggtggcatgtgcctgtaatcacagctactggagaggctgaggcaagagagtcgcttgaacccaggaagcggagggtgcagtgagccaggattgtgccattgcactccagcctgggcaacaagagcgaaactccatctcaaaaacaaacaaaaatagcctctcgagtagtgacctcccatagtccttagggtaaaacccaagcttctccccaggctagtagagccccacatatcttcctttttttttttttttcttttgagacagagtctcactctgtcacccaggctggagtgctgtggcgcgatctcggctcactgcaacctccaccttgtgggttcaagtgactgtcgtgcctcagcctcccaagtagctggaattagaggcacacatcaccatgcccagctaatttttgtatttttagtggagccggggtttcaccatgttggccaggctggtctcaaactcctgacctcaagtgatccacccgcctcggccccccagagtgctgggattacaagattgagccactgcgctcagtatgtatctggcctagcttccacccttactactctttccccatgcctgctacaccagagccgcccaggccttggttatttttttttctaatgtgccaagctcattcccactttagggcctttgcatccactgttccctctttccagaacattccacacacatactctttgctctacattatagctggctccttctcatcccttagttttcagcttaaaagtcacttcctgagaggccttccctgatttctgcagctaaggaatcctccctcccctaccaccattattctgtcatttcctcctttttcttcatagcacctgccacaacttgtaattatagactcctttgcttattggctttttcttccagggctctatgaaccacatgagggcaggaactatctgttcccgtcccctggcacctagcatagggctctccatatttaaggaatgagtgagctgataactgaagtgaggttggaaggcagggtccctccactctgtttatgtagctgcctccttgcatggaaggctgggccccaactggggcaggatccgatttccactgagggctggaacccccaccccaccccccaggaagtgttctcagccctgggccctgggtgccaggaaatttggcctaggtatcagggaggggcgggaatccagcctccctgctgcccagctggggaggtccctgtctcttcctagccgggcaccgttgccccgcctgtcctggggtgcacgcgaaaatgaggaaaggtgagtagtgctagccagtgcggggattgtgtggcaggggcggggcagggaaagcgctgaatagtcccacctggagggtgggcagggccagataggagatgcccagaccgaccccggctgcctgcccgcagacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccaggtgagggggacaaatggggagggggaggaaactggggagtggggagtggggtaatgtttgaggaactgtggaaactggggaatggctgagtggtagaaggggagagagggtggtgacttgggagaggaaggtcccaaagagaggagctccagggcatgagggagacagaacaaggaagaataaggacagatccattaggaggcacttggggtaatgagggcagagtcaaggcaacaagggggcagggcttcgaccttcatgccgcgtagagttctagggctagtggaggtgccctagggaggtggacagctcctcctgcccccaccaagtcctctttcccctcccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcgggtaaggagcagtggaggtcggggtcccccaggcctacttcttgcctccaggtctgtaggcctcatgtgcagcactcctaacttagggagaggggcttttgggccccaactccttgcattttctctttctacaccaaatttcacccccttctccctggatggagtcagaagagcaaagctaccttatggaaaacctgaaagtgttttcagaagctttttttttttttttttaactagaaaaagaaatttgtaaaccataaattaagatgcacaggtggaggtatactgtcatcaattaaggcagagatatttcaacttctaggatcataaatccctatgggtctgatgaaaagccttgcaccctctgtcctccaaaaatacaccctgcactaagaactcttagaagttacaagctggccacccatgggcaacacccagcacacagactggtttggtttagacactgaactgtcttaaaattttgtttgcttttgttaaaaagttgagaattttcataaaaatccagatttccaacatctcttgaacaatcgggaaatccgataacaacttgggcccgcattctcacatggctgaagttacctggcgtggaatagaagctgcttcccatgatgggcatgcactgtccagtttgccgtagtttctaccacttcctcttctctgtcctgcttgccttagtttgtcatttggctgtgggcatttaagtttgcagcccccatcttagacgtaaataagctacagaaaaggaacaagctgacaaagttcctatcttggctcctgtaagaccagctctccaagccgtaccaaagaaattcctcttttggttttgcgtgttctatccttacataatccagtcctggcggaggggcaagggacataccaagtagacaggtgcaggaagctggcaggggtccagctctggtccagggtgggggcatggggcagaacatcctgttctgccagtctctgggcttttcctaatcagggattaaagtctccagtgacaggatagaagaggtccatggaccctgggtctccaaccctcttggttttgctcccatcctcttaggtggctgagtctgtgaatccatgctggggagggagctcagacacctgaccccaaatgaaaaactgagcctacagctctcaccactgggggtggaggggcagcagattcattgtacagaggggtagcatgttatcatcacacttccccttctgtgtctctcccagtgggggcgtgatgctggtacatgacatccgacgaaatgagagccacctaattgatttccgggagtccgcaccaggggccctcagggaagagaccctgcaaagatcctgggagaccaaggtggggaccctggtgagaagagagagttcaggggagtctctcttcattgcccttctgctaacccaagcattaatttgctaagtatttaccaggggagtgggaaaaagagttgagcaggattctcttaggctatgagagagtcaggcagcccccaagataaaataatgaactagaaaatctggaaccttacttctctgggaatcttacctatctggcacgtgggaaggaagaaaaaaggctactgagtaccctgaaatgtcacgaagttgatgcaatgaaactcacacatctcactctgagccagttgactataactttcccagcccttgatatattggaagattagaggggaattgccagaagtaaaccaactgtctgctgaaagaaaaagaagatatcgaataacttggaaaaatgggtacttagtgcggtggcaaaagccaaacacacccctgagtcttcagagctcagagtaatggtggggtgaaactgaataggttaaatgaaggtcctttgtccaccgttttaaaaggtagggttgcctgggcacagtggctcacacctgtaatcccaacactctgggaagccaaggcaggaggattgcttgaggccaggagtttgagaccagcctgagtgacatagtgagactttgtctctacaaaaaatgctttgaaattagccaggcacagtagcatgcaccaaggatcgcttgacttgagcccaggagttggaggccacagtgagctatgacyatgccactgtactccagcctgggtaacaggaaaaaaaaaaaaaaaaaaaaaaaaaggcaggggttggtgaaatccaatgtagacaggtgtctttctacactggttatgtcctggctcttaaaagagttttgcttaatttataaatcccccaactacggcagctaaaagaggcctttctgcatttgctgataggaagtcagggagatgggaggggtgcctgcttgggaaagcttgtccctcccctgggatacttggcctgtgtctctcccctgtgccagccatccctggcttggggctctgcggagttcagcccagcaccccccttccagtgacctggtctcctctctccctcgcctacccgccttgcccagcctgggctcttggtgggggttcccggaatggtgaaggggctacatgaagctcaccagctctatggcaggtaacaaccctccccctggggaccagggacccccgtttgcatctctccttgggtggccttctcctacttccctggattcttcctttcccaactccccctcctaatatccccttcccttgccaggactctccttcccaggaacccccctccccccggacccctcctcattcccccaggacctcctccaccccctgctctccggcccccccaggctgccatggtcccaagtcctggcctttgcagcagctgtggcccaagatggcttcaacgtgactcatgatctaggtcagtggggcctggggatttgggagagacatgaggttgatggagaagggtagaatctttgagatttggagcccaagccagagaggccctctcttccagtttgctcctcagaccccctccccaccttatcccaccctcacctggaggcggcctcaaacgagggggtctgggaagggcccttagacatccctgcctcgcacttaacaggctcctgggggtcagggcacttagggtgggccactcagcccccatctaccccatctattgcgcgtctcatccggtccagtcctggcgtcccgccctgcccagcctcccgtccctgcccctagcccgtgccctggctgaacagctgccacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggtaagtgctcgtgttgtgcgggtgggggcatgccccaaggtccctattgcaggacatccgcgtccgcattttttccttccttccctccctccctccctttctttctatattatttactgtggattatgttcatttgaaattctagaatagtcaaaactaacctctagtgacagaaatcagatcagtggttggtggggctgggaggagctgactgggatatgacatgaaaaacctcctgggatgatggaagtgttgtcttttttttttttttatgagacggagtcctgctgtgtcaccctggctggagtgcagtggtgcgatcttggctcactgcaacctccgcctcccaggttcaagtgagtctcctgcctcagcctcccgagtaactgggattacaggtgtgcaccaccacacccagctaattttgtatttttagtagagatgaggtttcaccatgttggccaggctggtctcgaactcctgacctcaagagatccacctgtcctggcctcccaaagtgctgggattacaggtgtgagcccccatgcctagccagaagtgttctgtcttgattcagaggtacctttgggcttctcaggggtgatgccagcctgtgcaggggcttgtcatgtccctcccaggcctggtggagacccagtatcggcctcagcttccctaagctcacaatccttccctgcttttgggttttctagggactgagggaagcacctctttcattgttgagtatcaagactggggagattgacacagaagtttaccatccaatcccaaagagtcccagtctcaggcagtaacagatgtgagaactgtcattaatagtgcaaaagtcctaatggaaaattaagttcatggtaaggatgcatagaccaactcagtggttctctcatctgagcaatggggatgattatatctgtctctgccatacagttgtgggaattaaataggtctgttattcattcaacattcacagagtgcctgctctgtgccaagccctatgctgggcactggatgtggcgatagactcaaacagacttaactggaaagtccaggagattactggctttagattcttctgtgtccagattatcaatccactgtgttaggatttgctctccctctttctctttctctctctctcaactctactttcctttgtttggattcactctcagatcctttccacctgctccccaccagcccatatcaggccatccttccagcaagctatcccagagaaagagcatttttccttcccagtagttccagcaaaagcctccaggttgtgtcttattagctcatcataggtttcatgactattcccaaatcaatcactgtggcacagaagggaatgccccaattggccaggcctgggttgtgtgccctttcctggaggtggcaaagggaatgcaggagattgtaacaaagaccatcagatctttgataaaaagaaacccaaagttgagtttattaacttgccagaaaaaggaactcaagaattcaaatgggccaggccatggtggctcatgcctgtaatccccactttgggaggccaagatgggtggatcacttgagctcaggagtttgagaccagcctgggcaacatagtgagaccccatctctacaaaacatacaaacattagccaggtgtggtggcatgtgcctgtagtcccagctactcaggaggctgaggcaggaggatcatctgagcctgggaaggttgaggctacagtgagccatgatcgtgccactgcattccagcctgggcgacagaatgagaccctgcctcaaaaaaaaaaaaaaaaaaaatcaatgtgtaattctctgaagatagataactcaagggtttcaagtactataaggtacaaaaaaggaaaggattcagagtggttatgctaatttagggttgacagcacactggataggatggaatgagcccattggtttgtacaagattggttcattggtcaataatgagggcttggttatgtccaataagggtcagtccttctaggatcactcaaagtcatggttttctagtggctttagttggttgtggtgagatgcagcattcagttttggtatctcctaggcaagtgtgccataagtagaaaaccttccttttacataggcagagagagcagcaggtacaaagacacgaaggcatgagttcaggaactgcaggtcactctgcagctgcatagagctcactggggaacagcaggacatgaggtgggaggggtaggctggggccagatcacaaaaagtcttgaatggcaagctaaggaggtcattcatggaatgtacccagtgtgatgcctggcacatgataggtgctcaatgttagtgcttttcccccttcctttttcctgaggtgtctagggataatggggtctctaaaggccacgatgggggttgcagaaggcacagaagttataaacagctgatctgtctgtgatccaaacgtgttataggccaaaaccaccatgtcacagtggtgggaggtcattccctcattctcttccctccaggctcagcacgcagggggtgtcataaccgaagaggacttcagcaattacagcgcccttgtggagaagcctgtgtgtggcgtgtacagaggtgacctctcccccggctcccagggtcccccctcaggagaagcctcccagtccatggccacatcgttttggcctagagactcctctccatttcacaggagagaaactaaggcagtgagctacctgggcagtcaactgttgaagcaaaccagagtcagcccaccttctgaaaagtagctgtggggtcagttaccccaagtatttaggatattggggggtggacctggtcaaagggtccaacctggaagttggggttctggccataggttttcttgatttgggctctgtgttgcctctgccctttccccagcagcgctgtcactgccctgtacttcctaagaatttttaagacaaagtccatccaagcttcacagtagaatgaacctttcaagacagtcatagacccagctcctcatagtgccaaaaagaaattgaggcccgaggagggaatataacaactggccaaactcaagaaaaccaacagggaacccagaaaaccaagcttatgacatgggtggggtccatgtttactgaacccaaggtggtaggtgctggatttctcagaagattctcaggttctttcccttctaggagagccagatcacatcaagccccaggaaagggtttctctgagttcaactttccaggcctcaatctccaacctgattcctctgccagaggcagtggaatatgaagcaatggaaagagcctatcagctgggtgcagtggctcaggcctataacyccagcacattgggaggctgaggcaggaggatcacttgagcccaggagttcatgaccagcctgggcaacatagtgagacaccgtctctataaaaaatttaaaaattacccaggcgtggtggtgtacctatagtcctagctactcaggaggttgagatgggaggattgcttgagcctgggaggtcaaggctgcagtaagcatgattgtgccactgcactacagcctgggtgacagagtgagaccattatcacacacacacacacacacacacacagaaaagaaaaaagaacaagcgtagcgttggagctaggaagacctgggtttgagtaccaactgtgccatttaccttgaacaagctacttcccactctgagccttggttccctccttaaaatggaaataataatagtgcctacatcttaggatgcccataaggatttgatgagatgatgtaggaagttgccctgatcagagcatgcactgaatatagattttccatttccccttcccagcctgggttgtctcaacaatgctagtaccttgagtgctctggattccccttgtctctctgtaccacagtttctggacctatcaaatatgtgtgataacagtagccacagtgaggactaaatgagttaatgttagtgttatgcatcagctattattcctttgatgtccaaacatctagtaacagaataggaagagaaggttgctgctgccaagaagtttggggctggatgagaccatcaggagtcatggataatatcctggcctatgggagagctaaaaggagacacatgacaggccaggaatatgaacatctggtcacctgtttctgctgtgctctgctgatagcctgcagtgtgactctgggcaagccacagccctcttgagccttagttttctcaaatggcagaggaaactgaagaccagtgttctgagttsaagtcctggccctgcccttgacttgccatgtgaacttgaatgagtctctttgcctctcaatgtttcagtttccccatctggtgagggagttcagcgcagtggtctcagtgtgtgatggtggaatgtggagatgggatgtgggatgtgaaggtgccttgacccctaccctgccatcagtcacttcctgtcctttcaggccacctggttcttagtcccccacctccgcacacgggccctgccctcatcagtgctctcaacatcctggagggcttcaatctcaccagcctggtatcccgagaacaggctcttcactgggtggcagaggtaaggctgacccgtctgcctttccctggatttaaggatattaggagtggggagattgggtactgccatagggcaggactaaatcccctccaagttttctcacacacgaaagtccactgggtgtgggttctgggaggggcctggcagcctcttccatatccctgctgtattttcagaccctgaagattgcattagccctggccagcagactgggagatcccgtctatgattctaccatcactgagagcatggatgacatgctcaggtgggtcttgggcaggacctgggggctacagaggcagcrgtgggtgtggggaaagggtcaggagaaaagcagctggtatagcaataaaggcctgaaatcctaagtcaatttcagctcaaccccaactcacaacgtgacactgggtgcctctccctgcacctcacctttcctatcagcacaatgagttggcttactkcatgtggctcttaaatttttttgaggctagcatagcacctatataagcccatctgctcctccttttgagtaggaaaagaaagctcaataccaaacaaaagccaggcacggtggctcacgcctgtaatcccagtactttgggaggccaaggcgggtggatcacctgaggtcaagagtttgagaccagcctgaccaacatagtgaaaccctgcctctactaaaaatacaaaaattagccgggcgtggtggcgcgtgcctgtagtcccagctagtcaggaggctgaggcaggagaatcacttgaacccgggaagcagaggttgcagtgagcygagatcatgccactgcactccagcctgggtgacagagtgagactttgtctccaaaaacaaacaaacaaacagtctccaagcaaatactgaaggtggtggtaatacagcttcattagcaacataacatagtagtagcttgtgggctctggtgagactgccttcattcaaattccagcttgacccttcgctagctgtgcagccttgggcaagtggtttaaactctctaaatctgtttctacaagggggcttgacaataatggtatcaaccttgtaaggttgtggtaaggactaaacaaaatcatacatgtaaagctttgtttggttgaaaattgaataaatgtcttcaagtaatctttggtaacttattctctaatcagctatggataatccaacacatagttattaggtaagaaaccctcagttgaattttttttttttttttttgagatggagtctcgctctgtcgcccaggctggagtgcagtgtcatgatcttggctcactgtaacctctgcctcccaggttcaagcaattctcctgcttcagcctcccgcctcagttgaatttttaaaagtctggagcattacatattgtttctaaggtcaatgcaaactttgctctaaaacacacacacacacacacacacacacacacacacacacacacctatatgaaatctattcaaccagttcatccagtaaatagttattgagcacttactctgtgccttgggaaaaaactctaaaagaaagtaaagatcctgactggatgtggtggctcatgcctgtaatcccagcactttgggaggccgaggtgagtggatcatttgaggtcaggagttcaagaccggcctggccaacatggtgaaaccccgtctctactaaaaaaaattagctaggtgtggtggcaggtgcctgtaatcccagataatcgggaggctgaggcaggagaatcacttgaacctgggaggcagaggttgcagtgagctgagacagcgtcactgcactccagcctgtgtgacagagaaaaactctatctcattaggaagaaaaaaaaaatcctcatatacaaaatcctcccccaactaaactcttaataaaactttagactacaaacattagtttaaatgaatccagtttgttaattcaaagcaaatattttctgatccattatgcaccaggcactttcatagaaaggattaagaagtcagataactaaaaggctcttgatttaaacattaaataaaagttggttccagaaaagaatctaaataatacctaaatacattcaacagctattttctgggtatttcttatgtgcaattaatgagcttctgcactcatagacctagtagtccagtgagggaggtagatttcatcaaataattacacaaacaccacaaaagtgaggtaggtggggtgtattgagagcctgttgtttgctcatctcccaccccttgtcttttcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttaggtatgccagctcagactcagaacctggaacaagggatcctctgaaccaagagggggtgggggctgggtagaggtgaggatgggccagggctcacccaaccccacctcggcccccagctccctgaaccagccctttggcagcggccttatcaccccctcggggatcctgctcaacagccagatgctggacttctcctggcccaaccggacagctaaccactctgcacccagcctggtaggatttgcttccctgctttcctggggaccctgaggcctataggtaggaggtgcaatggcatggctgcccctttctccctactttctccagaatcttctagtataaggaagcctaaagaagaggttcacctcatccctagccctgctaagtctgggacatggagcctggtgggtctgaagaacccttgtcccattctgtcactgtcttactgtgtgaccttgtgaagatcttgccctctctgggcaatttcttcacctgtacaatgagggttttggctcctatttgatgttttgggcattttccagcactagcggtctgtgactatgtgagcttgagctgatggggctcagccctatggttgggcaccaaagagggacccaaggaggaaggatttaataatttttatctagttaaaaatcagcactcttacaccccgccatctggggccccagcagggcaaagacacatagagatgatcagggtggggttatcctgttcttccccattgccatctttcttggcttggtcctttctcctgtgacccgtagcagcctcatagctcagtggatgtacttatcactcccccatccaccccacccatccaggcaccctacccatttcacagatagcaaactgttgtctgggaagggaccagtctcccaggaaaactgggcctgtggaagatgtagaagagggagagcagttggaagggttgtggaggggccctttcccggtcttgtcccaccccacctgccccttgtggtctctgtcctctaacaacaggagaattcagtgcagccagggaagcggccactctctttcctgctgcccacagtggtccgacccgcggaggggctctgtggaacctacctcgctctgggggccaatggagctgcgcrgggcctcagcggcctgacacaggtgaggtttacgccatggttggcctttttcagccgggagccaagctgtggcctagactgcagatgcctgtcatatctgtggcttgtttccattcctcatgcggcaaacatgggctgaggctgttttgygccaggcgcatcctgggcaatgtggacatgggctgcgctgagtttcttagtgaaaatggagccctgatgctccctgtctttcccggttgcaggggaaatggcagggtcagtagattgaaaagtggggttagcatctgggtggcctgggttctgttaacctcaagtcccattatacctctacccagcatctgaatagacaaccagccctctttagggtgggatttgaaaggaagggcctgcttttctccagaacacctcagaatggctccatgaatgtcttgagaacctgatatatatgccaggcacctattttggcaggtggtgagttaacgatcttaagttctggaatcagacactcctgggttccggcccaagtgctaccaatttgtaactgtgtgatgctggagcattcacttaacagctctgaacctcagtctcttcatctttaaaatggaaataataacaatagctaacatttaaagagttcgtactaagtgctgggcactgtgttatgtgtgttaaccattttaaccttcccagttctggagagaatccttatttctattttatagataaggaaaccgaagcccagagaggttaagactttaggtcaagtaccttcagctagaaagagcagggaggcagtttggttccagagcctacgcacactcctaaccactaagttaaaagcacccacattgtgccctagaccactcctagctattaaccttgccctatccagagagaaaagaagggagccccgggctagattaaagagacttggttctagtggtgtatcttccctggcttcctctaaactctggagtaagtcattttccttgctggacttcactttccctctctgtgaaatggaaacagtcatcacaggcctgcctgtcttccagggctgttaggaggctcagatgacacccggtgtaagaattctcaagactaaggagcctggaccaagggtgagagctgaggaatcctggaccatcacccctgggacagccctgatttttctgtaccttggctaccacaggttctgctgaatgtcctgaccttgaaccggaacctgagtgacagcctggcccgcggccgcctacacccggacctgcagtccaacctcctgcaggtggacagtgagtgcagagcagagacctcgtggggcgggcacagggacaggtagagaaaggactcctcccaagggtgcccatgcctcaaccagcaccaactgccagtgaagtttggttttatttggcaaatttctattggagcagtgaaygatctggggattggaaccagtcttgccatttcctggttgtgtggccttgggaaatccatgtctcaactctgagcctcagttttctcatttgtaaaataagacacagttgttcattcttcaaactttcatttactcaacagtttgtattgaacacgtacgtgttccaggcatcatcctaggtgctggggattctgcatttacaggcaaacaagaaaataagtcatcaaagaaatatgagacaaataaatgctctgccaactgtcaaagcagggtgatataataggacggactcaatgatcaaggaagacttctctttggtggcatttaagctgagatctaaagagtgagaaagaaactgggtgcaatggctcagacctataatcccaggctgaggtgagaggatcgcttgaggccaagagttcaagagcagcctcagtaacatagtgagacccccctccacccccccgtctctataaaaaaatttttttaaattagccaggcatggcacgtgcctgtggttctagctactcgggaggctgaggcaggagaattgcttgaaccagggaggcagaggttacagtgagccaagatcacgccactgccctacagcctgggtaacagagtgagatcctatctcctaaaaaaaaaaaaaaaaagtaagagagagcccactatacaaagaattggtgcagagctttgtaggtcaggggagcaagtacaaagaactcagggcaggagtgggtttggtgagtttgaggactaaaaaggwgaccaaggtaagcaaggatgaaattagatcagagaggcaggcaggcgccggatcgtggaccttagggtgaggagacggactttcctctaagaaaagggcttaattttggcacagctgaattttataaacaggaaagtatctgcacctttgaggagtttttattataacagacaatgtattaatatgacacgagtccaaaagaatacagaattgattgagacacagtccttgcctgttcaatattattatccccattctatagaggaagaaactgaggctcacagaagttataaactagtcaaagatcaaccactaagtggcagaacttcaattaggacacacacctggctgataccaaagactctattctttactgcacagctcttgatatctcctggactgaatcacattagaagcagagaccgcgatcttcaacaatcacatcctgtggttggccagcgacacttggatcccagctgatagatgacaaggccacatccttgaaattgaattttgttcaacaaatatctgctggtctctgttgaatgtgaggctctgtgctaagttatttgggctcagcccagtcctgccttcagggccttagtgtaagatggaggtacaaggagtgggggcttggtgaagggaaagttcatctacctgaggccctggggaggctttatggaggaggtgacaagtagcttggctttgaagtatgagtaggaatttggtatgtggaggtaaaggacattctggacaggaggaacagcctaggcaaaaaccagaatgaatggctcagagagcagccaggaggctagctgttgtttcctagagttctcaatttacccagcacctttgtgacttttgccacatttgcacaccatctaaaccaatatgtacataacatgtctctctaaatgaacttcctttttagcctaaatgtattttattatttttttgagatagagtctcactctgtcncccaggctggagtgcagtggtgcgatctcagctcacttcaacctccncctcctgggttcaagtgattctcgtgcctcagcctcccgagtagctgagaatacaggtgcacatgccaccacacccagctaatttttgcatttttgtagagacagggtttcaccatgctggccaggctagtctcaaactcctgacctcaagtaatccgcctgcctcggcctcccgaagtgctggatttacaggcgtgagccaccatgcccggccctaaatgtattttaaaaatagaccttatatcataatcacaaatggaaaaatgacatcatttgccacaaatagatgacaaatagctatcatctatttgttagctatacaaatagatatgtgtagtttttagttaaatattgttgcccatggaaggctctgagactgctttctccattaaagaaggagattaggaagcgttagagagcagactgaaacttgttccttgccataatcaaaaggattgaaagtgaaccacaaaggaaatagattttcgattaagtgatttaatgctattcaagattgggtcttcatctcaagagctaccaaaagtcttcctattagggaaagaagaagactagatctttattgagaagcggtaggatgtggagttacagggcttctcacagaggtcagccttaagattatccagttgggaaggggagacacatgacctgatttgtcttatttaggggaggtagattgaggggaggagaatttaagtcagggaaatatgagaagcagctgggatatggcccaggcaagagatgatgagggtctgaacttatccaatgggatggggatttgttcatctatgtagtaagtatctgctcaatatttactatgtactgaccctgtcactggagatcaatagcaaacaagacaacgttcctaacttcaaaaagcttataatctagtggagggagacacagtaaataaataaacaaatacaggtagcagtaagtactttggaagaaaaccaaacaaggtaaagatggtagggactgctgttttaggtaatggtggaggaaattcttgaagaggtgccaaagactggatagcagtaagggggccagcagtgtgactttctaggagagcattccaggcagaaagaacagtaagtgcaaaggcactgaagtagaaacatgtttggccttctaaagggacagcaaggaggtcaatgtggctggaatacagttaagcaaggtgagaaatagaaggaaatgaggggaggaatttagagaagtagcaaggtcccaagcaatgttgggcttagaggcaccttggtaaggactttggattttattctaaattccgttgaagctgttggagggctttgagcaggggaggtgacaaggtctgactaatggtttaaaaggatccccttggctgctgtttgaacaggctataagaaaggcagggggccaggcgcggtggctcacgcctgtaatcctagcactttgggaggctgaggtgggcagatcacctgaggtcaggagttcgagaccagcctgaccaacatggataaacccccacctctacaaaaaaaaaaaatagaaaattagccgggtgtggtggcgcaagcctgttatcccagctactggggaggctgaggcaggagaatcgcttgaacctgggaggcagaggttgaggtgagccaaaatcgtgccattgcactccagcctgggcaacaagagtgagactccgcctcaaaaaaaagaaagaaagaaagaaaggaagggagggagggagggagggctggaagcagggagaccagtaaggaaggaaggaagggagggctggaagcagggagaccagttagtggattatgcagaaatcctggcaagtaatgatggcagcttgactttggcaggtggagatgaagacccacaaagcccctttttcttttttctgcctccctccctccctcccttccttccttccattttctttcttttctttttttggagacagggttttgctcttttgcccagactggagtgcagtggtgcaatctcagcttactttactgcaacttgtgcctcccagggtcaagcgatcctcctaccttagcctcctgagtatctgggactacaggcatgtaccaccacgctcagctaatttttaaattttctgtagagatggggtctccctatattgcccaagctagtctcaaactcctgggctcaagtgatcctcccaccttagcctcccaaagtgctgggattacaggcatgagccactgcacccggcctgtcctgttttcaatattaagaatgactgcatattattgatcacttactgtatgcaaggttcagtgctgtgtgtgcattatctcctttagtccctgcaacttcatgttctcatataatccctatttatgcatgaggaaactgaggctcagcaaggtaaagtgatttgtccaaggtcatacagctctgtggtggagcagccaggatgaggactcaggtctgactgtaggactcttgaactagtgctctgtacattctgaatgtgtatatgtcggggatggttttcaggtgagttcacagaggaagagattgagttcctggaagccaggggtcaccacgtggagaaagtagatgtcttatcctgggtccatggcagccgaaggaccaacaacttcatcatcgctgttaaggaccctcggagcccagatgcagctggagccaccatcctgtagagcagcggggtggggcggggtctctgctcccccactttgcatgttcccagagtccctccttctcccaggtttggtctcagggggaccccagggatgccccagatcaggggccagaggggatgcttagcaaacccaatcccagagtaactggaaaattctccatcaggaggcctgtggtggtggtggtggtggtggtggtggtggtggtggtggtgagtgtcagcatctacagtacagccaggcaggcaggaccttgaggaatcagactatctgtctgtgtgtcacctctcctccttcagccatgctggccccgagcttagggatgtgcttgcaaacccttctcaagggtctcacaaccccaacatcttcagactggcctgacctgggccttgtcttccagttcctttctcccattcccagcctcatttcttaaatgactaggaattttttaatggaccatcatagggagggggtgctcctcttttcccaccaggttgaggtgggggccttgcatcgggggtccccagggtatggggtaggggtgggggtgggcaccagctcaggggcttccatttgcaaagggaaattaaagaaagaatgttgcttaaccatggctctggtttaatttatatttaactgggttgagagtgggagtgggagaggagacctcggctcaccctgtcccagtaaccgattcaagagtaacctggagtcaacgttgaaggactcataataatatctgtccagctaagacatgcaccaataataataattcataacaccaataactataatatatagcatctaatctttattacaagcctcatgaagtaggtactaatattattgccattttacagatgggaaacaggccaaaagaggttaagggacttgtctaaggttcttcatctattaaatggaagaactggggttcatctcagcatgtccaactctggaatttgtgctcttaaccaattccacacctattagttgaactctttgttataaagtatacgtcatatagtatatatcagacaataaataccttttatagataatatcattcatgcatacattcttctatccattacattccaggtactttgttaggcactagagattcagcactgaacaagacaggcttttcttttcttttttttttttttttgagacagttttgctcttgtcacccaggctggagtgcaatgacgtgatctcagctcaccgcaacctccacctccccagttcaagcgattctcctgcctcagcttcctgagtagctgggattacaggcgtgcaccaccacacctggctaattttgtatttttagtagagacagggtttctccatattggtcaggctggtcttgaactcccgacctcaggtgatccgcccacctcagcctcccaaagtgctgggattacaggcatgagccaccgcgcctagccaagacagactttttaatgggtttgcagtctatcggggcagtcaaatgttaaagaaataagagcacagataattcgggtaattgccatcacaataaactctatgagggatactaagagaatgtatatcaagaaagttaatctagtttgaggatccgcaaaagcttccctgagaaggtcatgagaatgaataggattgacaggaaaggattagatatgggatgtgggaatgtcattctaggcaaagggaacagtatgttcaaaggtattgtggtgagaaggaatgtgtcatgttttaggaggtgaaagaaggcctatatattcttcctagagcaggggttggcagagttttcctacaaaggaccagagagtaaatatttcagattttgtaggtcatatggttcctgtagtaattactcaactttgttgctgaagtgcaaaagcagccatagacaatgtgtaagacaacatcctgatggctgtggatgtgttccaatagaactttcttttctttttttttttttttttttttttgagacagagtctcgctctgttgcccaggctggagtgcagtggcgcgatctgcaagctctgcctgcaagtggagctcactgcaagctccgcctcccaggttcacgccattctcctgcctcagcctcccgagtagctgggactacaggagcccaccacgcccagctaatttttttttttgtatttttttttaatagagacagggtttcaccgtgtagccaggatggtcttcatattctgacctcgtgatccgcccacctcggcctcccaaaatgctgggactacaggcgtgagccaccgcgccccgccagaactttattttctgaaaacagaccccttcacgcctgtaatcccagcactttgggaggcacgaggcgggcggatcacgaggtcaggagatcgagaccatcctggctaacacagtgaaaccctgtctctactaaaagtacaaaaatttagccgggcgtggcggcgggcgcctgtagtcccagctattcgggaggctgaggcaggagaatggcgtgaacccgggaggcggagcttgcagtgagccgagattgcgccactgcactccagcctgggtgacagagcgagactccgtctcaagaacaaacaaacaaacaaacaaaaaccagacccttactgctataagggcagtagtgtgctgacccctacactagagcaccccgaggggatgatgagatgagatgaaactggtgagataggtagctcattcttatgaggctggtattaattcccccattttattgatgagaaaattgagagacccgaagcaacttaccagagatcacccagctggtagttggcagatgcataattcaaaagcaatctgtttgactccatagactatgtctctttctttctttctttttcttttcctttccttccttcctacctttctcttttcttcttttctcccttccttcccctcctttcacagatccatgattcaaaagccatctgttcgactccatagactatgtttcccttcccttccctctcctcccctcctctcccctctccttgctctctccttcccctctccttcccctccccttcccttcccctctgtctcactgtctctcttttgctttccttctttctctttcttccttccttccctccctttctttccccttctttcccttcccttccctccccttcgtttctttatctttttttttagagatagggtcttactctgccatccaggctggagtgcagtgttgcaatccctgttcactgtagcctcaactttcctggtcaagcaatcctcctgcctcggactcccaagtagctgggactacaggcgcataccaccacacctggctaatttttcatttttttgtagaaacaagagtctcactatgttgcccaggctgatcttgaactcctggcctcaagtgattctcctgccttggcctcccaaagtgctgggattacaggcttcagccactgtgcctggccacttctttaaaaatttttaaattattttattggattgcagatataacagtttttcaaatatcaaatactttatagatatataatgtatatctgtaatccaccccttcaaaatccaaaccctccaaaaatctcattgtcaataatttaatacacattcctccaacttttttctgtacactaacatatattctgtttaaaaagtaaaaatgggactatattttcacactgtctacaacttccttttttttttaacttaccaatagagcgtgggcattttcccctgttaatatatatggatccacttcattatttataataatgcatcgtagttcactgaagggtttaaccagtttccttttgatggatgtttgggtgatccttgccctgatatctttaggtgcctgagccatgcctgtagtcatacctactctcccaggctgtctttcaagtgacagagtgtcttagttcatttgggctgccataccaaaatatcataaactgggtagattggagcagagattagtgaaatagagaatagaaaaacaatagagaaaatcaataaaaccaaatcctggctctttgaaaaaatcaacaaaattgacaaacctgtcccagattgatcaagaaaaaaagaagactcgaaattactagaatcagaaattaaagatgggacagtacttacaatcttacagaaataaaaaaggatcacaaagaaatactatgaacaactgtatgttaataaatcagataacttagatgaaacataaaatttcctagaaagacacataccaaaactgactcaagaagaaatagacaatctgaggagatacataacaaataaagagattagtaatatatactaaaaagcaaactacttacaaagaaaagcccaggtctcagacggcctcactagtgatttctacaaaacattgaaaaaaattaataccaattctataaaaaaagctttcaataaatagaagaggaagaaacgctttctagtttattctgtgaggctagttttaccttgaaattaaaatccaacaaaataagacctaataagaaaactacagaccaatattcttttatgaacatggatgtaacatactcaacaaaatactagccaacaacatataaaaagaagtatacactgcctcagtgggatacattccaggaattcaagcttggtttactttcaaaaatcaagtattgcattatatttttttggtagaataaaaaacaacacatgatcatctcaatagatgcagaaaaggcatctgacaaaatcctaccaccccttcatgataacaaacaaacaaaaaacactcagcaaaccaggaatagaagggaacttcttcaacatgataaaaggcaaatataaaaaaccctcagttaacatcatacttaatagttaaagattggatgctttcccactaagattagagcatacccattcttgctacttctattcaatattgtattggatgttctagtcagggcaattaggcaagatacagaagtaaaaggcctccagattggaaagtaaaaagtaaaactatttttatttgcagatggcatgatcttgtatacaaaaaatcctaagaaatcaatgaaaacaatgacagctaacaaaggagttcagcaagattgctaatacaagatcagtataaagtttctgtacacttgcaataaacaacctgtaaatgaaattaagaaaacaattctggccaggcacagtggctcccacctggaattgcaacactttgggagactgaggctggaggattgctggagcctaggagttggagaccagcctgggcaacatggtgaaactttgtctctacaaaaattaactgacagtggtggtgtgtgcctatagtcccagctcctcgggaggctgaggtgggagaatagcttgaggccagaaggtggattgatggcgccgctgcactccagcctaggtgatagagtgagacccttaaaaaaaaaaaaaagaaaagaaaaagaaaaaagaaagaaaacaattccatttactgaagcatcagaaagaataaaatacttaggaataaattttataaaagaagtataaaaattaaaactataaaacattgtcgaaagaaatgaaagaagacctaaataaatgtaaagacattctgtgtttatgaatcgaaagatttaattttgttaagatgacaatacttcccaattgatctacagattcaatgcaatctgtatggaaattccagcagcactttattgcagaaatgaatatggatgatcctaaaattcatatggaattaattgcaagggactcagaatagccaaaacaatcttgaaaaagaacaatgttggaggacacacatttcccgattttaaaacttactacaaagtaatcaaaacagtgtggtaggtataaggataaacatatcaatggaacataattgatagtccagaaataaatcaatatatctatggccaattgatctcaactagggtgccaagatcattcaatgaagaaggaatattctctttaacatattcacatacacaaaatgaagtttgaaccttgcctcacaccacatacaaaaagtaactcaaaatggatcaaagacacaaatataagagctaaaactataaaactcttagaaggaaacataggggtaaatcctcataccttggatttggcaaatggtttcttagatgtggcaccgaaagcacagcaacaaaagcaaacatagataattggatgtcattgaaattaaaaagttttgtacataaaaggacaatcttgagtgaaaagacagtccaaaaaatgtgaaaagtatttgcaatcttatatctgatctgagtactttatatagtacccagaatat

SEQ ID NO: 10890 - DNA, 19542 bp, Homo sapiens
  misc_feature (1)...(19542): n = A,T,C or G, or insertion/deletion polymorphism (see Tables 1-2)
aaaaaaaattacttacaggatccaaaccttccttctctagtttggctttctccaagtagtaactcctctcggccacgctgagaagcctccaactctcactaatcttcttattgatctcagactgagggaggtgggggagctcctgctgcactttcaggtagatgtcgtaatagtacagaaggtaagcagacctgaggaagcaatgacttcttcaggctttcccagtaatggcaatgctggcagaaatccctccacttcccactccccatccctcgacccaggacttcattcaaccagtaagtactactatgctaagatatgggtagtcaagaggttgataaaacctagcttctcatttctaagcatttatctaaatagggactgaaagtcaagcaaacaaacatttaaataacatcctcagatggtgttataataagttataatcttattcctgattataactgatagctgtcagtacaacacaaattatattacattcaatttgtaatataaaaactcatggtataggagaaatgcttatataagctaccatattaaagttactacattagagccactatattacagtcaggagtaactacccaggaagataaggggctccaagggaggaggggaaaatgaatggtaaagatagcaagtggctgtttccccttcagaaacctggaagcaaaggctcatttgactggctttcctaaagatcgctttttgtgcaggaatgattttaaagcaaagatagatacaggtgtcctgtcctgtcattccactctcagggaaagcttcctcaaggggctggttatcactcacactccgtgctcctctacgcagcctttggtcaccaacctggtcaatggcacctccccaaggatgagagagggaagcaagcagaccaatcaaaatgaccaatgctggtagtttcacaagtttgaggtattcacagtcaagagtgaagttagagctacaatttggatattctgtacagatataattggtattatttctttttgtgtggtttttttctttttcttttcttttttttttttttttgagaggagtttcgttcttgttggccaagctgtagtgcaatggcacaatcttggctcaccgcaacctccgcctcccagattcaagtgattctcttgcctcagcctcccaagcagctgggattacaggtgtgcgccaccacgcccggctaattttgtatttttagtagagacggggtttctccacgttggtcaggctggtctcgaactcctgacctcaggtgatccacccgtctcagccttccaaactgctgggattacaggcatgagccatcacgcccagccttatttctaattttgtaattttattaatgctttgttttaaatgtttaaataacaacaatggcataataataaataatgtagctcttttgtacctagcttctaccatcagtatggtacaatttcctgtgacaacttgaaaacaaaagcaaagtctggccagtaatggcaatgctggcagaaatccctccacttcccactccccatccctcgacacaggacttcaatcataacactctttttcaaagagtcttaaaagttttcctcaatgcagctctccaagcaacttctgtttataaatgctagcagcaaccaaaatgtgttggctaacctgggtttctttgtcttttctccatgtattttatactttttcttcttcttgggtggcccaggagaggtgtaacaataggcttcctcaatttcctccatcacgacagttacctcagtaccatcatatgatgcgtccatggctaaaggaaaggaaagtcaaaataaagtttccagaatctcccctaagaggggcagcagcttcctgatcaaataaccccttacctctgccagtgccttaaggcttagacatttcccaaacccaatatatcctaagaagcacctggcttggttgtttaacacacaagattccagagctccacttcagccctcctggagcagaatctcccgagggtatggaaatccacatgcttaacaaatgcctcaggtgattcctcagaccgggcaagtttgtgaccactgccttagaaatacttttcacttatattcatgggatacagtacccacccacccctttaacacaaagatttattagccccaaattataacaattctatatggaaacaggttaaaaaaaaatgcttggccaggaatcagaagttctggcccattcctcctatgtttcatcaacttaagcaaatcccttcattgattcactcaaacatgtagtaagggcctgtatgtaaaagatttctttatactctgccagcttgtgcaattttggtcaggtcttttagctgctttttgttcagctttctctctcatgtataaaaaaagacatgtctcaactaccttcccacagatttatagtgataagactcaaaggatacaatagacacaactctatttaaaaataattggatgggcgcagtgactcacgcctataatctcagcactttgggaggctgagatgggagggttgcttgaggccaggagtttgaggccagccagcttggtcaacatagtgagaccccatctctattaaaaaaataaaaatcttttttaattaaaaaaaaaaaaagaaaatagtcaagtgctatgcaaatgaaaagggtttgtttttgggttttttgtttttgttttttgagacagggtctcactctgtcactagagaacagtggcacactctgggctcactacagtcttgacctcctgggctcagcaatccttccacctcagcctcctgagtagctgggactacaggtgatgtcatcacgcctggctaattttttggagagatagggttttgccatgttggccaggctggtctcaaaatcctggactcgggcgatctgcccaccttggcctctcaaactgttggtattacaggcatgagtgggattacactgtgcccagctgggttcattcctaaagtcaggtaattggcagaaaaaaaaaatggaagagttcattaagttttttttttaattttatataatttaaaaaataataatagagatgaaatctcgctatgttgtccaggctggtcttgaactcctgggctcaagcgatcctcttacctcagcctcccaaagtgctgtaattacaagcgtgagccaccacatctagcctctgttaaagactattatctgtgtctgagatgcttaacaaccttcccaaggccaccaagcccaagcagggacttgagagatagatttttaactcaaaaatccaactccctgggccttctttcattatgctacactgctatccatctctactggcaaccctccaaaccagcactgttcaataaactctgatgatggaaatgttctacatctgtgctgtcaaatatagtagccaccagccacatatggctatcgagcacttgaaatatggctagtgtgactgaagaattgaattagttttatttttaaatttatttatttttaagacaaggtctcactctgtcccctgggctgcagtgcagtgatgagatcctgtctcactgcagtctccacctcccaggctcaagtgatcttcccaccttggcctcccaagtagctgggactacacatgtgcaccaccaagtctggcaaatttttaaattgtttgtagagatgagatctcattatattatccaagctggtctcaaactcctaggctcaagcaatcctcctgccttggcctcccaaagtgctgggattacaggcatgagccaccaccacacctggccaattgtaattaactgaaatagcaacatatgctaggagctagagacagcacagatctaaacagtcatctgaccaaccaacatcagctctctggtgctgggctaaaaaacagagaatctactaacagcttttatgtctaggaaaagaggcataaaaaacttaataaccagttcaagaagagttagttttttttgtagccaagttctaaattggacttttaccacaagtctcaatccttggagggagaaaggctcacagaaaccacttgaattttacaagaggaaataacatagttgcccctgaaaatctgtcaggaggaaatttagaattctgggaagaggcagttgtggtggtaaatatgggactgatacgtgcagtacaaagcccacacacctctcatttagacctcactccacaaataaggtataatgagcactgcatgtggagtcaagagacctaaactctaacctgatgatctcagagaagtctattccacatcctaaatttcaactgtttctactgtgagaaaaggatgaacccagtggctcctagtcttttggaggcaagaattcttttgacaatgttgcgaaagcttaaaaaaacaaacaactacaacaacaaaaaacctctcctagaaattgcagacacactgtatttcacctataattttcaggatataccccaggtaaagcacacattattccttaggttcttcctagttctctgtcatctctaaatgattcctcttcctattaaaaacaaaaactaaactaacaaagaaaaacaaaacaaaaacctacattctaactgccatagtgcaacccaggaagagaacacagtctacaacttggctgggtaagcaataggccagtaaaggataagggaagcagtagttcaaatcaaggctacgtggggactgcgcttttttgccctgaattgacttctgggcggctgaaagccttgtggagaagggcagtaactgcaggagagcatctgtaatgaatggcatatagggtactaagcaccctgcgcaaaacgggttaggaaacactcattacagccaccttgggctgagggcaggaagacaacaccctacggttttgtttgttttattaccctgttctaagcctgagtacaagtttgttatcagactcgaggcagcagtatagcaatgcaaaaaaaggcaggacaatttaaggttaaaaacgaagggctctagaggacagaaaatccgggttctagtacagactacaccagtcgcaccagcacggggacctctgaccttaagcaatctacttaccctaagtctccgttatttcatctgtaaaacagagttaaggtcaatacctgaaatatgcgagacactttctctgtcccatcagatcctccttggaatctcacgagattgcctttgagggctcagccatgggccacagtttgactctgggctagctcctttccctcattctgggtcatgaatgaagcaagagccaaaccagacaaagtcttggtcaagctaagacgtctgggacatccgaatgtcccatacggattgcggaaggaggacactaaggctcagtggccctactttgtggaagactcagtagaggctcagagagccgcagcatccaactcgaggtcgcccagcggctcggcgcggccctcgaaggcgggacttacccggaggagcgtgcaagctgcgccgctcacattcccggaggcgcttggcccggcggctggacgagggggatggctggcgcactcgcgctccccgctgtcggcgagaggcggctccagtcgtgacagcagcaacaaggaagtggaggcgagggctcgcgcgcgcatcccgggggctgaaggagccccggccccgcggccccgcccggcgacacacggcgcggagtcgcgacagcccctctcgcttcccctcctcggagtcgcgatatggggtcctgaagggcaagaataggagcacaggttcgctccgcaggctcctcaccgatgcctgccgagggccccgggggtcaagccccggggagctcgaggaagacggcagggacacggtcgtcaccgaggcaccggtttggcggctgcaccggcagtagcggcacaccacggatcgccagggagacccgtcccggcggccctcgcggcgcaccggaagcggtcggcagcgcgtgactgcatgcgacccctggcgcaagcgcaacagcccagccctagcttgggagcggacccacacgaactgctcaaaggcttggagsnggtctagtaaggcgaacggactgcttccggccagaggtcccgggcggaggaggaagctgtggctgccggcggtgggacgccccggccgctcagcccccgggcactgctgtggggcgttcaggtaacaggggcggggctgtgctgagcgtgagggatctaggccccgcctcacctttcagagccacgtcgggcgctgggaagcctacaataccaccctctcctcagcacgacgttcaaggcctgacctcagcctgtctcagnctttccctctcattcaggatcgggttcatacgtagtgccgcatcaagtagcgccttcatcactccagtgatctgccctcaatccgtctctcccactggcccacgaatagtgatggtagtgagttcctggagtgactcaagctgagctgaatgaccgtatggagagcttccgtaaatcaaatagggattggattggattgtcctttctctccagtgtcacaagttgtccacatttgtacaagttcccgcacaaccctcactgtattccagtctgcctacttctctgcatctaccgccatcaccaaccttctagccaccatcatctcctgcctggactgatgtagttctccccacatcccctctacaatccattctccacgaagcagtcagattgatcattttgcactgtaagtctgatcaagtcactccctgcttaaaaccctccagtgtctcattcacttaaaataaaattcagacgtcttagcttgaccaagacttgtctgatttggctcttgcttcattctctttctatgtctcctctcaatattagtagttcccagaaccagctatatagcactctgtagtgtttggagtgctagctttgttgtgagcctcctgggtttgaatcccagccctgccacaagtaagcaatattaagcaagtaaagtgcttaacaaatgaggtttacgcagtagatcctcccacctcagtaaatggcaccatcatctgctggattcctcagtgctcaaaccagaaacctgggcgttatccttgactcctccttcacctcacatccggtccagcacagggcttgcaaaaacatagccccagactgactactactcaccatctctctattactactctaatccaagccaccattatctcatgtggactcctgcttttttctctgatacccttccattctttacacagcagtcatctctccttccttaaaatccttcaatagcttcctattgcactcaaattaacatccaaactgtatatggcctactggtttagcctgcttttatcttcagatttaaggccatctcttaggaaaatcaactttacccattaggttctctaccctgcaaccaaaagactatattgtaaatctgatcatgtcattccagaaaaacaaaaccaaaaaaccgtcaaaagcctcttaatgcccccaaagcaagctagaaacctgactaggacttcctgtgatttggtccttgctttcttctccaaagaattttttgttcctgaccaggacattctatttcctatatagtatttcattgcctttcatgttaaatatttcctttcatctcatgagttcctatttgtttattctttaaggcccaccatattattccctctttgaagtgcactgcccatccatgctccattccagttgattatctgcacatttatgttccagtagtactccgtaacctctgatttagttttcacatgctctartgtttgtcttccctggtaggctcctcaaaggtgggcactatgctccattcatctctgtatggctggcatcaagcatactgcttaatacatagtacatgtcatgaatggatggatacatgtatggaggtgatagtaaaaatctacccttgagaagggacagtcatagcataaagtcacagcaggttctcttgtcctttaaggattctcatgataaaatgcctacgaaggcaattacccaaaactgctactgctggatcatgttttgttggaccagcgtagggcagggggactgtttgttttaaattctgaatacttctagacaggatacaccacaccattctccaaatacttcaatccctgtttcactcacttacgccaccatcctggcccctaaaggcatttgagtttgaagcayctatctagggtccaagacttaaatctggaaggaccttaggcatcatctgggcttgtggtttgcaaccatgggacttttcaaaaatatgtattaaaaaaaaaaggaaaaaaagaaaataggcccagagagggactgtactacaacctgcccatcacttctgccataatctgtcacctaattggtctctttgcctctttgatccattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaagcgattcttgtgcctctgcctcccgagtagctgggattacaggcatgcgccaccacacccagttatttatttatttatttatttttgagacggagtcttgctctgtcactcagactggagtgcagtggcgcgatctcagctcactgcaagctccgcctcccgggttcacaccattctcctgcctcagcctcccgagtagctgggactacaggcgcccgccaccacgcccggctaattttttttgtatttttagtrgagacagggtttcaccatgttggccaggatggtctcgatatcctgacctcgtgatccacacgcgtcggcctcccaaagtgctgggattacaggcgtaagccaccccatccagcctaccatggcatctttgaatggtctggccacccacctttgtcatatacttggattcatgcaaatatttcagttccctgaatacctcaagctattttcggtgtgtgtgttttttttgttttttkttgttgttgttgtttttgagacagagtcttgctcttgttgcccaggctagaacgcaaatgtacgatctcagctcactgcaacctccgcctcctgggttcaagtgattctcctgccttagcatcccaagtagctgggattacaggcacccgccaccacgcccggctaatttttgtatttttagtagaatcggagtttcgccatgttggccaggctggtctggccgccttggcctcccaaagtgctgggattacagtcatgagccacagcgcccggcctatttttgcttttgaggttttgctgatgctatgtcttttgctggacagccctttccccatattcttggagatctcagcttcagtgccatcttagtgaggacatccctgaccaccctttgtataataagtagatcttcctcttttattctttgtcatagtctttatttcctttatagcacatatcaccctctgtaattatctgtttactttttatatttcccaccacattttatatttcataagaacagggaccttgactcttttgttcattactctacccttaaagcttggcacctgtaaatataaaatgaatgtatggctaccagaaacatcttcccacagtaaaaatctttccaggccagatggtggtagagctttgaagatctcactttggtggaatttcaagcaggaccatggcctggcagaaatagtaatctgagttaagaaatctaagctgcatgaacccgggtaggccccttcccagggccccagtttctgtgtccatcaaagaagctggagaataactcggaatgtatacagtgcartgctatttgcyaagctctttcactgcctgttatttcaatctgttctcatggtaggcagagcaaacattgttattcccatttttatggaggttcagaatgtttaagtaagctagataagatcacttctgtttcaaacattctgagtctttacaagtagcctctacaaaaagtcagtagcatgaatcctatcttttctttactttgactgtaaattgtcctttcctaatacaatttgtaaaaatcctgaaccatcttttaggggaaatccattgtttcctgataggtactccattttgtcttctcagctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctytttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccrgagccaccttctaaaacagatcctcctcaagctcamcagcagtgaggatcagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattaggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgttaaaaaaagaatcaactgttcttactctagagctcttttttcctttctgctgatttgctggaagcactacaagacttctgtttgttcgttygtttgtttgtttgtttgtttttaaagatggggtcttgttatattgcctaggctggaatgcagtggttattcacaggcatgattataacacactactctctctaactcctggcctcaagccatcctcccaaatagatgggactactgatgcacactgccatgctggccttacgaaatgttttaataggcatttcactaatagggatctggagtacaaggaaatacagtgcatttaagacataggctgggcatggtggctcatgcctgtaatcccagcacattgggaagatcacttgaggcaaggagtttgagaccagactggccaacacagcgagacccccatctctaaaaaaaaaaaaattartaagacatggatacaaccagggagggaggttataataatagagcatcctgttaatcagaatcatgggggagaacatacagcccagcgtgcctctcactttccagaaagggtgagaggatcattagagagttcattagagagtatttattcctaataagtcagataaatgtcagtttcatttttagaagtttcacacaatacctgctaatggtgtgatgtcatttttccccctgcttcaggttaattttttggatatttcagaaacccatagcaattcagtgatttttctttttgtagtagctcagtcaaaacaggtaacagcagattaatcatagaaaatgttgcttccacattaacaaaacaatcactgaaaaacagcagatgtttaaatagattattttatagcttattttggatattttttcttttaataaactaatatgatcatttgaattaaaagtactgtacatattttaaattcttaacatgtgggagaggcaaactcttctggctaagtcctgtggttgtatttctttgtcagctccttaattgctgtcatcatcctctcgtgtcaggattactgccacagtatctaattccttccctcacctttctcctgcagtccattctgcacatattgtttgatctattggcatcacaccatttcccctgcccaagtgtctgtagtggctttcaaatgcctacaaaaaaaactattcagctgagttttagtatcctctatagttgactacaacctgcatttccaacttgttagctcgatacaattctgtgtacataatgctccctgaagaggccattgttttcttttactgcataccgacttctgcctgtgtgccttgcccaaatgcctcatcctgttttctactaagctaggccctacacattcaggaactaactggaatcctctttcttccaggctttcttggagactccagcaactactccacctgttttcccctcatcttctccaaacttcttgtctgtaccactcaaatacttagatgttttctagatgttctctggctctttagactgtaagttccatgacagcagggatcagtcaacctttataatcttaatggtgcctaggactgtgctggacacatcgtaggcacttcaaaaaacatttgtgtataaattgatagacacgtacaatgtgttgaagccaccttatttttaaagctgtattaagcattgattctactagaaatggcttggagataaggtagggttttattccatttaaaagggtttgcaaaatttttccatgaatatagttgcctcaaatataattccaatccaggttataatctctgttctttgataatgaattatatataatgtaatttgataagtatatagaatatatactatttatagttgaacccatgtccctccaccaaaaagtcattgcaggacttctgttggcttccatttatacacacaagactttagtatgaaagggcttgtctaagtgctttgcatatagtagatgttcagtaaatatgtgcttaaacttgcttttttaaaaaaacaaatttaacatccctggccgggcatggtggctcacacatcccagcactttgggaagccaaggcaggcagtttgcctgaggtcaggagttagagaccagcctggccaacatggtgaaaccctgtctctactaaaaatacaaaaattagctgggcatgatggtgggcacctgtaataccagctacttgggagagtgaggcaggagaaccacttgaaccctagaggtggaggttgccactgcactccagcctgggtgacagagtgaaacaccatctaaaataataataataataataataataacaaatttaacattcttgatttacttaatatatcatgatttagatcctggacttccatcggaagatggaaatcatccgaaaaagaaaattttttagttcagtttacactggctaacacttcgattctattggatatcaggggtttttggtactttgttaagctaaaagaggttgatattatccctcgtcaggctttctgtggcttctccgtgcctctttggtcactccaacctcacttgagtggcaaccccacttctgctccagttgactaatcctctctgtaggccaacatactatacctaggcacctacctcaattgtgttgtcatgaggataaaaaggtgtacctgagactaagtgttctataaatgcactctattgtcattccatccctatttggaacataatgagtatcatctagagtcaaggacctgccttatcagcccttttttccactgacaggtcttggggttcagtgtttgagagccaccagcctaatcaatagatgataattcaagttttctgtgccattactcataagggccctgattcaaaagcaagtaagctaagatttattgtctattatatttcaagcactgtttacttattatttaatatttttagtaaatcataatacaaaaccacagtagactcagataatttaattccaaggttgtggacctattaaactgctgttcatgctacctgaagccagacttatctttaaagtggaatgtggtagcatactgtggccaccagagggcacaggtggactacatagggagacagcgtcaactgaagaaacctttggagctgccacttgtaatttctctgatgtggtacagattgagagggaaggcaacaaggaaagaaggaagagacataggatgttggacttgttcaaacaatttacctagaagtaactgcctgggaccacctaatcccctccattacataccatctcttctctagagacttttcccaacctattaataaccataggccaggctgagcatggtggctcatgtctgtaatcccagcactttgggtggctgaggcaggaggaatgcttgagcccaggagtttgagagcagcctgagcaacatagcaagaccccgttcctacaaaaatgaaattagtcagatgtggtggctcatgcctgtaatcccagctactcggaaggctgaggcggaagaattacttgagcctaggagtttgagactgcagtgagccatgattgcgccactgcactccagcctgggtgaaagagcaagaccctgtctcaaaaaaaggcaaaaacccaaaaccaaaaaaccataggctatgtaactgatcgtggatagacactcaagctctggaaatgaggcagtattagggaaataattacccaacaaacatatccatgtttgcagtaataacttatttaaccttataaacccactgcaggtcataggagctctaaggatggagcacatggccctactctcaagaagcttagtagaagagatagacgggacgtgggggagtgagtggtaaatgtcatttttgagaatatgcaaataatatattttactctttatgagtggtaaatgtcattttagaggatatgcaaagatatacaggagtatagaggtggaccctaaaggagcccctgaatgagagaagaggaattcagtaggaaatgttgctaaggaaaagggacatttgataagtatctggaaggaaaagtagggagttagggagatggggctgggaggcaactcctggcagaacagcatatataaaggcctggggtatttttttttaatggcccatttgggagcacctaaggttggtgggtggtaagccaagcaaaggatgtgtggtagaacgaaaggctggagatgtaagggcagagttttttaagtcttgtgggttagaccatttattttgaacttatcctaaaggcactagagaccccttctacttgccctaagtagcaatggtcaacttctttttaattaaaataattgataactagtatggaggttggattgtagaaaagcagataaactagttaggctgtggtatagtactgaagagaaataattaacactgaggggtaggaaaaacatgttggatttgagaggcatttacaaggtaagatggatttagtgtgggagttgtaaagggagatttcatgaaatttcaggtttctgcttaagtggctgggtcgtgccaggatcaaagtatgttaccaggagaaaggaagacaagtttgagggtcatgttacatgtgagatgtctctgggcatccaggcagttgtctgttaacaaccagccctggagatttatatacagacagatagactgtttggcgttctagaatggttaggctagaaatattttttggctgccacagatagcacggtgattgaggacatacatgtggatgaagttatgtagagtgggcttataatgcaaggtgttcaacatatgggagtccatgagccaacctttttagagctatacgtgtatacctgcacatgtggctatttccctgagtcatactttcatcagcctcaactggatctgaaaacaaaatacttaagcagtggtattaagtgaagagagaagaggccaaggacacaagccctgaaaggacagatggggaagtgaggccctccaagatggctgacagagatgctccagaatgactgagtgtacctcacagggctctggatcctaggtgctgctcacaggcaggagtgcacactacggtaagactggaaggacccttagactattcaactccttcactctgtgaggtgggaatgaggttgggagaatgctcagggttactgcaaaaggaggactaaaaactgtccttaaccctgtaccctcatgaactgagcgaggcataaagaggaggacattctgggagaggcttcatggcatgtatagggtgagagtagtgctctatttccttacaaaatggtgtgctccaatcaggaatctactcctagttctctcagtcatcagaaggtgttagcctctatttactgatggaaaaaaaatgtggctcaaaggtcacttgcccaaattcagagttaagatagtagtaaaacatgatccaaaattgggctttctgatcccagtactgtatggaataggagtcacgcacgcctataatcccagcattttggaaggccaaggcgggaggaatgcttgagcccaggagttcaagatcaacctgggcaacatggtaaaaccccgtctctacaaaaaatagaaaagactagccggagtgtagtggcacacacctataaccccagctgctcaggaggctgaagcaggaggattgcttaagcccaggtcaagactgcagtgagccatgattgcgccactgcacttctagcctcagcgacagggcaagaccctgtctcaaaacaaacaaacaaaaaacagaaagggtcctcaagcaatctagtcctcctcccctcttcaccaaaggtttaagtgactcattcaagaccataaaggaaaaagaattggatttctttatgtccttctccgaggacagatccttttgttatgactgggaaacattaatgactgaattactctccaaatgtaacagatgattttttttttctttagatggagtttcgctctgtcgtccaggctggagtgcaatggcctgatcttggctcactgcaacccctgcctcctgggttcaagcaatgctctgccgcaagcctcccgagtagctgggattacaggtgcctgccaccacgcccggctaatttttgtatttttagtagagacggggtttcaccatcttggccaggctggtcttgaactcctgacctcgtgatccacctgcctcagcctcccaaagtgctgggattacaggcgtgagccaccgtgcccagcctaacacatgatattttattttatttatgtatttttttgagacagagtctcgctctgtcacccagcctggagtgcagtggtgtgatctcggctcactgcaacctctgcctcccatgttcaagcaattctcatgccccagcctcctgagtagctgggactacaggtgtgcaccaccaaacccagctaatttttgcatttttagtagagacggggtttcaccacgttggccaggctggtcttgaactcctgacttcaggtgatccacccgcctgagcctcccaaaatgctgggattataggtgtgggccactgagcctggccaacagatggtattttaaaactcactggggcctaaatgtgttttagtcagaaccctccttgcacttaaataatttaaatacagagtaatgtattattagagtaacaatttattagcagacaaaacaaatgaaacctctaaatctcaacacacatacaggatcttacataataaacagcataaaacataagcttctagaagaaaagtatctgctattaaccaactccccctcctttccagtaggctgcaatacattaataactcatcctcatcccataagagggttaagcaatgatttacatggaattacatcaaggcacttgctttaattaaaaaatacagtataaaacatgttcctaaaagtcat

SEQ ID NO: 10891 - DNA, 74677 bp, Homo sapiens
  misc_feature (1)...(74677): n = A,T,C or G, or insertion/deletion polymorphism (see Tables 1-2)
agaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtcctttactggtgtttcatcacaaaatgcatagcatatgtgagttctaaatacctggaacctgtttttagaggacgaatccctcacctactgtatcccctactacttcaaaaaaaatttttagaaaatcttatgacttctttcctaaagatgtctggggaaaattccatccatattgagatgcaattagtttgggggaagaagaaaaaatacacttgacatttgttgtagttaatgcctcttaattgcttaaattggtgtgtatctacttaaaagaggacagtcttaaatttttattctggtgatgtggattttcttgaaagtgcattgagtattaatgaagatggcgtatagacttttatgtcattgatgtattaatgtgacacaacaaaatggatttctttcctcatcagtttttgtgtgaagttatctttaattgaggtacctgtcctaagcactgatagcctttggttctgtctaggaaaggaaaagaaagggacttcacattttttgagtaactgccatgggccaggcagtttatatgagggtttctcatttaatcctcacatccttaagaaggtgactatctccataatacaggtgagaaaacaggcttgttagttgaataaattgcttaagatcacagattattggttgggagcaaggattcagaccttgttcgctggtagccgcaggaagcactgaatagtttccaacagggcacctgaaaaatggtttactacttaccactattctctaatacttcttacctgattcagttcctccagacactccctgaaaatctgtgtgccaaacagtgaagtaaagtacttttgctattaatgtaattgaggttaaatatttacgtgtgcaaaattcgacgtttttcacttgtcatttatctcttttttcaagttggccatttgtcttgaagctcaacagaattgtaatgtttagcactaaggaaaggaaaagctgtcaaggagcaaaagcagaaggaaaccactgccaatgtgtgcaatataaaaataagggtaaaataatttttactttatttgagacaggtctctgttgcctaggccgaagtgcagtggtgcaatcatagctcactacagcctcgaactcgtggactcagacgatcctcctgcctcagtcttcgaagtagctgggactacaggtgcgcgccaccacccccggctaattttttttttttaagagacggggtctggccatgttgctaaggctggtctcaaactcctgtgctcaagctacatttccgcctcaggcctcccaaagcgcccagattgcaggcgtgagccactgcgcccaggctgggtgaagtaatttgtaaaacttagtcctgtgggagttattttagcttagtcgattttcctcatccgtgaaatgggataacttccacctggtgcccactcaatagataagaagaaataatgtctgcaaaacattgagtacagcgcctcttaggctttcttaagtgaagctatcatctgtcattagctttctctgacccagatgctacacgctgtgggctagcaagaacacggcttcaaataaggtggggagaatggctgtaaggggacagtgttccattaatggccaaaaaaaaaaaaaaaaaaaagcagcctaaaaatccttttaacgtatccttaaatattcacttgagggttcaacctttctttcctttctcctgacctctatcggccctaattaacctgttcctgccgccacctaactttaccctaatttggaaaaagctgtgactgcccaatacttgttcctcttttccccctacacctttgagcactagaaagctccagacccagagctgctgaggggcgggagaggaagggagtcactaagccgcagcctggcccttcctcccagggcagcgtaaattcacgcaaacattgattcgttcgctcaacaaacattgggaacctaagtgccaggcttgtgccaggccccagtctctgacctcatggagcccacagcccactggggaacagagattaagccatgaaacacgaaaatgagtgccacaaagacgtgagctactagagtatcaggaccgacctcctttagaccgctggatgggagagtcgtttgtgaggaagtgacttttaagctgaggcctgaagggtgatctgagggagctgctcttggccatcgatatgccgcgcgactccccaggccctcggacccggagcctggaccaaggctgggcgggaaggccccgggccaggggcggagccacctcggcggcgaaagccggaaagcggaagccgaaggctgctgcccggtggtcggctgagcggctctagcccagatctcagacggctgagtcactgcatcycggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaaggtaatacatatatatattttttttatttgtaaagcattcttcctgcaaaaagctcccacaaataatataatgttactttcccccgagtttagtagtgccaggtgttcatgtatacttcaacataaatgaaaaaaaaaaaaaaaagatgtacaaggtcattatgtcttttaaacccggttccaggtcccagaataaggtttacaagccacctccttcaggctgcatacacaatgccaccgcaatgctttgaaagtttgcttctgatcaaactgcttaaaaacaaaaaagacatgaaacctgtatgtgcacagctcagattgatactatcaacaatcttattgagctgttccttatcttttattcctctctagtttttctagtgctcttttccttaagaagtggattttttttttttttttttttttttgagacggagtttcgctcttgttgcccaggctggagggcgatggcgcgacctcggctcactgcaagctccgcctcccgggctcagcctctggagtagctgggatcacaggcgcccaccaccacgcccggctaattttttgtatttttagtagggacggggtttcaccatgttggtcaggctggtctcaaactacaggcgtgagccaccatgcccgcccaagaagtggaaatatcttttaaggtaatattaatttgaaatattttgggcattgcttttgaacttacttttaggtccagctattttagatttttgaaggaaacagtccttcgaagtattgatttattctaacttttgagaagcatattttccacatagcatattgatacttaataggctcatgacttttatgaggcttgacttaataatgtaaggatttcctttgcatcgtttaactaatagactactccctctttcagattggagcctacgatcagcagatatgggaaaagtcaatcgaacagactcagattaaggtaaattgatttctttgattccgcctatgtttcactgcattaatatgaagagtggaattgtacttacctggtaaactctgcatttaactaccagtatggcattctttaatctttgaaggttataagaaaagcagtgcaagcataatgagaagtgacacttgatttttggcctcactatcaggaaaacagaaaggagtgagttgttctatgatgaattagagagcaaatgtcccatataaatagggctggggttacttagctctggctagtttttaccacttggcagtgcaggtccaaatattgccagagtttcagatttttcaagagaagctggaaatacacatttttatatgaaatatattgtgcattttgtgtcggatttttaagagactcttccttctcttcctcctcctcctttgcaagccaaataaaatccatttgtggcctgaatccagcctatggtcccccattttattcaatcactggcttagagtatgtgtttttgtttgtttttttgttttgttttgtttttgagacagagtctcactctgtcgtccaggctggagtgcagtggcgtgatcttggcccactgcaagctccgcctcctgggttcacgccattttcctgcctcaacctccagagtagctgggactacaggcgcccaccaccacgcccggctaattttttgtatttttagtagagacggggtttcactgtgttagccaggatggtctcgatctcctgaccttgtgatctgctcacctccgactcccaaagtgctgggattacaggcgtgagccaccgngcccggcctagagtatggttttaagtttttcaggttcttaaacttttttctacacagctcttagaactgagaggattcttattttatactaaccaagtgaccaaaaactgttatataattcagaatgccagtttattaacttataataggggaggagagggttaaattatcttctgatattccaaagtcagagttgtggggttaagccatttggggatgctggtacaaattcatcatggaatggttgcttggtaaccaaatgtaattggatagtcttgagatgtggaaaagcctaaagaaccatccttggccctcaaaagaatataactctctgcgactttaatacttacttaaatcttatggattcagggcctcacttccttgcaaagtgctgataaatgccagctgattcttgtttttgcattacctttcaaaaagtattgcagcagacccttcattaatacttaaaaaaactgggtgaatacaacttaatattatctgttctgttaaataggccaatcaatagaaagctacttgaacaacaagtagccgactaacttttcacaatttggtatagtccttgattatttatattagtgggagatggggttaggatgaataagtctccagattttattttgtgattctctaaagcctgtcctgttatttttttgtgagctgctaaacatcactgatagtaagtatggtgtaatggaaacagcatagaagtggagtttgatcttgttttgtgatctctagccttgttatctaaccttcttcccctagccaatttaaagatttccttcaccctttttttttttttttttgagacagagtctcgctctgtcaccctggttggagtgcagtggagcgatctcggctcactgccagctccgcctcctgggttcacaccattctcctgcctcagcctcccgagtagttgggactacaggggcccgccaccatgcccagctaattttttgtactttttttttttagtagagacggggtttcaccatgttagccaggatggtctcgatctcctgacctcgtgatccacctgcctcagcctcccaaagtgctgggattataggcmtgaggcatgagccaccgcgccctgcctgatttccttcactcttttccatgtcatttaatacataccttccttttagtgcatgatatcaaagttatttgttaacctatgtgtgttcataggcctaagggtaggaagtgtgtttgtttcctactcttagaacatcttgattcatactaggaactctgtctgttgctatagttaattgaaccctatccatcatgcatattttttactcgttctctcatagggtaatctacctaaccacgccttaatgtatgcttttaaatttagcggcggtgggaagaatgaaatgtaaaataactataaacatttactgagctttcagtgtgatagtagaaagctgaaaaaaaaattactcagctaatgtgccactcttgtactaggtgctgagaatacagtgaaaaagatagatgtgattgttgccttcatgggtttcacagtctgatagtgatgggagaaaagcccagatatctttttaatatgcttaagtcttaaaaaatgaccaaagtatagcatacaaaaaaattaatgctaaatttaaaaatacatgaacacaaatacaattttttgaaaacaaaaaataaaaacaaaaaataaaagaacaaataagcaaaaaaaattttwaaataaaaatattaacatcatatcacagtactgttatataatttaaaattatatatttaaaagtataattcagaattatgaaagataaattttaaaaatcttaacttgggtcatgaaaaatggtatgaactcttcaataagcatttattgaactacaatgtttaaggcattttgttgggtgctgagcacaagagaaaaatattaacaaacagaagtataagacttgtttagaggaagagcaagtaagtagcccaatatgattggagaataaggtacatagatagagtgataggccataaatctatttgaaggttacttgactgctttactaagaactttagatactattctgtagaaaattgaaaggttttaatggtttttgagtagaggagtcacatcatatctgtgtttttgaaagatagaaataaaaatatagacattataataaaatctatggaatatttccagagtagtacttattattctcaatgtctatattaacaaaaaatgtctagtttgactaggaaggtttacaatgaatcatattaatattgaagaatctagagaaagaaaatgtaatcaaccaaagtaaaacagggaaagaaataccaaaaataaaatgaaagcatccattacgtatttatttaacaaatatttgttgactgcttacctacaatgtggcagacactagctatgcctacataatggtaagtaaaaacattcaatcattttttttttttttgagacagggtctggccctgttgcccaagttggagtgcagtggcatgaacacagctcactgcagcctcaatctcctgggctcaagtgattctcccaccttagcctcctgagtaactgggaccacaggcatgcaccaacaggtttggataatttttaaattttttgtagagacaaggtcttgccatgttgtccaggctggtctcgaattcctgagctcaagcagtgcttccaccttgtcctctcaaagtgccgagattataggcwtgagacgctctgcccagccatattcaatatttttattttcatggaatttatgacaaagtggttgagaataataaaaagaatccttctaataaatgcaaattacttwgtggcaaatactgagaagaggtctgtttacaagctactatacttataataagggaaataaatgagcctagttgctgggcatggtggctcatgcctgtaatcctagcactttgggaggccaaagtgggaggatcgtttgaggccagggatttgacactagcccgggcaacatagggagactctgtctctacaaaaaataagttagctggccatgatggcatctgcctgtggtcccagctactcaggagactgaggtgagaggattgcttaagcctggaggtcaagatgacagagaccctgcctttaaaaaaaaaaaaaaggctgggcacggtggctgatgcctgtaatcctagcagggaggccgaggcaggcagattgcatgagctcaggagttcaagactagcctgggcaacatggtgaaaccccttctctgctaaaaatacaaaaattagctgggcatggtgacacgcacctgtagtcccacctactcagggggctgaggcaggagaatcgtttgagtgtgggaggcagaggttgcagtgagctgagatcatgcattgcactccagcctgggcaacaaaagcgagactccgtctcaaaaataaaaaaaaaaaagaagaacctaattaagaaggtcagataagcttttgctaaggaattgattaaaatgagatctgaagcatgagtagcagttaattaggtcaagaacaaatacactaattctacacaaactttttcagaaaatagagaaggaaatatacttctcagctcattctatgagactagtattaccctgaaacctaaaccagacaaagacatcataagaacattcgttatgaatgtatgtgtgaaaatctttaacaagatattaacaaaaccaattctacaacacataaaatggcttatctactatgaccaagtgggagttatcctgggaatgcattaatttgaaaacaaagtaatgtaatatgccatattaataggataaaggacaatcatatgatcttctcagtaaatacagaaagagcatttaacaaaattcaatgcctattaataataaactaggttcttaggggaacttcttcaacatagtaaaggttgtctaggaaaagcctgcaacaaacttcacacttagtggttaagactgaatgttttcccctaaaatcaggaacaaagcagggatatctgctcttactatttttatttaacattgtactgggagtccyagccaatgtaataagcaaaggaaaagagatgaaaggcattgagatggaaaggaatatgaaaactgcctttactcatgacagcataatcccatatttagaaaatcctaagaatatatataaaaaatgacagtaggctgggcgcagtggctcacgcctgtaatcccagcactttgggaggccaaggcgggtggatcacgaggtcaggagatcgagaccatcctggctaacatggtgaaaccccatctctactaaaaatacaaaaattagccaggcgtggttgcaggcgcctgtagtcccagctactggggaggctgagacaggagaatggcgtgaacccggggaggcagagcttgcagtgagccaagatcgcgccactgcactccagcctggacgacagarcsagactccgtctcaaaaaaaaaaaaaaaaaaaaaaaaaaaaaaaattacagtaacaaatgaatgtggcaaggtcttcaaatacaagatcagtacacaaaaatcagttgtatttctatataccaacaatgaataattcaaaaataaaattaagaaaacaattttataatagcaacaaagaataaaacacttaggaatgacataaaaagtgtaagattcatacatggaaaactataaaacattgcttagagaaattaaagaaggtctaaataaatggaatagcatttcatgttcatgatctggaagattcaatattgttaaaatgtcagttttctccaaatgtatctatatattcaatgtaatcccttcaaaattccagcagaagtttgtttttggtagagattgatgagctaattctcaaatatatgtatgtaatacaaaggatgtagaatattcaaaacaaatttaaaaagaatagtgttggaagatttacattactacatttataatacatctgttagaacaaaattaaaaagattgacaataccaaatgttggcaaggtgatggaggaactacaactcttctactcttctacactgctgttgggcatggaaaatggaaaatagtttggtggttttaaaaatgttaaatatgtacttctcacatgacccaacatttccactcctagggtatctacctatatttagggtatctactatatttaacattttctatccaagagaagtgaaaacataaatacatgcaaatgttcatagcagcactattcttaatagccagaagtaggaaaaacccacgtgtccatcaactggtgaatcaattggtataaacaaatgtgttatagtcatacaatgaaatacaattcagcaataaaaactgttaatacatactgcatcatggatgaacataaaaaatgtcatgctaagtacaacatattgtgtgattgtttatatgaaatttctagaaatctatagaaatagaaaacagatcaaaagttgcctatggattgaggggaacagggctttcctgcaaacaggcagaaaggaactttttgaggtgatggaaatgttctaaaacttgagtgtgataatgattgcacaactctacaaatttactaaaaatctaaattatttactaaatctgtaaaaatagtttagtttaatagtatgtaaattatacctcaataaagctactttaaaaattataccaatagtaaaagtaggaaaaatcataatatagtacaccaaaaatgtaaatgtatacatattcacaattaaaattgttttctaaatttttaaaaaatattttatattttgtagagacaaggtctcaccacattgcctaggctggtcttgaactcctgggcttaagcagttctccctccctggcctcccaaagtgctgggattacagatgtaagccaccacacccagccctaaaattttttaattgagagaatatattaaatctaatgtctaatattattttcagtgatggagtgtaacttagttctccaaaataagcctaaaataagaatctccccttttactaatcttttttttttttttttggagacagagtcctgctctgttgcccaggctggagtgcagtgctcacagcaacttccgcctcccaggttcaagtgattctcctgcctcagcctcccgagtggctgggattacaggcgcacgccaccatgcccagctaatttttgtatttttggtagaggtggggtttcaccatgttggccaggatggctcgatctcttgatttcatgatctgcctgcctyggcctcccaaagtgctgggattacaggcgtgagccaccacgcctggccccttttactactctttagcatactgtttgagatacatttgctaagatgagcaaaacattctaattaatattaattaatattatcttttcttttttgtgtgttttatttttaaaaattaatattagagtgaacaaaaatcactgtttgaagatagcatggttttgtatttagagaataaaaaaggctaatcagaagcacagagactacttcagctgtatttataatgttttatttaagcaggatggtggccatatgatagatgacactgacactcctcattaaagatgacagtttgaggccatgcgtggtcgctcacgcctataatcccagcactctgggaagccgaggtttttgctcgaggccgggagtttgggaccagcctgggcaacrtagctctacaaaaagataaaaaaattagctgggtgtggtgggcatgtgcctgtagtcccagatactggggaagctggttgggggggatcgcctgagcccaggagtttgaggctgtggtgtgctatgattgtgccactgcactctagacggggtgacagagcaagaccctgtcctgaaaaaaaaacaaaaacaaaacaaaacccaaaaaatggtagttcaaatacatgcactaatctctcctgaaacctctttaaaagtacaacarataagaaaaaatcatggcagcctgcaaggacttaaagaatggaagaagagactacagtaaatgagagctatcaatacaatttcgaaggttggaaaatgaaagaagtaaaactcttaagtgcctgcaatagggaaagccaataggaaacaagtaaaacccctgtaattaacttctgaaagactcaggaattagatgtatcaggtataatctgtaggagtgagaaagaactaaagacaggattgtttgaacatgtgtataagggataatagatctacccccagatcttccttattccatgtagccacatagttacccttatcttcctctgacagaagaccgggttgaagcttgctctctggagaggctgagccagagaagttctggattctggaagaccagaaacaaatcagagtctggtgagatgctgcactaataatggggattaagtgaaagtctggtcgtcagatttataatctgcaaacagaagactggaatttcttttcgtcaaaactgagtaaccaaagagaacctaaggatactgaaaagtgaaatgactggccacgcctctatagtgaggtccactattcaaaatgcttcacgcattgcacactgagcttgcattcagtgtgttagtgactgttaattataaatggataattaaagatcatcaaatatttaagacctaaagaaaaagaagaaaagagaaaagaagcaatgcaggaatcataaaaacagtgtttttaaagatataattactacctttaaagaactggatactataaaaagactgagatatcttcaggacatctattgtataacattggtgactatagttagtatgttgtattcttgaaaaatgctaagagagtggatattaagtgttctcaccacacaaataataaccatgtgaggtaatgtatatattaatttagtcattctacagtgtatatccacttcagaatatgttgtacacactgaatacatagaatattatctgtcaatttaaaaattaagaatgcttaaaaaatagactatagattagaaagtgagaagactagaaaataaaaataatcagaataaattcaggggtggctgggtacagtggctcacgcctgtaatctcagcactttgggaggcygaggctgatcgcttgagcccaggagttcaagattagcttgggcaacatggtgataccctgtctttacaaaaaatacaaaaaaattagctgggcttggcgttgcatgcctgtagtcccagctacttaggaggccgaggtgggagatcatctgagcctgggaagtcgaagctgcagtgagccgtgattgcaccactgcactccagcctgggtgacagagtgggaccctgtctcaaaaataaacacataaataaataaaaattaaaataaattcagtggaaaagttagaagataaatttgagaccatttcccagaaaagtagtataaaaatgaacaacaaaaaagaaaatagcaaagtgagtgcaattcatgcaggaaatgtaatatccaactaatagatgttccagaaaaaggaaatacatggagaagaagaaattaataaataatttwaaaaattgccccagaaatgcagtactgtgtatgtatttccagattaaaaggatcttttcgttgggcatggtggctcacgcctgtaatcctagcactttgggaggctgaggcaagaggatcccttgaactcaggagtttgagaccagcctgggcaacaaagtgagatcctatctctacaataaaatttaaaaatcagctgggtgtagtggtgtgtgcctgtagtcgcagctactcagacggctgaggtgaaagggtcctttgagcctgggagttcaaaggtgcagagagccgtgaatacaacactgcactctagcctgggcgacaagcgagattctgtctcaaaagaaaaaggaaaataaaaggatcttttgagtcatcagcactgagaaacattatcatgaaatttcagaacatttagaattagagcttgggttaagcatggagtagagtgaaggatcaaaacggatcatgtagacaaaaattgggagtcagagatactgcccctcagcagcaacttctagctcatttggaagctaaaagataatggaatgttcagtggaaggtgagggacaatggcacatgagagaaagtgattttcaacctgaagttttatgcccagcctaattattaatcaagtgcaaaggcaccactgatatattttgaacttagagtctcaaaattcatatcccatactccctctctcagaaagctgtgggaggacatgtactgtattataatccatgaataagccagaaaggaattcatagtgtcagaaaacaggacagccaacacagcaaagtaaaaggaattccaggataattgcaaatgtctcaggatgataccttatatctgacctagaaaacaaccagtccagaatggagtatgaggacagaaaattgatatagaactcttgaagggggaaaactaaactgatatatgttgtgttcgagcatattggaagcagatatgtaacagagggagtttaaagatgaattagtaatagaagattaagtgcattaaaaaatgaggcaattacagttctaggacaagcaaaaaatttgtgagaggaaaatataatagttcactacttggcttagctgtgaacaatatttatgtaattataaccctctaaacattgatgtaacaaaaatttgtgataaaactctattggaaaaaactatagttcaggagggcgtgcgtgtttggtgatgctgtaatcattaatagtgtgtagtatgtcttgcattgttttaagcaacacacacaattgatcctcatgataatcttatgaggtatgtgctattatcttcccttttttataggtgaaggaattgaggcatagaaaggctaaataagagttatttcctcatcttcaacagtaagaaatgaatggataacatctgaaattgatgaaagcactgtaaacattttttgttttagaagtaaagagaagaaatagctaggatgtatgaatcaagggtaaggaagggtgagactggaatgttattttttattaaccttgtaatatgagtattattttagtacaaataaagatttaattttacaacatttttcctccaaaaccaaataatacattaaatgatgttacctgagtaataggatatacatatatttccatatgcgataggtagatttagaggtatgtgagtatttacgtatattggctataccaatatgctttatttataccggtgccaaaaccaacaaatctccttagcatttaggcaagaaatttagagtcagatggactgaactgtatattatagtaattttcctaattattcactacctgtaattattcttacctgtaagaagattatatggctgcacttactgtcatgtgagttgcagtgccttcctataagagaagaattcttcctggccccacagacttccaccttagtcaggggatttgcttggccagtggaatgtgagctgaatgtgaccttcctcccatgacccaatacttttcattttcttacctttcctattcagtgaattgctaaagtactgaagtcagggtttagagttcttcaccttcacactaatctcacattttcagttaccaatacttctggatgatacctgctaaatatcttttgaatatgagtactcttcccagttcacgcttctaattacctggtctaacctattgtctactcatctggttggcaaactattgcttatgtgcaaatctagctgaaacacagccaggtttagtgctttacatatttatattcaatgtctgtgtctgctttagtgctacagtggctgagtggttgtgacagagattgtatagtccagcagtccccaacctttttggcaccagagaccagtttcatggaagacagtttttccatggactggtgtggggggatggttttacaatgattcaagcacattacaattattgtacactttatttctattattaccttataatatataatgaaataattgtacagctcaccataaggtagaatcagtgggagcccttagcttgtttttctgcaactagacagtcccatctgggggtgatgggagacagtgacagatcatcaggcattagattctcataaggagcatgcaacctagatccctcgaatgtgcaggtcacagtggggtttgcactcctgtgagaatctaatgccgccactkatctgacaggaggtagggctgaggtggtaatttgagcagtggggagtggatgtaaatacagataaagcttcccttgttctctcacctgcccctcacctcctgctgtgcaacytggttcctaacaggccacgtaccactattccatgccctgggggttggagacccctgatatagtccataaagcctaaaatgccatctggctctttatagaaaaattttgtccactcctgattagattactggggtaggttttttaactttctaactgctttctcttgcttcctatctctctttaccctccatctgttctttatagcagagccaggttgttgttttttggtttctgttttaacacaaatttgattatttttctcatatttaaaactgtttcctgacttcctagtacccttacaataaaatcatactcctagcatggttatagttttcacattatggcttcttctcatctcacaagtttacctctctcacccatgtcttgacctcttttcacttccattctgtgctttaggccttctcaaacttactttagtttttaccatgctatctcttattcctgggtcctctcatgcttttctttctttcttgccctgccctgccctgccctgccctgccttgccctctcctgccctgccctcccttcccctcccctccccaactcccctccccttcccttccattcccttctttcgagacagagtcttgctctgtcacccaggctagagtgcagtggcttgatcttgtctccctgcagcttccacctccctgattcaaggaattctcctgcctcagcctcctgagtagctgggactacaggctcatagcagctactcccggctaatttttggcattttagtataagagacagggttttaccatattgcccaggctggtcgycctgaggtcagggaatctgcctgcctcagcctcccaaagtgctgggattgcaggcatgatcatatgtgtttcttgattcctcattttgctatatcacatgtgcaactttacaagttcttatacattcttcaggtatcaggttagatactatttttctttgtggaaatctttcttggacttcttaaatgtgaataaggtgtcctttatggatgttcctgtagtgctatacttgccttgtaattgttttgttgttcaccatatgccccaaatcaggggtaacttccctctctgcaccagactgtataaatagttcaattcttttgattgtaataaaatagaaaatttcagcaccctaggaaatagagatttctcacagggtttcacttgttttttattccttgtttaatacaaagtccaattatattgcatcaatacctccagtgtttttgttcctcttccaaaaagtggggacttcatttgtcaagtggttctgagcttgtgatgatgttgcacagttatgttgggggcagacagtagagagggctgcgtacagcctacagctggggatctgcagagaatttccagaccactactctggcaactagtgattatgctgattctgtcctacaatcttttcctgggctgctgaggtagaggttgtggccagtaaggaaatccactcataatgcccattgaacctctcaaagttaagcagtcttgtttgatttaaacaaaacctctctctactttgattagggatgcattttgtgtcatatagcgaaaggcaggatagtgtagtggttagagcacagactttggaatgagaatgaaagggttggaatctctgccttggttgccttatccgtaaagtgaggataataaaggtaccaatctcataggacatttgtgaggattaaatgagtcaagttaacttaagtacagtcatgtgccacataatgatgtttctgtcatcaatggacctcatatacgacaatggtcccataagattataatggagctgaaaaattcctattgcctagtgattttgtagccatcctaaagtcatagcacgacacattactcatgtgtttggagtgatgctggagtaaacaaaccaaatgcactgtcagtcataaaaagtatagcatacagttatgtacggtatctaacacttgataatgataataaatgactatattactggtttatatatttactatactatactttgaattgtttaattttagagtggactccttctatttattaaaaaaaaatcagttaactgtaaaacagtctcaggtaggtccttcaggaggtattccagaagaaggcattgtgatcataggagatgacagctccctgtgtgttattgcccctgaagaccctacagtaggacaagatatggaggtgggagacaatgatattgatgatcctgaccctatgtaggccttggctgtgtgtgtcttagtttttatttaaaaagtaagaaaaaaaaaagcttatgaagatataaagaaaatgtgtgtttttaaactgttattacaaaagagtaaaaaagttaaaaaaattataaagcttataaagtaaaaacattacagtaagctaaggttaagttatcatagaacagactgggtgaggtggctcatgcctgtaattctagcactttgagaggacacagcaggaggatcacttgagaccaggagtttgagaccagcctgggtgacaaagcaagaccccttctctacaaaaacaacaacaacaacaacaacaaaaaactccttgggaggctgaggtaggaggattgcttgagcccaggaggatgagattgtggtgagctgtgatcgtgccattgcactatatcatgggcaacagagcaagactctgtcccagagaaaaaaaagttattattgtagaaaggaaggttttaaaaaatgtgtagcctatgtttatggtgtttataaagtctacaatagtgtactacagcagtgtcctaggctttcactttcatttaccactcactcactgactcactcagagcaactcccaatcctgagagcactattcatgataagtgccctatacaggtgtaccattttttatcttttttttttctttattgagacagagtttcactcttgtcgcctaggctggagtgcaatggcgcgatcttggctcactgcaacctcagcctcccgggctcaagtgatcctgcctcagcctcctgagtagctgggattacaggtgcccaccaccacgcctggctaattttgtatttttagtagagacgggggtttcaccatgttggccagggtggtcttaaactcctgacctcaggtgatcctcctgccttggccttctaaagtgctgggattacaagtgtgagccaccgcgcccagccccattttttataccatatttttactgtaccttttttaggtttagacacaaataccactgggtttaaaattgcctaaatattctgcatagtaatatgctgggcagatttgtagcctcggagcaataggctgccatatagcctaggtgtgtagtaagctttaccatcaagatttgtgtgactacgctgtatgatgttcaggcaacagtgaaatcacttaaagatgaatttcttagaatgtatccctgacattaagtgatgcatgactatatgtaaaagtgcttaggatagtgcctgccatgtacttcctcttgttacacatacatgcacggtggaagataaagcagaaggattctaaagtatggaatgtgttttttactctccctcagtgcaaaatatacaacagtatattgtgacttttgtaatctcccataagatcagtagtcataagtttattaatgatttctgtccctttaggaaataaaaaaatggggagattcagagggtattttcctgagaaacccttgtacatttggcattattgtttgtcttcccttctatactgtacattctttgaagatagagccgtgttttgacttattattttatacctagctcaagcagattatctgacatatagaagatacttgtcgaatatttgttgactgagtgaataaatgtgtttctattgctaagggagctttggataattttacctctagttaatgctaattctaactctgtaacattgttggagaaaagtctagaaagcaaagaaagtagaaaaattattttggctctaaagtgatggggaatagcactggtacaaatgtccagaaagcttagcactgggacaaatgtccaaaaaggtaaaaagtaatatttttacctttaaatttttaatttctgattttgaatatagtacacaagataattgttattctcatgaaaattatgcatatttcaaaaattagtgtacatgtttcttcaaagagttttttccttgagttgcctcattttcaaattttgattccttctttaattttattacatttaaggttttagaacatttttctgtaaaatctacagcttatggtgagttgaatagaaatatataagattcacaagagaaactgactgcatctgtttaagcaaagctaaagatcaatactggttcaatgtctgtaataggtaaacagcaaattacggtaacctttaattttggcattaattttagtgattgaatatctaatttttaagacataattaagaattagcatgtgcaaattattttatttttattttttaaattaagggacagggtcttgctctgtcacccagattagagtgtagtggtgtgatctcagctcactgcaacctccatgttcccagttcaagtgcttctcctgcctcagcctcctgagtagctgggattacaggtgcccgccaccatgcccagctactttttgtgtttttagtagagatagagtttcagcatgttggccaggctggtctcaaactcttgacctcaagtatcctcccaccttggcccctcccaaagtgctgggattataggggtgagccactgcacctggccactatttctcaccatatacaaaaatcaagtcaaaatggattaatgatttaaatgtaagacctgaaactgctagaagaaaacataggggaaatgcttaagaacattggtctgggtaaagattttatggagaagacctcagaagcacaggtaacaaacaaaaatagataaataggattgtatcaaactagaaagcttctgcacagcaaaggaaacaatcaagattgaagagacaacctacagaatgagagaaaacatttgcaaacttttcatctgaaaagggattaatatatataaggaactcaaataactcaatagcaaaaatccaaatacttcaattttaaaatgggtgaatgagctgaatagacatctctcaaaagaagacaatacagatggcaaacaggtatatgaaaaaatgcttgataccaccaatcatcagggaaatgcaaatcaaaaccgcaatgagataccacgtcaacctaattagaatggctattatcaaaaagacaaaaaaaaatgctggcaaggatgcagagaaaggggaattcttatacactggtggtatgaatgtaaattagtacagccattatgaaaaacagtctcgtggttcctcaaaaaactagaaatagaactaccatatgatccagcagtctcagtatatatccaaaggaaggaaaatctgtatgtcgaagggatatctgcattcctatgtttattgcagcactgttcacaatagtcatgacatggaattcagtgtacgtgtccatcaacaggtgaatggattaagaaaatatggtatatatacacagtggaatactatttagctgtaagaaagaatgaagttgtgtcattcatggcaacaagaatggaaatggagaacgttatgcaaagtgaaataagccaggcacagaacgataaatactttctgttctcacacatacatggaagctaaaaagttgatctcatagaagtagagagtagaatagtagttattagaggtggggaagtataagagggaggcaatgacagatagccaacggttggttaacaaatacaaaagtacagctagataggaataaggtttaktgttctgtagcactgtaaggtggctataattaacaatttattatattttttcagatacctagcagggtggattttgaatgaacccaacacaaagaaatgataaatgttcaaggtgatagatatagtttgatcattacacattgtatgcatgtattgaaatatcacattctacgccataaatatgcacaattataacgtgtcaattaaaaatagtagaagcaaaaaaaagatggaagttatttgtttttgaggagtgaaattcagaggagaggagagatggcttaggggactgttgtttttcacgtattgatctgttggcactgttcgaatattttaaaaagtgataaagtatattgatgcattagtggagaggattaaaaactaaaacaaaatatgtattaatggcaagttcctttaaggagctttaggattaaagtgtccccagtaaaagggaatcagatatagagaaaaagaaatgtaagtttattttttgtatttaaaagggcttttctggctgggcgcagaggctaacacctataattccagacttttgggaggccgaggtgggtagatcacctgaggtcaggagtttgagaccagcctggccaacatggtgaaaccccatctctactaaaaatacaaaaaattagccgggcttaatggtgggcacctgcaattccagctactcaggaggctgaggcaggagaatcacttgaacctgggaggcagaggttgcagtgagccgagatcacgccattgcactccagcctgggctacaagagcgaaactgtgtctcaaaaataaataaataaataaaagggcttttctttatttctgattttatttttgttttgttttatcctagggtttgaaaaacaaaccgaaaaagatgggccacataaagccagacttgattgacgttgacttaatcagaggttagtcttaaaattgttttttatgtacattattatattatttcacagggatgcttaattttcaatatcttctctatatgatggtatactttaatttctaaatgtaacactttactctcatcattcaggctttagcactttttccacctcttagtactgtgtgactctataaattacatgcatacatgtaaaagagggatgaacgtagagacttgctgttgtgtaattaagataaatatgttgtttaacattcaagtaagcctgacttattttgagcttctgtcctagtgattgaggcaagaagttattacatttaacaaacatctaagagggtttttttttttaactgaacaggttttgtgctgatttttgcactcacctatttttaatgtagtgctacaggtggccttcaatacagtgtatataaatgtttgatgttttgttttattgtatgtttaaagggtcaacatttgccaaagcaaaacctgaaattccatggacatctctgactcggaaggggcttgttcgagttgtattttttccattgttcagcaattggtggattcaggtyacctctttaagaatctttgtttggctgttactactttatttcatgcaaggtaattggagaaatkggaataagcaatgacagtttctttttgctgcttttgctattaaataatgaagacctactgattttacatttaccctttcatttgacagtttaaagtacacagaatgaagagacatatgccatttggggttcatattaaaattatctgctatgagagagcaaacatacttgtgtaactctttctcctcacttgagtttctttctacctgtctcactggccaggccttctcagtcttttcttgtgtctgacctttgagcctttgaaattgggtatgtgtgttttttgtttttgtttttgagacggggtctctctctgtcacccaggctggagtgcagtggcatgatcacagctcactgcagccttgacctcccagacgcaagcaatccttccacctcagccacccaagtagctggcactacaggtgtatgccactgtgcctggctaatttttgtatttttttgtagagacaagatgttgtcatgctgcccaggctggtcttgaattcttaggcccaaaagtgttgggattacagatgtgagccaccacgtttagcctgaatattggattacctaaagtttgcaccctaggttctattctctaagtagtctcattaaggcctattgctttaaatacaattgatatacaggtgattcccaaatctatatcttcaggccagatctctccgctgcacttcagacttataaatctaattgcctgctttgacatttccatatggagatttaattggtatcttgaagttaattatataaaaaatggaactcttcacttgtgtgtgtgtgcgctgcacacatgtgcctgtgtgtgtaaacttgttcttctttttgtctccagttcattaaatgatactatcaatcacccagtattcaggtgaaaaattaaatcttcctactctaccctaccatcaactctcacatgtaatatgtcaccaagtctgtgagttcttcctccaaatttttcactatatttatctcagtctctactgccatgatcattgtccacagcaccagcatttctttgcttagaccactggaataacatctactctgagccttctttctaccaatcattctttccacagcaattagcaaaatcttttaaaaacagaagccatataatgtcattttcctgcttaaaaccctgtagtgacttctgttgaccttagaataaaaatccaaagttcttaccatggcctataatgccctacaggacctggtgcctgctcttctctcagacatcatctcctatttcttaccactctgctcgtgctggctgtagacataatatcctttttttgttcttcacacggagctgttttgttttgtttgaagcattcggagtttggctcttttttcccaggctggagtgcagtggtgcaatctcagctcactgcaacctctgcctcctaggcttaagtgattctcgtgcctcaacctcccgagtagctgggatacaggtgtgcgccaccacgtccagctaattttttgtatttttagtagacatggggtttcaccatgttgtctaggctggtctcgaactcctgacctccggtgatccacccgcctcagcctcccaaagtgctgggattacaggtgtgagccactgtgcccggctgtttaaagcattcttaaggcttttcaaatggctggcttttttctcacctttaaatctcagctgggttgtaactttcataaagaggccattcctatctacgtatctttttttttttttttttgagatggagtctcgctctgttgcccaggcgggagtgcagtggcgcgatcttggctcactgcaagctctgcctcctgggttcacgccattcccttgcctcagcctcccgagtagctgggactacaggcacccgccaccacgcccagctaattttttgtatttttagtagagacggggtttcaccgtgttagccaggatggtctcgatctcctgaccttgctatccgcccgcctcggtctcccaaagtgctgggattacaggtgtgagccactgcgcctggcctcctatttatatttctaagtagtcctaataccctctagtcactatcataagaatcaattttaatttctgggttacacatcgctacctgatgttttctaactgtgtgcagggacccaatatattctctttacgactgtatccccattgtctaccaaggaagtagacagtatatactatggttacatctctgcaaaaagatatgaattagaacaaagagtgggagaaagttgggttaaggtgaaagaattatgggttcttctatttgtgtcagttaaaaatttttttaagatatagagtgaaaaatatatgtataaatttacaaatctataggtttaatttttttaaagttgtgaaagtgtcatttattagaatatctgtaatggaaatgttccgcgtctgtgctgcccagtatagtagctacttagccatatgtggctattgagtattcaaaatgtagttagtgtcagtaagagactgaattttaaattttatttgatttaaattaagtcttcataatgatcattttaatggctgcataataattcatcatatgggcataccatcatttaaaactatcattttaatgtctgtacagtctatcatatgtagagtcatatgtagagtctatcatatggatttatcataaacatctttgtatagctgccttttttttttttttttttttttttttttttgagacagagtctcattctgttgtccaggctagagtatagtggtgtggtcttggctcactgcaacctctgcctcccaggttcaagtgattctcttgcctcagcctccgaagtaactgggactacagagacacactaccatgcctggctaatttttgtatttttagtagagacagggtttcactgtgttgtctaggctggtcttgaactcctgaccccaggtgatcctcctgcttcagcctcccagagttctgggattacaggtgtgagccaccacacctggcctatatagcttttaatagtccattatgtaagagtactgtaatttacgtaacctttctgtatgaatctgttcaggctgctataagaaaaataccatagactgggtgttttatcaacaacacaaatttatttttgacagttttggaggctgtgaagtccaggatcaaggtgccagaagatgtggtatctggtgagggcctgctttctgattcataggtgtcagtcttcttgctgtgtcctcacatggtggaaggggcaagggagctcttaggagtcattttataaggccacatctataagggcactcatccccaaactataaccaactggttatatgtgactggggacctctctaacatgctttctcactttttacaatgtggataggctaagaacttttcaaatctttaagttatgcttcctttttgcttaacaattctgtcttttaagtcatttctctcttctcacattttactataagcacataggaagagccaagctgcacctttaatactttgcttagaaatagctccagctaaatatgcaatttcatcacttgcgagtttcactttccacagaatcctagaccacaaatacagttcaacaagttctttaccactctgtaacaaggattgtttttccttcagtttctaataacatattatttctcatttctatctgagacctcatcagaatggactttacctcatattttaccaatagtctgttcatggttacttaggtattctttaagaagattgaggctttttctctagctcccctcttttctttctttgtttttgtttgtttgttttattttgtttttcaagacagagtcttgctctgttgcccaggctgaagtacagtggcgtgatcttggctcactgcaacctccgcctcccaggttcaagtgattctcctgccttagcctcctgagtagcggggattacaggcacctgccaccatgcctgactaatttttgtrtttttagtagagatagggtttcatcatgttgaccaggctggtctcaaactcctgacctcaggtgatccacccgccttggcctcccaaagtgctgggattacaggtgtgaaccactacacccggcctcctcttttctttctgattcctcaccagaatctcttttaaaaatgtttaaggcaatctaggctttttctactatgtacttcaagtattcgtctagtctccacccattacctatttataaagctgcttccacatttttaggtatttgttatagtaggaccccccattctcagtaccaatttctgtcttatgccacttgggctgatacaacaaaaatatcatggcctaggtgctttataaataacaaaaagttatttctcacagttctgaaaagttcagatcagagcactagcagattcagtgtctggtgagggtctgcttctctctgggtcctcatgttgctgaagggccacaggagctctctggaatctcgttaataaggttactaatctcattcatgagagctctgccctcatgacctaatcagctaccaaaggccccatctcctaatacgatcacattaaggattaagatttcaatatgagttttgttggggacatatgttatagcatcttcccatattgtgggcatttaggtggtttctatgtgttttttattaataatgccagcaggaacaaagttttccttattttatattatttatttaggatttgttctttgaaatagaattaacagatcaaagaatgtggacatttaaggcttttagtacatataatgaaattgctgatggcacagttgttttggaaagcaatagatgagagtacctgttttaccatggtcttaccagcattattataattttaaaaattgttatctaggtggggggcagtggctcaagcctgtaattccaaaactttgagaagctgaggtgggaagacttgaggccaggagtttgagaccagcctgggaaacatagcgagatcccatctctccaaaaaaaaaaaaaaaaaaaaaaaaattagccaggcgtggtgcaagcctgtagtttcaactacctatgaggctgaggtgggaggatcacttgagcccaggagttcgaagttacagtgagcaatgattcatcactgcactctagcctggctgacagagtaagaccctgactgcatctctgcccgccccctcaacaaaagattgttacctaatttgacgtgcaaaaaatatttagcttgttgaatatgaatttccttggtcacttgtaagggtaaaattaagtattttttccacacatttattattaaattatttattccttccttgttgatagatactgcatcctatatagataaaatttccatatatgccatggtctgtttctggactgcatattctgtaccatcagttttggttattctcatatctatgccatatattaaatttttgtatttgccatggtatgtttctggactacatactctgtaccattaatttctggttattctcatatctatgccacactgctttcattactacacagctgtttaatatggattaacattgagcaggaaaattgttttttttcttttgagatggagtctcactctgttgcccagactggagtgcaatggtgtgatctcggctcactgcaacctctgcctcctgggttcaagcaattctcctacctcagcctcccaagtagctgggattacaggcgtatgccactacgcccaacaaatcttagtatttttagtagagatggggtttccccatgttgaccatgctggtcttgaactcctgacctcgtgatccacctgcctcggcctcccaaagtgctgggattacaggcctgagccaccgcgcctggccaagtatttcttcattattctgytttcccacattttctctcatgctttcttgtttatcctttccaaaataggttagcattattttatcgtgattaaaaccaaaagaccccccaaaaccaacaatacaggaatttggattggaattctctgattatcccctttccccagcacacatacacaaatgtagatgtatacatatatttttggaggatggacagaaaatttgacttctttacaacattctctttgctatacagaaatatgatattgctctccttttactcaggacttcctttttttttttttttttttttaaaattgagacggcgtcttgctctgttgcccaggctggagtgcagtggcttgatctcggctcactgcaacctctgccacccgggttcaagtgattctcatgcctcagcctcctgagtagctgggactacaggtacccgctaccatgcctggcaaatttttttgtatttttagtagagacgggggttttgccacgttggccaggctggtctcgaactcctgacctcaggtgacccttccgcctcggcctcccaaagtgctgggattacaggtgtgagcyacagcgcctggccttaatcaggacttctgtttatccctcagtaaacctttgcaggatttttttctttctttctttctttcttttttttwaaatagagacggggtctcactcttactcccaggctggagtgcagtggcgtgatggtatttcactacagccttgagcccaggcaatcctcctgcctcagcctgttgagtagctgggactataggtgtgtgccaccatgctcagctggtgttttttattttttattttttagagatgggctctcgctatattgcccaggctggtctttgaactcctggcgtcaagtgatcaaatgatcttcctgcctcaacctcccaaagtgtttgagttacacgtgtgagccaccacacccagccctggatttttttcttataaggcctgcttagatcttgttaaattcaattttttttattgtggtaacatatacacaacatgaaattcaccatcttaaccatttctcagtgtagagttcagtggcattaagtatactgatactggaatacaaccattacccactgtttatttccaaaattttttcatcttcccaaactgaaactccatacccattaaactccctatttcccctacccatcgtccctggcaaccaccattctaccttgcctctatgattttgactactctgggaacatcatataagcagaattatataatatttgtccttttgcaattggcttatttcacttagcataacatcgtcaaggttacccatgtagaatgtttcagaattcttcctttttaaagctgaattgtattccattgtatgtagataccatgtttagtttgtacattcatcttctgagagatacttagagatttccacctgaaattaaaatattttgtctttgttgctgctgctgaaaatacatgactttttaagtctatttttacaagttttaagtggtttttgctgtcacatttgaaagctattggtttataattaaaattgttataaccagccgctttattaaactctttgtcatcaattctaattgtttttcagtgcttgtattagattttataatgatacaaccatatggttggcaaataatgacaatttggttttctcctttcacatacatttcatttactttcacccaatcagtcaacatttcagagtaacgttaaatgataacagtgagtggtcatccttgttttgttcctgattcagaatatcttcactaacatataatatgtattgattttacttatatattctttagcatgttaaggaaatatttttattcttaatagtttagaaaatatgggcatttgagatgaattacaaatcaagaacaaatgtatgtatgtgtttttttttaatacaatgctttttttttttactgttacctggagttgggccagacttcacaggtttagggcacaatcctctacaagactgctctcccttcagatatcagcctccagtttgggggtccccaggatcactctcacttctgaccaggtagctatagttttgggtcccccaggcattccctcaggtttgatgattggatggaatgactctcagaacttcagaaagtgctaaacttacaattatagttgcattatagcaacagaatataaatgagaggagaggtataggagtgtttgggatggttccaaacaggatgcttccgttgtcctcaggtagcaatatgcaaaatattgccacccagggaagctccccgaagctttggtatgtagagtttttattgagactttattatttaggcctgattgatggaatcattgacatgtggttgaatgcagtctccatcacccttcagtcctcagaggtctcctaatatggctcaaagacccaagcctttaatcacgtagttggtctttttggtgtgaccagcagccatccttaggtaccttgttagcataaactatcaggcctggcacaaggggcccacaatgaatagcaaaggtacttctgtcacttaggaaattcaagggtttagaggtcacttcccaggaactgggatcaaatgccaatcaaattctttttttttttaactttttaatttttgtgggtatatagtaggtatatatatttataaggtagatgagatactttgatacaggcatgcaatgcataatacatcatggcaagtagggtattcatcttctcaagcatttatcctttgtgttacaaacaatccagttatactcttttagttcattttaaatgtacaattaaattattgactataggtcagcctgttgtgctatcaaatactaggtatttttcgttctgtcccatgaaccatccccacatcccctactccacccccactacccttctcagcctcagagccttctactctctgtctccttgagttcagtcattttaatttttagctcccacaaataagtgagaacatgtgaagtttgtctttctgtgcttggtttatatcacttaacataatgtcctctagttccatccatgttgttgcaaatgacagaatcttattcttttttatggctggatagtactccattgtgtatatgtaccacattttctttatccgttcatctgctgatggacacttaggttgcttccaaatcttggctgttgtgaacagtgctacaacaaatgtgggagtgactctttgatatactgatttcctttctttcttttgttctttttgtttgttttgagacagagtctcattctgtcacccagggactggagtgcagtggcataatctcagctcactgcaaccctttgcctcctgggtacaagtgattctcctgcctcagcctcccragtagctgggattacaggtgcctgccaccatgcctggcaaatttttatatttttagtagagacagggtttcaccatgttgcccaggctggtcttgaacttctcacctcaagtgatctgctcactttggcctctcaaagtgctgggattacaggcatgagccacagtgcccaaccaccattttcctttcttttgggcatatacccagcagtgagattgctggatcatatggtagttctatttttctttatttgaggaacctccaagctgttcttcatagtggttgtactactttayatttccaccaacagtgtacgggggttcccttttctccatatcctctccagcatttattattgcctatcttttggataaaagccattttaacgggagtgagatgatatctcattgtggttttgatttgcatttctgtgatcaatgatatgagcaccttttcatatgcctgtttgccatttgtatgtcttcttttaagaaatgtctattcagatcttttgccngttttaaaatcagattattaggttatttcctatagagttgtttgagctccttatatattctggttgttaatcccttgtcagatggataatttgcaaagactttctctcattctgtgagttgtctcttctcttggttgattgtttcctttgctgtgtagaagcttccctyggcccggccctccgccccgccatccctgagacggagtcttgctctgtcacccaggctggagtgcagtgttgtgatcttggtttatcttgatgtgaccccatttgtccatttccgcttcaccaaccaatttttttttcttttttgagaccaggtctcactctgttgcccagtctggagtgcagtggtgtgatcttggctcactacagcctcgacttctgggctcaagtgatcctcccacctcagcctcctgagtaggcttggagtgggaccacaggcgcgtgccaccatgtttggctaatttttttggagtattgtggagatggggttttgccgtgttgcccaggctggtcttgaatttctgggcttaagtgatctacccaccagacctcaaaaagtgctgggattacaggtgtgagccaccatgcccagccgccaaccaaattctttattacataactgtcaattgagatgatttgtatagatgtgatcaaaattacattgtatgaaattattacattaattcacttgagtcaacaaatacttaagcttattgtgtctgtgccaaatattcttctaaaygctgagataaattttctacttttaaatgtcaaattcactttggtagtatttcaatcatttatccaacaaatattgagtgtctattctgtgctccaggtactggtttccagcaaatattgagtgtctattctgtgctccaggtactagttttagatatagcggtgaacaaatcagacaaaacyccttgtcttcatggtgcttactttttagtggcaaatttatatttacattctcaagtcaacaagatctatagtttattgtctgggtactttcattattgtgtttgagtattgggattttattagggcatggaataggtaactttctttttctccgcacaggaatagtttgtatagcacaagaattactatttatgtgaaaatctgaaatatgttaaaatatggagatactttttgatatttttccatttcatttacttctttaaacattttatatatatgctttgatttgcatttcatatatatatatatatacacatatatgtatttcttcttcattatatatgaaatggaaaggcaacatagcatagtagttaagagtgaggactctggagcctgactacctgggttcaatccccatctttgctgtttgctttctgtgtagccttggaaaatactcttcctttgagcaacacagcacttcaaaatgtgttttatatacagcatctagttgtttttgtggtggaaacccttttgaaatatctaaattatcatgctgctagaaaggtaaatccttttaacacagtattcttcacttgccgagggatctagggcttcagtttttcacttggctaatgtgcatctggatgggcattgtaggaaactatttatttgtgtacttttttaaatgatggatttttatagaaacaatttgtatagtttttagaattaattttaaagaagagctctaatgttttacatcttaaaacctcttcttttcagttatagcaattgtcttatatttgatgatgcctattgtgaacrtaagtgaagtacttggacccttgtgccttatgctactcatgggaactgtccactgtcaaattgtgtctactcagataacaagaccatcaggaaacaatggaaatcgaagaagaaggtaagatgagaaattacactgtagttgtatattttctgggagagttattgtagagatttataaaacctttgattaatttaaaatctccctcttttgtgtttttcattattttttggcttagaaaatgaatgcattactttgcacttttctccttgatgctgagaaaaccttgttacaaacttttagttccagtttgggatttttgtcattcagtacagttgtttaaaaggaaaatttctatactatatkattctttataaaatttatcatatattggcttcaaagaaaacattctctttgaaattcagtcttaatcaaaatttggtgaaaattcactgtaaacaaggatcttggtacatttggttagcgctaccaaaattttaccttttttcaaagatgtgtaataagaattgatttctaagtggtctaaactttttttttttctttttgagacagagtttcgctcttgttgcccaggctggagtgcaatggcgcaatctcggctcactgcaaccgatacctcctgagttcaagcgattctcctgcctcagcctctcaagtagctgggattacctgcgtatgccaccacacccagctaatttttttttttgaatttagtagagatgggatttcaccatgttaatcaggctgatctagaactcctgacctcaggtgatccacccgcctcggtctcccaaaggactgggattacaggcgtgagccactgcacccagccgtctaaacttttaataaggatttatttggcttttctttacatattgaattcatgttatattttaatcgattatatggtatatgtgagttttggaactgttgaaatgttcttaggtatatgcagtgttattttccaaaagttatgttatcttccctcagaatatctgtagatttttgcctgcgtaagcaattactaaataagaattttccattaggtgcaatgaatttcaacatattcttatttttgaatgttattttaaaaactttttaaaaaagatttcttgtaaattcagttaaattaatggaatgttttctaaggaaataaaatgctatgctatgtcttattgatatctrtagtatatatcttttgtctaggatatcaataaaaagtgatcagttgctactattctatgttacccttataaaatgtgccataagaggtagattcctaacatccatatttaaagaaattgctccttctgctagtggtgttgaatgtgcctgaacagactcttggtcatacaagtagaaatttttttttttagtagattctgaatagcggttctatttctttaatgactgaacaaaatggtagcataggactttggtttggaatctggttttgccctcaaatcagaaagttcttgcatagtttatcckcagaatatgaagttaarctatacttgatttaaggtagtaatttgtcagtataattttctgtagggatatttttggcagaaatagaaagggtcttgaataatctgaagttattgaaatttttttttgtagaaaattacgaaaaactgtaaatggtgatgggagccgagaaaatggaaataactcctctgataaagtcagaggaatagaaactttggaatctgtacccattattggtggtttttgggagactatctttggcaacaggtgggagtcttttttacttgattttgtattcacrtagtgtttacagaatgtatagtatcatcaggccataggagtaagtagtatagacttatcttggtgtgatttttaagggttatcagagggcttgcttactcaaaatgttgtcttcactgtctgttttgttacctgtgaatgcagtaatctatcatggaagtattctgttttttttttttttttttgaaatggagtctcattctctcacccaggctggagtgcaatggcacgatcttggctcactgcaacctctgcctcttgagttcaagcgattctcctgcctcagccttctgagaatagctgggatgacaggtgcccgccgccacacccagctaatttttgtattttattagagacagggtgtaaccatgttgcccaggctgatatcgaattcctgacctcaggcctcaggcatgagccatcacacctggcctgatttcctttcttttggttatatacctagcagtggggttgctggatcatatggtagttctatttttctttatttgaagaacctccaagctgttcttcatagtggttgtactactttacatttccaccaacagtgtacgggggttcccttttctccatatcctctccagcatttgttatcgtctgtcttttgcctaaaagccattttaactggagtgagatgatatctcactgtggttttgatttgcatttctgtgatcaatgatatgagtaccttttcacatacctgtttaccatttatatgtcttcttttgagaaatgtctattcagatcttttgcccattttaaaatcagattattagattttttctatagagttgtttgaactccttatatattctggttattaatcccttgtcagatggataatttaagactttctctcattctgtgagttgtattttcacttggttgattgtttcctttgctatatagatgctttttaacttgatgtgatctcatttgtccattttgctttggttgcctgtgcttgtggagtattacttaagaaatctttgcccagaccaacatctggagagtttccctaatgttttcttttagtcatttcatagtttggggtcctaggtttagttctttaattaacttttatttgatttttgcatatggtgagagataagggtctagtttcattcttctgcatgtgaatattcagtttttccagcatcatttattgaagagactgtcctttctctaatgtatgttcttggcatctttgtcaaaactgagttcactgttggccgggcacagtggctcatgcctgtaatcccagcactttgggaggctgaggcggggggatcatttgaggtcaggagttcaagaccagcctggccaacatggccaaaccttgtctctactaaaaatacaagaattawccgggcgtggtggtgggcacctgtaatcccagctactcgggaggtggaagcaggagaattgcttgaacctgggaggcagaggttgcagcgagtcaggatctcaccactttactccagcctaggtgacagagtgtgaccctgtctcaaaaaaaaaaaaaaaaaatgagttcactgtagatgtatggatctatttccggattctcaattctgttccattggccgatgtgtttttatgccactaccatgctcctttggttactatagtgctgtagtacaatttgaagtcaggtaatgtgattccttcagttttgttgtttttacttacgatagctttggttattttgggtcttttgtgattccatataatttttatttttatttatttatttatttatttatttatttatttatttatttattwgagatggagtcttcctctgtcatccaggctggagtgcaatggcgcgatcttggctcactgcaacctctgcctcccaggttcaagcaattctgcctcagcctcccgagtagctgggattacaggcgcctgccaccacgcctggctaatttttttttttttttgtatttttagtagagatggggtttcaccatgttggccaggctggtctcaaactcctgacctcaggtgatctgcccaccttggccttccaaagtgctgggattacaggtgtgagccaccatgcctggccaattccatataaattttaggattgttttttctatttttgtgaagaatgtcattgttatttttatagggattgcattgaatctgtagattgctttggttaatatggatatttttaacaatagtcattcttccagttcataaactatggaatatctttccatattttttgcattctcttcaatttcttttttttgagacagagtctcgctctatcgccaaagctagagtgcagtggcatgatctcggctcactgcaagctccacctcctgggttcatgccattctcctgcctcagcctccagaggagctgggactacaggcacccgccaccgtgcccggctaattttttgtatttttagtagagatggggtttcaccatggtctcgatctcctgacctcgtgatccgcccgtcttggtttcccaaagtggtgggattacaggcgtgacccactgcgcccggctgcgttctcttcaatttcttacatctatgttttatagttttcattatagagatctttcacttctttggttaattgctaggtgtttaattttatttgaaactattagaaatcgtgtaactttcttgatttcttttttagattgtttgctgttggcatatagaaatgctattgatttttggctgggcgcagtggctcacgcctgtaatcccagcactttgggaggccaaggcgggcggatcacgaggtcaggaggttgagaccatcctggttaacatggtgaaaccctgtctctactaaaaatacaaaaaaaaaaattagccgggcgtggtggcgggcacctgtagtcccagctacttgggaggctgagacagcagaatggcatgaatccgggaggtggagcttgcagtgagccaagatcacaccactgcactccagcctgggcgacagagcaagactctgtctcaaaaaaaagaaatgctattgatttttatgtcaattttgtatcctgcaactttaatgaatttgtttatcagttctgatagttttttggtggaatctgtaggtttttccaaatataagatcttattatctgtaaacaaaggtaatttgaattcttcttttccaatttgtaggcctttcatttctgtctcttgtctgattgctctagctaggacttctagtactatgttgaataacagtgatgaaagtgggcatctttgtcattttccagatcttagaggaaaggctttcagtttttcctcattcagtatgataccagctgtgggtctgttatgtgacttgacttttattgttttgaggtatgttccttctataccctgatttttgagaattcttatcatgcagggatattgaatgttatcaaatgctttttcatcatcatttgaaatgattatatggtttttttccttcattcttttggtatgatgtgtcacgttaattsatttgtatgtatgttgaaccatccttgcatccctggtataaccctacttggtcgtgatgaatgatctttttatttatttattttatcttattgttactaatatttgagacagagcctcagtctgttgcccaggcttgagtgcagtggcatgatcttggctcactgcaaactctgcttcccagttcaagtgattcttgtgtgtgagtcccccatgtagctgggaccacaggcatgtgccaccacatccctccctccctaattttttgtatttttttgtagaggtgcacagaagtcaagtattgagatttgagaacctctgcctagatttcacaggttgtatggaaatgcttggatgtccaggcagatgtttgctgccggggcagggcactcatggtgaacctttgctagggcagtgtggaagggaaatgtggggtggrcacccgcacatagagttctcactggggcacttcctagtggagctgtgagaagagggccactgtcctcaagaccccagaatggtagatccaccaatagcttgcattgtgcacctggaaaagccgtagacactcaacaccagcccatgaaagcagccaggagggaggctgtaccctcccggtgatacttgatatcattttaattttctggaatgttttaagacttgttttttggctataatatggtatatccctgaaaatgattcatgcactgaggagaaaaatgtgtattctatagccagtaggtaaaatgtttagtaaatgtctgtcaggtctgtttggtctgtagtgtagattaagtccaattttttttgttggtttttctatttggatgatctgtctaatgctgaaaatgaggttgaagtctccagctattattgtattggagtctgtctctctctttaactctaataatatttgctttatgtatctgggtgcttcagtgttgggtgcatatatatttacaattgtttgtcctcttgctgcattgacccctttatcattatataatgacctttaactctttttatagttaaagtctattttgaccaatataagtatagctacttgatatggtttggctgtgtccccacccaaatatcaacttgaattgtatctcccagaattcccacgtattgcaggagggagccagggggaggtaattgaatcatggggctggtctttcctgtgctagtctcgtgatagtgaataagtctcacaagatctgatgggtttatcaggagtttctgcttttgcttcttctttctcttgccgccrccatstaagaagtgcctttcacctcctgctgtgattctgaagcctccccagccttgtggaactgtaagtccaattaaacctcttcttcttctcagtctcaggtatgtctttatcaacagcatgaaaatgaactaatacagtaaattggtaccagtagagtggggtgttgctgaaaagatacctgaaaatatggaaacaactttggaactgggtaacaggcagaggttggaacagtttggagcgctcagaagaagacaggaaaatgtgggaagtttggaacctcctagagatttgttgaatggctttgacagcaatgctgatagtgatatgaacaataaggtctaggctgaggtggtaacagatggagatgaggaacttgttgggaactgaagcaaaggtgactcttgttatgttttagcaaagagactggtggcattttgcccctcccttagagatttgtggaactttgaacttaagagagatgatttagggtatctggcggaaaaaatttctaagtagcaaagcattaaagaggtgatttgggtgtggttaaaggcaatcagttttataagggaagcagagcataaaagtttggaaaatttgtgccctgactatgcgatagaaaagaaaaacccaggccaggcgtggtggctcacgcctgtaatcccagcactttgggaggctgaggtgggtggatcacctgaggtcagtagtttaagaccaatctggccaacatggtgaaaccccatctctactaaaaaaatacaaaaattaaccaggcatgatggtgggtacttgtaatcccagctacctgggaggctgaggcaggggaattgcttgaacccaagaggtggcatttgcagtgagctgagatcacgccactgcactccagcctgggtgacagaacgagactctgtctcaaaagaaaaaaaaaaagaagaaaagaaaaacccattttctggggagaaattcaaactggctgcakaaatttgcataagtagcaaggagcctaacattaatacccaagcaatggggaaaatgtttccaggacatgtcagacactttcatggcagcccctcccytcacaggcctggaggcctaggaggaaaaagtggtttcgtgggccggacccagggtccccatgctgtgtgcagccttgggacttggtgtcccatgtcccagttgctccagccatggctgaaaggggccaatgtacagctcaggctgtggcttcagagggtggacgctccaaaccttggcagcttctacgtggtatcgagcctgcaggtgcacagaagtcaagaattgaggtttgggaacctctgcctagatttcagaagatggatgcccaggcaatagttttgctgcaggggcagggcactcatggagaacctctgtgagggtagtgtggaagggaaaaggtggggtcggagcccccacacagcgtccctactggggcaccacctagtggagctgtgagaaggccaccatcctccagaccccagaatggtagatccaccaacagcttgcactgtgctcctggcaaagcctcagacactcaacaccagcctgtgaaagcagccaggagggaggctttaccctgcaaagccataaggacagagctgcccaagaccatgtgaacccaccttttgcatcagcgtgacctggatgtgtgagacctggagtcaaaggagatcattttggagctttaaaatttgactcccccactggatttcagacttgcaagggccctgtaacccctttgttttggccaatttctcccattttgaacgtgtgtatttacccaatacttgtatcctcattgtatctagaaagtaactagcttgcttttgattttacaggctcataggtggaagggacttgccttgtttcagatgagattttggatgctggacttttgggttaatgttgaaataagactttgggggagtattgggaaggcatgattggttttgaaatgtgaggacatgaggtttgtagaggcaaggagcagaatgatatggtttggctgtgtccccacccaaatctcaacttgaattgtatctcccagaattccagtgggttgtgggaggggcccagggggaggtaattgaatcatgggggctggtctttcccatgctattctcgtgatagtgaataagtctcacgagatctgatgggtttatcaggggtttccgcttttgcttcttcctcattttctcttgcccgccaccatgtaagaagtgccttttacctcccgccatgattctcaggggcctccccagccatgtggaactgtaagtccagttaaatctctttatcttcccaatctcgggtatgttttcatcagcagcatgaaaatgaactaatacactactcctgctaatttttagtttctattgggatggaatatctttttccatccccttattttcagcctgtgtgtatcttttataaagtttgtttcttgtaggtaacagatcatggattttgtttttttaatgcattaagccactctatgtcttttgattagaaagtttagttcatttacattccatgccattattgataagtaaggacttactcctgccactttgttagttgttttctggttcatttgtgatctcttctttctttccttcytatcttcctcttagtgaaggtgattttctctaggggtattttaaaatttatttctttttattttttatgcatcttttattatttttttaatttgggggttacattgaggcttgcaaataatattttataacctatttttttaaactggtaacactgattgcataaacaagcaaacaaactcataaaccagcaaagagaaaagtaataaaaactgtacactttcactctgtccccttgctttttaactttttgttgtttgtatttatatcttattatactgtctatgtcttgawatgttgtattcttttaagttggttcatcttttagtcttcctattgaagatatgagtcgtttacacatracaattacagggttataatattctgtcttttttgtgtatttactattactaatgagttttgtaccttcagatgattgcttattgctcattaatgtcatttctttcaatttgaagaactctcttttgcatttcttgtaggcaggtctgttgttgatgaaatccttcagcttttgtttttttctggggatgtctttatttttacttcttgtttgaagtttatttttgttgggtatagtattgtaggacaaaaaggtttttcatttagcagtttaaatatgtcagaccggctggacatagtggctcaggcctataatcccagcactttgggaggtcaagatgggaggattgcttgaggccagaagttcaagaccaacctgggcaacattagggagacccagtctctacaaaaataaaaataaaaaatcagctggatgtggtgacctgtgcctgtggttccagctatgctggaggttgagacaagaagatcrcctgagcccaggacgttgaggcagtagtgagctgtaattgtgacagtgaactccagcctgggcaactgagatccccatctcaaaaaaaaaaaaaaaaaaaaaaagggaaaaataagtaagtaaataaatatgtcataccactctctcctagcctgtaaagtttgcactgagaagtctgctgccagamatattggagtatctttgtatgctatttgtttcctttctcttgctgcttttaggatcctttctttatctttgatctttgagggtttgattgttaaatgccttgaggtaatcttctttgtgttaaatctgtttggtattgtatgaccttcttgtacttgaatattggtatcttactctagatttgggaagtttcctgttattatccctttgaataaactttatactcctgtctctctctctaccgcctctttaaggtcagtaactcttagatttgctgttttgaggctattttccagatcttttaggtgtgtttcattcttttttattctttttcttttgtctcctctgtgtctttttaaatatactgtcttgaagctcactaattctttcttctgcttgatcaattctgctgttaagagactctgatgcatttcttcagtatgtcagttgcatttttcagctccagaatttgtttgattttttttttttagttatttcactctctctgttaaatttatctgataggattctgaattccttctgtgtattcttgaatttgtttgagtttcctcaaaatagcttttttttttttttttttttttttttttttgagacagrgtttcactgtcattgctcaggttgaagtgcaatggtacaatctcggctcactgcaaactccacctcctaggctcaagtgatcctcctgcctcagccttccaagtagctgggactacaggcacatgccattgcacccagctaatttttgtaaagacgaggttttgccatgttgcccaggctggttttgaactccttagctcaactgatccacctgtcccttggcctcccaaactgctgggattacaggcataagccactgtgcctggctaaaaatagctattttgaattttctgtctctaaggttgtatatttctgtctctctggaattggtcactggtatcttattagatattggtgaggtcatgttttcttcgatggtcttgatgcttgtggatgttcattagtgtctgtgcattgaatggttagatgtttattgtagtcttcacagtctgggcttctttgtacctgtccttcttgggaaggctttccaagtatttgaggggaattgggcrttgtgatctaagtctttggtcactgcagctgtatctgcattagggggcaccctaagcccagtaatgttgtggctcctgcagacttgtagaggttactgccttggtggtcttgggtcagatctgggagaattctctggattaccagggagagactcttgttctcttccctaactttctcccaaacaaatggagtctctttctctctgtgctgagctgcttggagccaggaggagtgacacagcacccctgtggccattaatactgggactggcctgggtcaggtctgaagccagcacagcactgggtcttgcccaaggtccacatggtgaccacttgcctgtctaccacctatgtttactcaaagcccaagggcactacaatcagcaggtggcaaatccagccaggcttatgtccttccttttagggcagccagttaccctagctctgggcagatccagagacgctatcagggcctggcgttgagaaccttaggaatcttcctgtcattctattctacagcagctgagctcacacccaaaccaaaagacaaactccttctcattcttctctcccgtttcctcaagcagaggaatctctccccatggccaccgctgccccaggcctgcagcaagtactgcaaggctgttgctgatattcactcaaggtccaagggctctttggtcagcttgtggtcaatgctgataggcctgggtatctcccttcagggcaacgggctcccctctggcccagagtgcgtccagaaataccatccaggagccaaggcctagaatcagggacctcaagagcacacttggtgttctaccccactgtggttgagcttgtaccctgcctgtaagacagagtcccctttactcttccctctcttttcctcaagcagaaagagtctctccctgtagccaccacagctgggaatatactgggtccctcctgaggccagcatggctctgagtctcacccaatgcccacagtgagtactgcctggctaccactgttgattatacagagcccaagggctctttggtcagcaggtgatgactcctgccaggactggatccttcccttcaaatgtgctggttgcattttggtccaaggtgtgtctagaaatgtcatccataagctaggtcctggaatgggggcctcaggactctggtcccttgttctactctggctgagctggtatccaagttgcaagacaaagtcctttttactcttctgtctcttcctgggctgtgaacaacactgcctggctttgcagtaagggtggcaaaaatgcactccctggccacccagctggtgtctcaataggtcatgtgcacctaagtctactgggctagtggagtggcaataacacacgatataaggtaggagttgcattgtgtctgagaagatgtggagaggactgtgaacctacttttgtgcaacactgaaaagtatatgcttcctttcagttaattgacatgagtctttgaagaatagactcacattctgagtctgtgagtgagtattttgtcattctacacccttacttagcaagctaaagtcctgaaaaatatgattcctgcattttcttgatttccagaataatatagcrtattccttaaaagaaagtggtttcatgaaaggtgttactttcaaaaaattaatcttcttttccttttttaaaaaataggattaaaagagtaaaattaatatctaacaaagggactgaaactgacaatgacccaagttgtgtccatcctatcattaagaggagamaatgtcgaccagagattagaatgtggcaaacaagagagaaagcaaaattttcagatggagaaaagtgccgtagggtaagatttagatggatttaacaaggggtttttttccccatgtaacattttcctattaagattctgttagagatataaaataggtactagtaggtttataaatttgtcctaacaagtaaaaccacaggatatgaaaagaagataccacatgaagactggaacttagtcttaaaatttatagtactggacttgttattaattttgcgagttctgtaatcctagcactttgggaggccgagacaggcggatcacgaggtcaggagatcgagatcatcttggctaacacggtgaaaccccgtttctactaaaaatacaaaaaattagccgggcgtgttggcgggcgcctgtagtcccagctacttgggaggctgaggcaggagaatggcatggcatgaacctgggaggcggagcttgcagtgagccgagatcgcgccactgcactccaacctgggagacacagcgagactccgtctcaaaaaaaaaaaaaaaaaattttgtgagttatccagccttagcagtaggctggtagatttaataaacagattagtgaagagggtgctgggtcatattccagagaagcagtgatagtatagtaagagtttgggaaattattttgtaggtttaagtagacatggtctgctctatgtctaaaactagctacacacttttatagtcttaaactgttttcttattggttagattgtggcatttagtctaagaattattgagccgttactataaccaggcattgttctgagtactttacgtatactaacttatctcatttattttcaacaaacctgtgaaatagatgcttttattataatttctttttagatgagggaactcagctccaaacagatttagtaaattgctcaaggttatgtatctagtaagtagaagagctgtgattcaggcttagagtttgacttgagtcttggtttttgaatactacataacactgcctcttcatttaggatatttagtttcaactaaatatttttcttaattgagattaagtaatatatggatttgttcagttttgggttagtttacttttgctgcttggtagtttttgtatgatttttttttgtttttacacatgcagcttattagaatattttgggctgtcccctgtgaaggtattgctgttctctttgtaggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaatttctattttagtttatgaaagtataggactgaatcattgaagttagtaacaaagcatttaacatattttcctattgcttgttggtttgatttttggcaggtaaagaaaaccactacaaggtggtgtcatattgtgcgggattcagatagtctggctgaatcagaatttgaatcagcagccttcagccaggtaaagtatccctttgagaaatcaaggtatatttttgagggtaataactttatccattcctttttttattggttgccctaaagtagcatttacattaatatttgccagcccttccctgtctccaattacccatctccttatctagcagcttttaatgactacacacctagaaagaatattttcctacattgaccctaagcttaaaagtatcacagatgatgcccagcaggaggttacttaatccctaaataatgagattattaaatattcacttggcatatgaagtttatttttaaacatcataaattggattgatgctgatgaagacagatttttgagaaaggagttctgaaagatgggagtagtaaatctcatcatgagagctaaagggcatattatattatttggaaaattgtaactcagaggtgagcagagtagatggtggtggtgtggttttttcttttattttgattaayaaggcaattgtggtcatggaataactttcatatttatgttggtacttttctttgactgattatcctttaacgttttggagctgaatcctgttcacgagtaggtctgtagtcaagttcacaatatttagagttggggtcactttgtgtgtgtcaaaaagctcagctaagccaattgagtgggtcatcttggtgtgcttacaggaatcactcccctcccagaacaccttagttgatcagttccataacatggcantagcttcttagagggagtactgcttgctagagacatcagagtttaacatttaaatattaaaatctattattggctggacatggtggctcatgcctgtaatctcagcactttgagaggttgaggttgttggatagcttgagaccaggagtcggagaccagcctgggcaacaaaatgagaccacatctttacaaaaaaaaaaaaaaatatatatatatatatatatatccgggtgtgatggtatgcacctgtagtgccagctactcaggaggctgaggcaggaggatcatttgagcccgagtttgaggttgcagtgggctatgatcatgccactgcactccagcctgggtgacagagcgcgaccctgtatcaaaaaataaaaaagcattattgttacgtgaagccctgtgaaaaaatgaattcatggtgattgacttctgaaggctttcaagccattgctgtagataagttgttttaattttatttcacatgtaattatttttaaagatgaataacattttttgctttttgttttcctttaaagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcaggtctgtgcagacatgataagaatagctagtatttattgtgttcttactgtgtgtcaggcactctgtcatctcatttaactttacaatcatcctgtagggtagatactattattatccccagtttagaggtgaggaaactgagcatagtctataagtgaagatgttgggattagaactcagggagaagtaatctagagttgccctaacctaaatttttctgtatattactttttcttattattttccttagaatggtcctttatgtgtattttatattttatatgagtagagtttgcatatagagaatataccttatattttcatgaacatcacagtgttacatatgaattactaggaaatggtattgcttgctttttgaacaatgcataaaataaataatgcttttaatttcaggttttatattaatatcataaagtcagatagccattagaaggtatttcaaccttccaaccaatgtagagattcattctacatctgtgtaaattttttaccatctgttatgtggtgataatagttcttacttcttaggaatagtgtgaaatagctaatgagataatataaagtacatagcataatacctggcaagagtaaatacccaataaatgttagcattattatttatatctccatcagatgatcaattggcctcttaaatacttctggagctggaatgcttgttatttaatgatacagcttattccacttctggatagattgaatgatgaagaaatagttcacttatcaacctttyagttgcttaatgtcaatgattgttatgattcttaggtttttgttctttaggctaaatatttccacattgtcttgcaaatagtggatgatggatatatatttgtttaattgtcaaatattcttgattcaaaaataccattgatttaggttatacattttcatttaaaaaatcgcttcattaaatgtatataatttttaaaaaatgaacaagaaacagtgtaaattttctcattaaagttttcttttttgggacagagctcactctgttgcccaggctggagtgcagtggtgcaatcatgactcacggcagccttaacctctccagctcaagtgatcctcccacctcagcctcctgattagccaccatgcttggctaatttttaaattttttgtagagacagggtcgcactatgttgcttaggctggtcttaactcctgggttcaaacagtcctcccaccttagcctcccaaagtgttgggattacaggggtgagtcaccatacctggctctcattaaaattttatgctactttttctgattttgcagtgaggctaaatattttttgcattcagtctgaagattcatctaaattacattagttttcagtagttatgcatagtatcacgatgatgttgatctccgtagcactcccctcctttgagatttgcagtataattttaagacatatataagaataattgagtgtggtaaactcaccatgtcaaatgcaataaatcattttccaatcctgttcacgtagcctattcttttattccctgtatttcttaataccacactacccacccaagtcaaaaagcttgaagtcattcttgaccccatttttttttttagatggagtcttactctgtcacccaggctggagtacactggcacaattttagctcattgcaacctccgccttccaggctcaagtgattctcctgcctcagcctcctgagtagctaggattacaggtgcctgccgcctgccaccacacctggctaatttttgtatttttagtagagatggggtttcgctgtgttggccaggctggtctcgaactcctgacctcaagtgatccactcacctcggcctccgaaagtactgggactacaggcgtgagccaccgcgcccagctggccccattctttccacccttagtcgcttatgttcttttgattcagctgtctaaatacctgcatctctctgtttctggtcaccctgcttggtgcaggccatcattttatctcaactggatcattacagtagcttctgtagggttgcctctgttcctttcattttccttgctacagccagagtgataattctaaaatacaaatctgataatgccacttcctttaaaatccttttttcttctttctggattgcttgcttctgttcctttatttgttctaakacagtctcatctctgaccattccctccctcctcctcacatggtgaacttcgactcaactaaccttctttgtttctgatgtgtaccaggcctcatgtgcctcttgggcccttatgcatacaggtttctttgcctgggacataattttctctaatgccaattcttttggttcattcctttttatttccaggcaggtcttggcttgagtgatgcttccttcaggaagcctttcttatatactcctaaagcactcttgcctttccttaccatgctgtatagtaacttccttcagaagtctataagctccttgatagcaaggacatctatcttgttctccattttatccacatgcatgatacatagtaggtgcttaatatgaattgtataagtcagtgaatcaatcaagtcagtgattcaaatcaataaatacttgttggcattatgctaagcatggtggtagaagagaaaaaatatgccagatggtccttttctagaagattatcttttagtttgggaacaagataattatataggaaacaaatagaggacaacataaaagcaccatataataagatgttaatttgtctgatacagactgtagaagtttttcatttcagagaagggcaaagttagtaagactgaggctgtcagagaggaccatgttggtgaaatgggacttgagctagtatttaaagaataagacatgatatggcagaggaggagagggagctgttttcattgtgactgtctccacttgagcttttctaagcctcactaattttgtgtcctggttagaccagaaacagacttaactcctcagtcattcatgtgatttataaggccttttagtatctctcttcctttacttcctattactcccagtgtaatctcgtagctctagaaattctttcttaatagcccatgactacactaagcttatcctcacttccatacctttagagagggaagcaaccttggagatcatggactatctctcctcataacagaagacatttagtctctctctagatgagagaatggcttagtaaggaaaaatggacctagygagccatggtggtatgtgcctatggtccttgctacacagaaggctgtatagagggaggcagatgggaggattgcttgggcccaggagtttgagaccagcctgggcaacatagtgataccctgtmtcaaaaaaaaaaaaaaaaaaaaaaaagaaagaaagaaaggaccagcattatagaggtggttattagagtgttggcaaatgaatggagcctgggaaagaaraactaatggaggcaagarggcatggatagaaacaattttatatttttcttctcagaatcatttattctggcttcaraattcaagtccttcctctgatcgagttagtgcaataatctgggaggggaatgagtgcaaaaagatggatatgtctgtgttggaaataagtggcatcatcatgagcagggtaagactgaatatgttttcagatttttcaaaaaatatacgaagtgatcaggagctattttataagaatctcttagtgattaaaacagtatgactctgcttttgaagcacatatatatcatattatatataataacattattaacatatatatgtaattttgtagtcagagtctttacatggtagtatatacattatttgttatacctggtctctattaacataatcaactgttcaggtatgctctacagatattccttatctcattgaatcccaatttttaataagatttgaaagtcataaatctgtatgtcatttgtatttatacttttagaatgtgtttttaatagtctaaatagtgtttgataaatactgctttgtaactccatttagctaacacaataatggtggaaattttaaattaattcacaggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgtttkgtcgataattaatttttttgaaagattgtgtcttacttggatgttttttttcatgatgtgtgtggcagagagaacatataaacaggtcagtggagaaataaggaaaattttttacctgtttttgtatatgatattccattgagttgcttttgttctcttgatttggtctctcttcaagttgatgtgggcaataaaggattgataagtggacttttgatatttgtggatttattgtttgtgttattgactatttacatattacacgttgtaatctgaaattttgccaggcctcatgtgtagaataagtggcttagccagtgagtgagcctagccgactgcttagcatctgcacctcagtgtcccttttttgttttttatccatagaataaaataattatctacatgtgataatgtttttgtgaaaaatggccaagtgagaaataaatttattgaaatttgataaaaattatggatggagggtttaaaatattggtgatatgcagaagaagtgtgatttattttattttattttttgagaccgggtgttgttctattgcccaggttggagtgtagtggtgtgatcacggctcactccagccttgacctcctgaggatcaagcagtccttccagctcagcctccccagtagctgggactacaggcctgcgccaccacacccgactaattttttgtatttttgtagaggtgaggtcttactttgttgcccagtcttgtctcgaactccagggctcaagttatccgcccgtctttcctcccaaagtgctgggattacagggcgtgagccaccatgcccagccccagaaatgtgattttgaatggaaatttaatttgagaataagccagaatcatgtataaacatttgagtttgtgaagtagtggatccataaatgccaaccattctttgggggtctccaaagaatattccttgcaaatgttgagtgtaccacattgtgaagaagtatgttactatgtaatgtgctttggaaacaacagggtaacgagctattaatgaaaattttcactgcccatcttactgaacactgattagaacttcattctttttaatrtttttgtattctgggaatatcgttggcaattatatgaatacacagacacatacatacatttcaytgtgattttttttaaatctcttctagagatttttatttgcaaaactcttcagccatattacttctgccaggaaagctaggaaatatgaaatacctcatttcagacttaagaaggtggagaatattaaaatatggttatcactgcgttcctatctaaaggtgagttttatttgattaacaatagagtatgtgcaagaatatgctcactgaagctcctggcagcagttactcagtagacagtgtagttctgggtgtcaggcagattatagcagcagctgacagacttgctggacagcaagttggatgtcatctctctgcaaagctggtaggggtaggtaaagaagagcttagaaagggaaaagaaaatctaaatttcctaggggcaaagtgacaattaaatagtttatatttttctggcttttttgggaaatactccagccgaaagtatgtcaatgaatcagtcacccttaatttggaaatgcatggatttcagtacttaaagttgatgacgtccaaaatatgttaaaatcctatctcagaaacttcttataaacattattttcacacgaatgtagtacaattcagagtgttaataatgtgagggcggttgctgtctgccagtaactaaaacattaacacatgtgtctcactccacagagacgggggccacagcgttcagttgatgtggttgtatcctcggttttcctactgacactttcgattgctttcatttgttgtgctcaggtaaaagtttcacatctgctttaaggaaaaatgaaaattctattatagagttcactttctgttttagacttaggtcactgtccttaagtatgtatttttaatgcatctacattttttactattttggatgtttggtaatttttctaacttttcaaaatgggaatacaagtaattctgaagtcctttcaaactgtaagatcgctctaattttagttggtaattattaattgataataaaactatcatatgnttgcaaaataactgattttctgactacattattccttctgtatttattagttatcactccaaggtagatctttcatttctttccctcttatttattcattcatttatttattatactgtggaatcatgtattctcatttttatacagtgggttaaaatctgttactataggctgggcatagcagcttaacacctgtaatcccagcactttgggaggctaatgtgggaggattgtgtgaggccaggagttgaagaccaacctgggcaacataatgaggacccatctccatgaaaaaaaaagaaaaaaacaacaaaaaaaacctgttactatatttgctttgctgcctacattgtcctaaatttggccagtgggagcccctagaaaccccctcctgtacccttttgacagggtctgctttttgtaaagcacttccgtgctttctgcattaaaagaagttacaggtttatcttatattttttgaattttattgaattttaatgtaattctactgtggtcaaagcatactctgaatattttcagtcctttgaaatatgtagaggtttactttgttatccagcatacattcagttttattaaattttccattagcacattgacaagatttgtattctgtcattgttgagagcagtgtcctttatgtgtcaaattacctacatccttactgaattttttggtctgcttattctgtcagccattggtggaggtgtgtttaagtctgattgtggatttgtctgtgtttcctcttctgtcagtttttgctttatgtgtaactgggtacatccagatttagctttgttatccatctttttgggcagttgacttttatgtcctttatagtgatttatttattttttctgaatccaggatccaattcagaattacatattgcatgtaattgtcatgtctctttagtctcctttaatctggaaaaatgtcaggctttgcctttcatgaccctacaaaatgtctctatttgtaatgtttcttattgatttgatgttaatttcattgcaccagctgtcttgattcatttctacatgttatatctttgtctacctgtttttattcttttgttctcatattttaggtgtgtctctcataatcagcatttcctcttatggttgcttggtgtttgttcattcgttcttcttcttccttttttttctggtagccgggactacaagcacatgccacctagcctggctaatttttaaatttttcatagaagtggagtctggctttgttccccaggctggcctcgaactcctggcttcaagggatcctcctgcttcggcctccaagagtgctgggattacaggcatgagacactgtgcccagttggttgcttttttttttaatccatcctcacagtcttagattttggagtgtctggcccatttaaacttaatgttattactgtaaccacaaatatatttggttcttactttttctacctgctaattttcctttttcattcctcttgtcatctttttattaaccaaatatttttaaatattccacctaatcctattaacttgttatatgttcttttgttgtaagtagtaaagagattacaacatgcatgcttaattttttatagtctaataaactgattaatttatcactctcttgataatgctaggcccttagaacagtttatcccatttacctcttcaccttttgtattattgtccttcaccttaattttacatatattttaaaaccgcaagatgtaattattattgttttgtgtaattaatcatatttactcacatatttaccttttccattgctttttatttcctgaatttctgtgtttctctctgggattattttccttctacctgagtaactcctttagtatttattttagtgccagtctgctggtgatgaattccctcagtttttgcttgtttgaaaatatattttatcactttcacttctgaatgatttttttttttttttttttttttttttttttttaccaggaattgaattccaggttgccagttatttcctttcagcacttttaggattctattgctttctgatttccacattttatcttgagaagtctgctgctagggtgccatgacaagccaaagctaatatgagtcaaactcagtggggaggcagaaaacaaaggtcttgtaaggcaatggagctggctaagaggagtggagatgggagcctacgtagccctgggggaagcgagatggagagggcagctgcttggtgacttcctgtttttcacmaggtttctgtgagcattatctgtatgtttttcagtaaattccatcttactttgggcttgagtaaatttctttacttttaaatcaacaaatttaaaaacaaaaacaaaaaccttttaccggaaaatttgacacataataggcactcaataaatggtagttgctgctgctattgttatttggagcctaaaacagaataaagaactgatccttaggattttctagtcataccagtggaatgagccacatgttttagggagctcacttgacataaagcaaakttattactttgaataatggttgccatatagttgtgagtggacacactgatagttaaagtagctgcaaatgcatttgtcttattttatttgtggtattttccttctttgttacttctagacccttgctaaaggagaaaatctagaaaacttagagaaatatatagtgattaaataaataggtaatagttaatgagtattaaagctcttctgctttcagtattaaaatattggatttttggaaatgttcttaaattgacagagtaaaagagtaattacatgattttaaggtaaatgaaaaacttaacttttttttgatcctttgtataggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacaggtattgatcagtcctgtcaattgggtttagtggttaggggtagcgtaatacgctgtaaggttcctgcagaggattcagggtttaatcactgtctagctgtcactttctagctacaggacctcacaagtcagtttgctgctctgtagttgcttatccctaataaaatggatgtaatatctcctcctgctctgtgagaattaagatctaatggattgaaaagactttgtatactatggagagatttttattggtggtaatggagcatgcttttaatctcatattctatgtcaagtattagatctttagagtacttgtcatttagcatgtataataagcttcttgaattcttctgtattagacatagaatacattattcagtgtttggaagatacttggttttcagtatgtgaatagacactaagattgagaaatatctcttgtaaatacagagtagtataaagtttttttaattttgtttttaatttcaagtttttccataaactttgaataaaaacatttatcattcgtttctgttttttttttgtcttagaatcgtaatggagaattcttcctacaaggcaaaatataaggaattagtaaagtaaaaggagctatcttcttctgttccataaatgtttaatgaggatgttagattatctagggggatagtgagatgaataagatagaggttttgaactcaaggtgcttacgtgctaattatgttatgttgcaagtaatattaaaatttttcattgttttgatatttaaattgcttcatcattaatttttcatcactaaatagtttttctttgccagagggagactgatcaggaatgggggctagagcacatgacatatgttctctgtagcgatagctattggaatttcaaaatttattttacttgaaaacatgacctttgaaatatgccagattttatgcagtatatatatttttttccaagaaatttaccttaatttctattccttcccttagattaatttatatcttaagatggaaaaaaagccaaataagaaagaacagcttactctagtaaacaatgtattaaagctgtccaccaagttgttgaaagtaagtcataggctatgatacacttttactatcatttgagttaaatcagtcttttctctaagaaaacattaaatgncagatgataccttgggttgggaggggtcctggaagtggactcttccacagtggcatcaggggtaggggtcacagtggtggttaggaccagagctgaggtcacagagctcctggaggcaagattaaggncaaagagtggctccccatcaccaagttgggccatctggtcaaggacatgaagatcaagtccctggaggagatctgcctcttctctgtgcatcaaggaccaggttcaaggcatttgtcaccattgaggactacaacggctatgttggtctgggtgttagtgctccaaggaggtagccagcaccatccatggggctataatcatggtcaagctctttatcctccctgtgtgaggagactactgggggaacaagattagcaagcctcacactcacactacctacccttgcaaggtgactggcagcctgcatctctgtgctggtggcctcatccctgcctccaggggcgttggtactgtcttggcccctgtgcccaggaacctgctgctgatggtggttacccaccactgctgcactttgactggggactgcgctgctaccctggccaattttgccaagggcacctttgatgccatctccaagacctacagctatttcacccccaacctctggtaagagacatgttcaccaagtctccctatcaggaatttagtgaccatggcctaaagacccataccagactctccatgtagaggacccaagctctagctatggccaccatgtggtggttttataccagaaaaataaagtgagttaacctgttttaaatacattaattaatgttttacttctcagaacccagtaagagatagatgctaggctgtgtagattcaaaatgctgacctgatggttttgggttaataactactgtgaaaaaatttccaattttgttacccaggttctgatgattgctgatgtctgtcatattttatatatgtgtgtatgtgtgtgtgtgtgtgtgtgtgtgtgtgtgtgtgkatatatawaaaactacaaatgacatattgctcaaatccacctaaaaaaatcttagttagtagaaaagtaggtgagaacacgttatggattttttgaaggtagctctttgaatattaaggaaagacagccttaagcattcatctatacccaagacaaaacacagcaagaagtcactgagtagctatgagaaaacatgtatctcatttcaattctttgatgttttttgtaggagctggacacaccatttagactctatggactgacaatgaatcccttaatctacaatatcacaagagtagttatcctttctgctgtctcaggtgttataagtgatcttctaggatttaatataagagtaagtatcaccaccactctgtagcatcctagtcttaaaaattactatgtacagaaatctgtgttcttcacacgtgtgtgtgtgtgtgtgtgtgtgtgtgtgtttctagcatgcaaataactcttgaggtaaagaaataggcattttgattggtggtccacaggcttttcagcttcagttttctcattttacacaaatataacagacagtgctcttgaatggaacaaaaaaaatcaagtttgaatttcatatcagtttaatagcctgagctgggtaatggtcttactctgatcctggggaatgtacagatgtagaatgaatgaaaaccagtacatgaactgcattgtattatttttgatcctggaagttttaaatgttttttctctatgatgttctatggttgctattgccagacttgatacattttcttcttttataaaggattcttagtttatagtcatgtaagtgtacctataaatcccacctggttttcctagaactaacttattttggtgattttgttctcttagctgtggaaaattaaatcataagctgagttaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaakmtcttttattggaaatatgcaaattcaatacttttccattatagtctatagaactggagatttcatttctctatcaaagagagatcaagcgaactattttaggttaaatccgaataaaagaactttactggagactttcagtttctaggttttctttgttgttgaaggaagaaaattaacttttaaactgtgagtttctgttaaactgtggagaaatgttttgttcgtttacgattttgggttaataactgtatagttgttggcaaacgatgcatgcatacaatatgccatgtaattcagcatgaaaaatttaagtatatgcctactcatccatttccatcatacaacatggtttccacgttctatgtggaagccatggaagcattgtttccatatagatcatctgagttgtggttcctaacacagtgctatgtgtcctatcacaagcatcattgatagtttatcagttgtgcaacttaatgtattaaaccctccgtacattttcaggtcctcagtgtctataatcggccatgccatgcctctgatgatacaggttctgtaatgcagcatcctgttatacacatgcatatacatatgttaatgaaagctctaatagtctacttataattcttgctcattaagttacctgctttgaagaatctctcttttttttttttttttttttttttgaggcagagtctcactttgttgcccaggctagagtgcagtggcaccatcttggctcactgcaacctctgcctcctgggttcaagtgattctcctgcctcagcctcccgagtagctgggattacaggtgcccgccaccacacctggctaatttgcaagaatctctttgaggcaaattgaaagcttgaacattttaatgataaggttttgtgaagttttaaataaacataatttagaaacttggttattacatgtaaagcatgtattcatttaaaatcagaggatcagttgcacattttctaataagcaggaatatttgtgaggtttagaggtggatctctgaagagtccagggattgaggtcagacctttctgggttcaaatctttggccctgccacatattagctctttgtatatcaattttctcacttgttaacccatttatggggataataactacaagtggggataataactacataataaggttgttaagattaaatgaggttgtcatgtaaggtacttgcacagtgtaaagtatttagtactcagcaaatctacaataaatgtgttactactatttaaagtccttaaaaaaaatctcactgataattcctaactgtgaagatagaaacatggaaagcaaggttgctgaactagaagttgattaccaaaaatatgcagccttttatacatgagttataattttttaaatggcaaaactccattatagtgataaacctttagaaggcagtgttctgtagaagcacttcagcatctcaacagatggttcatagaaaccatgcttttactgtttccatagggaacagtagcagtgatctcaaatccaaaattgagctcactgcagatttcaaatgaaaactgatgccttcatctttttcttctacaaaaatgctgttctatttttatgtacaacttttacacagttaattcttagtttaaaagcagtgtttagagtatattaattcaattgtgtggattgcttcagttgtggttttgatggtgtatattggtttaaattatttttcaggtgggtaaaattatgtgtaagtatagttaatcatatcagaaacttaggaatgattcttgactcatttttcttcctcatacctcacatccaatcaatcactgagtctttgaataattatcttctagatatctttctcatcagtccactcttcttcctccccactgccactgctcttatttaagtcagcatcctttgttttttgagcaagtttctgctatctctgctcttatgtatgcttgattcctctttcccccacacctaacccactcatctcaaaaatgtaatatgtcttttctgaaatgtaagtctcatcatttagaatccatcagtggcttactagcactttgaagataaaaatccaaaatccttttagcaaggtgtgtaggcctaccctattgagaaagattttaaatctttatgtttgaaagatacttttgctgggtataaaattctaggtttaaagatgtggttgtgctgttacctcctgggttgttgcattgtttctgacaagaagtctacagtcactctaatctttgctcctctgtatgttaagtgtcttttttctttcttttttttttaaaaactctggctacttttaagatttttctttttaccattgaatttgtgcaattcaattatagggtacattggtttagctttcttcatgtgttctgtgcttggggtttgttgaacttactggatctgtgggtttgtaatcatattttttatatgtagttttctattttcacatacagtttggaaaaatttttgctattccttaaaataaattttctatagtctactcttacttcttccttctgggactcaaatttacatgtatattagactgcttgaagttgttcctcaactcattgatgctttatatgtttttccaaccttttctttgttttaattttggatggtttcttttgctgtgccttcaagtttgctttttttgcactaatttgctattgatcccatcctatacatttttcatctctagaagtttgattttggtcttttttatatcttccatgtctatctttaacatgagtattcttttctctacctcatttaacataatacatttataataggaatagtatataaagatattaaaacagttattggggtcattttcccccctcattttgggtcattgtactgctgttttgcatgcctggtaattttttattggctatgaattttatgctgttggtttttgtgtgtatgtgtgtattcttggtagtcttttaaatattcttgagagctttgttttggaacactgtaaagttattggaaacagtctgattatttcaaggcttgcttttaagctttgctaggtgggcaagagcagcctttagtttttctctatttactgaagcaatatccttctgagtactctacctgatgctctgttcattatgaggttttttctttggctgtagtagcatgaactattcccagacttgtgtgaactttggaatttttctgcctgcttcttggaggttcttaacctgttcttgggtattccctcacatgcttgtgctgatcaatattcagccaaagacttgaaaggagccctctgcatgtctctggagcccctccctttctgtgcagctgcattctctctggtactcctacctaaaattctagaccccaggccttccccaaattctcaattctgtctcctcaactcagcaagactgcttggttctttttggattctcccttcttgcaccacagcctagaaactgcctccttgtaaaactgcctgtatgcaataatcttggagcaatcatgggactcaccttgtttaattctactgtcctgtgctgcctggtgtctatatctaaaatccattttttttcatatttttaaaattgtttttcagttgtttgtaagttgaagagtaaaacaactcttccttaccttagtaaatgagtttctccaattgctcaggctgaaagctccatatctaatctactaccatgtcatgccagttctacatttccacagctactaggttaaacctccttcactctcacttggactactgtgtgacccactggtctgtttccattcttgtctcctacagttggtttttcatagccacatgaatgagcctcaaaatttggaaactaacattgttcctacttaaacctttcctagctttctctttggtggcttccaaggcccttcattatcatgcttaccttgccttccagcttcacctcctttactttacagcctcactcctttacctcactaccacactgacctccctctgctcttctattattccaggttctttctcatatcaggcttgtgcaagcttgtttcatctgcctggaatatattttcttaggttcatctctggctggctgctgcttatctctcagctgtcagctgtcagttccttagagggccttctctgatgaccctagttaaagtagttacccattttatccattatcagttatatcgccttattgatttccttcatggcacttaccacaattttatcgtgtttattttttgactgtctgtcgtttcctttcccgctacagtgtaagtcccttgaaggcagagacttcttcttgtccccagaacatataataggtgttcaataaaaatgtgttgaatgaagaatagacctcaagtaatttaccatttgtgtagtttttttttctgttaggatagaagggtcatacatttgattcttgagcaatgcaggggttaggggcactatcctcctttcctgtaaaaaattcatgtgtaactctgatgcccccaaaacttaatagcttacagttgactgggagtcttgccagtaacacaaacaatcaacacattttgtatgttatttgtattatatactgtattcttaaagtgagctagacaaaagacaaatgttataaagaaaatcctaagaaagagaaagcatattttccattcattaaggagaagtggatcatcataaaagtcttcctctttgtcatcttcacattgagtagactgaggaggaagaggagcggttggtcttgctgagtcaggggtggcacaggtggaaggggaagcacaagaggcagtcacacttgatctaactttacagaaatacattgtaattggactttttgcttttttcatttctctaaaaatgtttctatatggtaccaatcgttcttctactgtttgctttagtttcagtgtccatatcatagaagagtccatgttgtaaaagaagtcaaaagcagccttgaataattggaacccttctgccagattgtcttacatcatcttgttctttggcattgcttctaagttttcttcctcatcatcttgcactgatttggaagcactcgtctccatcaacaagtcatctgttaattcctatggtgtggggtttattagctcctgaatttctcttgaaacccttcacaccccactttttttgccacatccacaatctctttcatgatttccttgattgactcttttgtaaatcctatgaagttatgcacaacatctgcacaggtttctccagccagaatttattgttttgggcttgttggctttcacagctttttctgtaacaatgatggcattttcagtggcatggcataatcattccttccagactttcataatgttctctcttggggttctctttcacagtattgacagtcctttccagagtactgtgtgtaatggatctaaaaagtccttatgacccccttattcctgaattaaagatgttgtgtttgggagcacagagaccacttcatcgctttggtgttgaatttatggggttttaggtggccaggggcattgtccagtatcaaaagaactttcaaaggtagtgtcttactagcaaggtacttcctgactttagggacaaagcattgacagaaccaatccagaaaaagggttctcattgtctaggacttcttggtatacaaccaaaagactgtcagctggtgtttttttttcttcttcttcttcaaggcttgggggttagcaggtttacagatatgtgtagtcctgatcgtaaacacaactgcatttgcacagtattagcttatcctttcctgcctaaatcatggtgcttgcttctctttctaataaatttcctttgtggcattatttcccagaataggcactttcttctgcattaaaaacctgttaaggcagatatcttttcttctcagttatcttctgaatggcatctgtgaactcgtctgctgcttcttcatcagcaaatctactttccttttgctttgtcatataactttgctttttcttgaatcacattggaatctatagatatgccttagagcactcccatactcacatgaagctgcattttaaatgcaagttaaaagctatttcac

SEQ ID NO: 10892 - DNA, 53118 bp, Homo sapiens
  misc_feature (1)...(53118): n = A,T,C or G, or insertion/deletion polymorphism (see Tables 1-2)
cagcacagagtctgacttctgaggctttggtgaaatgactgggaggaaagtgagccatcctgggaagaggaagccctgaggatagaggactggagagacaagttttaaaccatggctgccggaaagcaaggacataaggctaggaagacttagtcctctcagtctcctagaacagtggtcttcaaatatttttgcttgattattatcccaaaataattttgaaaaacccttttgcttttaaaaaattgaaatataacttatgtaaagtacaaaaatcttaagtgtaaggcttagtgaactttcatatatttatacatgcatgttaccaccaccaagattaaggtatagaacacttccagcagcttgagaggttccttcatgctcccttcttgttgatacctgctctctccttcccacaggtaaccactattctgatatgtatttccatctctcacatttttatgttaacatgtagggctgagtgtggtggttcgtgcctgtaatcccgacactttgggaggccgaggtgggcagatcactttaggtcaggagtttgaagccagcctggccaacatagcaaaaccctatctctactaaaaatacaaaaattagctgggcgtggtggcaggtgcctgtaaacccagctacttgggaggctaaggcgtgagaattgcttgaacccaggaggcagaggttgcagtgagccgagactgtgccactgcactacagcatgggcaacagagccagactctgtctcaaaaaaaaaaaagttaacatgtaaagatttctattataaatgtaaacggttgcaaaggatgtaatccctgtcatattttatatattataccttgccctgaagatttatccaatttggtttatagaaatgtctggcataaatctttttttttttttttctaagagacaagactccactctgtcacccaggctagaatacaatggcacaatcagaactcatggtgatctggaacctctaggctcaaaatgatcctcctgcctcagcctcatgagtagctgggactacaggcatgcaccaccacacctggcttgccctacaagatttttttttttttttttttttttttgagatggagtcttgctctgttgccaggctggagtgcagcagtggcaccatctcagctcactgcaaccaccgcctcctgggttcaagtgattcccatgcctcagcctcccaagtagctggggttacgggcacacaccactacgcctggctaattttttgtattttagtagagatgaggtttcaccatgttaacaggccaagatggtctcgatctcctgacctcgtaatctgcccgcctcggcctcccaaagtgctgggattataggcgtgagccaccgcgactggctgccctgcaagatttttatacccagatagtatatttggggtttggaagagaggtcactgtgaaaaggaggtgggaaagtagaacttgcagagtgtggtaaaccaaatttaggagatggtgcaaatggaaatggaagacatgttaaccaatcagcttaaagtgaccagtgcccacttgcccctgggaagcctatgtgtacccctagggcaggttttctcaaccttggcactattgaccttttgggtcaaatatttctttgttgtgagggctggtctgtgcattgtgggatatttagcaacatctctgacctctatttaccagaagccagtagcattcctccactcaagttgtgacaacaaaaatgtcttcagacattgccaatgtcacctgggggagcaaaattgccctgggttgagcatcctagggtactccagtttgaggactgttgccctagaagatagcagcgtcacagagctcctctgttacctgggatgggggcccacaattgcagtgtaggacccagtttcccttcttttgttagtccacagaagtggcacctgaaccttatttcccagtatgctggcagcggcaggagtggaaaggcaggaagcacaggagtaagggctgagtggtcctccttgcaggggtcagcagagtgggggcagtggtcttcatctttcattctagcctttgaagctaaggagaaggttggaaccttctgtaaatatggtttggcaacttcgtcagagataaccctatgagaccccaagaaatactaaataagacttgtggagggctggggatcttttaacaacagagaagggcaagcattagaaaaattcatttttagtcttaagcccatttttaaaaccccattcaagtacggtctagggcagtgctgctcaaagtgtgtgtttgtcaactgtttccagtctctgactagataaagacctactgctaaaataccaatcaacatactgcttccttcattgagactgtcttgctataaaaaaaaaaaaaaagtcagctgaaattagtttagtacttaatgactttagggcatagtgacatcatttatttacagtcttgctcaagctccttatcactgcagcagtacacacttgcagtagctaggacaataaattgagggtttttagagggtcttgaaatcagtactggaaatttcaatctttgttttaaaaaatctagcgacatagaaagatattagggtgcatgctgtttcaaaagaataagcattattttagaaaacttttggtgtaaatgtgcactatataaacattcatgtgtactgtgtcacaatgtaaaaatatatttctaactgtggatattggtcagaaaattttgaaaagtattggtctagggaaacagggaagtacaactgtgctgattttaggtgggatcatagcccactatgatcccagatctttttcagctatacagcagcagtagctactagcaataattaatctatattcctcagtttgcccaggtcccctgtgggtggcacctgtacacacctggttcttacatcttattacctaagggtgttctctggctgagacagtaggcttagccctcatgaagggcaggccgaaagtgcccaggagttaatgccaggagcagcttttactgtgaatgggaattggcagctaaaattccagctatctcaccccttttaaaaactttacaattcaaagttattacacaccattccctaagagggtcctctgtgggactgaacccttgttgttcacagtggtactctcttattaatacaccatttgttggctttcttccttctctgtttcagtttcccattcccttgcaatgggatcatcctccaaataaactacttcatccaaatctttgctttttgaagaaccagactgtattagtcaattttcacactactgtaaagagatacacaagactaggttatttataaagaaaagaggtttaattgactcacagttccacatggccaataaggcttcaggaaaccgacaatcaccgtggaaggggaagcaaggaacttcttcatatggtggcaggagagagagaagtgcaagcaggggaaatgccagatgcttataaaaccatcagatctcgtgagaactcactatcacaagaacagcacgggggaaattgtcctgtgatccaatcacctccctccctctctcgacacatggggattataattcaagatgagatttgggtggggacacagagtcaaaccatatcacagactaagccaactagatactggtcccttgttattataagagttgtctttcattgattacttattagatgccagctaatatgctaagcactttacataagtaatctcatataatctttacaacacagattaggaaaggaaactgaggttcagataaattaaatgactcatctaaggtcacatggccaataaatagggaaatcttccatttgaactcaggtctgttttatcctgttgcctgctgtgctgtaactgtgctattttttctcccattgtacacttccttggcccataaagttattgactatctaacaatttctccaagttagcctatcttgtttagttagcctatcttgttttttggaccaatcttcagcctatgctattcctttccatatccttcccctgaagtgctctgagtgacagaggtgccaactcctgtaggctgcatttcccaggctcctagatcaaccagcctcttcctgcgttcaggcaatgggagatgctggcaagaaactggagggaagaagagagaagtcagaatatttctccctctctctgtgtctccagttgcatctctagcatagctatatcttcagctctacctagtcaggcattcgatggtttgttgcaacttcccccagtggctctggcagctggtaacactgattcctactgttatctctccagcttaggggcggtagcaactttctgcttttacaaatctctggattgcttcacagtcctctgtttggcatctcagctcttccatgacctgtgtaaacaattcatggattaatttcctttgtttcaaattcttaggatggtttctgtttttctagttagaactgactgatacattgtctagtcctgtatttcacagagtgatgatgattcctctgatctgattatacataatgccggagtatgtcattgatgaaatgatagctcagaatcagccccaaaattgcttgccagtgtttgtaatgaataaggtgtttccgttttttaaaaattttattttccagctagcagttatgccaatgttctagcctgggttctctagaaagtagagcgtgaagcaaggactgagtgatgatgttgtatccaggagtatttgggaggtacaaagtcagggcagcaagcgcaagggaaaagggaacttaaacaggggaagatgggaaaccatgcaaggtgatgcttacccacaccgatcattgcttcaccacaaagccacaggtgacagctggtctctcagcaggtacatctgctcccctacactatctcaggacaggctgtgtggagacacagtgcctcagagtcatcgatccaaggaatttaaccacctgcacccctcggtctccatttccctcatcatcaaagtttgcctcggagagtgttaatgtcttcacatttctcttatagcatccaaccctttcagacagtcactcaggaagcctggtactatgcttggcaggctggcatactgtgtgagtacagaagaagcaggagaagccagactctaggacacagctgcctggacagagctgtcatccatggtggaggctgcgagtctgggaggcagtttggatggaaggaatctgagggggcacatgttatggctggaattctgtcccccaaaattcgtatgttgaagtccaaacccctggtacctcagaatgtcactttatttggaggcagggtgtttaaaaacgtcattaagttaaaatgaggttaaaattaagatgggtcctaatccaatctgactgatgtcctatcagaagaggaaattcaggcacgcaaagagacacaaaagatgcagacacagaggaaaagaccatgtgaagaggcagtaagagggcagctgcctgcaagccaaggagagaggcctcagaggaatccagccctgctgacaccttcatcttggacttctaccctccaaagctgtgagaaaatgaatttttgctgttcatgccacccagcatggtattttgttgtggtagtccaagaaaactagtacagcacaaaggttgtttctgagataaacagttcctgaaattccttctttctatgtagagaggttcttccgaaggattggcctgttcttatacaactttgacatcataattttggagagaaatccacccagtggtggggtgggtttatttgtatgaatatataaatattggggttctgttatttcaaaagctgtcacggaagttggtgagtgaggagagctgccttgcagcatagctgcacgatatattcccttacagatcccagcatagtgagcacaatatgtccctttctatcccagatggaaaggccaggtagagctgaggtggccaacatggatcttgtgtggaccaagcaaaacctgcagctaggggtgagtggagatgttagaagtgacccaatcatgtcccagagaaaatgctgagagtgaaagcctaagaagtgtatcctagtgagtcagacaagtaagggggcaccaaggggcactgctctgtgaagcaacattaagcagttaggtatcggagatggaggagggagaaggggatgagagcaagtcagaagaggtgagcagcagggctgactgcccactgaagctagaggactagtatccatggctaggcttcctggtacatgtatcacatgggcagacctaacccaacaaaaggccaaggagagaaattatttctaaatagattaataagtggatgactgctcctgtataacactctccctaaggatgcattaggaagcactgcctgtcctcatcatccataccttgggttatttctctccaaggaagtgactgctgttgaactagatcctgatgcattcattcaacaaacatttaccaagcactgtgctgggtcaagtgtatgcaaggagggactgagatagctctctctgcttaccatctttcaagaactgtataactctgattatttttcctaaatgtattgttgttacaataaagttgatctgatacacattttttaaaatccagtttcacagtttattccaaaagttaggatctttagtttagtacatttttcccccaaatgagattgctttttcttattcataatcaagatttcacttaaatgctatctttttgttttataatgattcctgttttactcattagcatcttgatattaagagaagagtccaggctttaaatttaagcagacttgggtccaaattcagctttatcatttttaaactgggtaaattttaatatctttgagccttagtttccttatctgtaaaatggagagaataacattcactttgcaagctagctgggagatgggaaataatatgcatttaataggtactcaataaatacttataacatggaattatattgtatttatgtttagttcgtgcaaattaaatgaaaaacaaagaaaakggcatactttttgctattcctgaaatatttcataataatawtttttttaaaaaatgaaactttaaaaaatgccttaggaaagtgccacattgaaagtgaatatacagcctcccaaaaagtcygatgcagccaattttccttcagtattgggtgtttctttagttgaacaccagatgatgaagttggcttgtatttacagaccatgctgtaccaaaaaaaaaaaaatgtgtatctttaaacaccagagttacactcaacgcagcaagatgttcacactaggagaagccaaacaagagtacagaagattcaagtctgccatctcatgctaaacctggagcatatcctttgaatggaatggagaacagaggcactggcatcccgtaagttgtgcattctttcttccagataatttaaacagccgtaaaataagtctagttctgctaatagttgccttggaggtactaataatctttcattgagagaactccctgtttatccttgccctttataccccaactcaaacccagtaacctgcgtttgttgcccccagtttctttgtgctaaattcttaaaattgtcaagtgaagcttttcccaaattctctccagcttccattctaatacagtacaacacagaactatgaagtaattgtcagtctttacggttgtttggctcgagctttttggtcaatcttagagaagtaaatctttttttaccattagagttaatgagatataagaagaaatcctcagagaagctgtttgcaaatacactttgaaatcaaggaaatatagtaaggttttagaccatatttaatacatgttaaatcttcctgtcttacatatattttagtcaaaggttaagcatggtgtgaggaatggggtattttagttcttgttgagattttccaacatcagatatattatattgagtcataaaggtagtaaaaaggatagcacttttcatttaatgacttcctcttagcctttgtcaaataatacattgctcttgaagaagggtttggaaagaacaaagtgaagaacccggcattggtaagaaatactaatcactattgaaatctaagcaagtattttcaactagtcttcacactcatctgtaggccatagttttgaaatgttttcggactttcacatttccatgaacactggatagaagccacaaataaatatccttacatgatttctcttgtaatattaatatttttccacttcttataaaaaataaaatgataggccaactcctggactgatgatctttagcagcagcatattccttttactatcatccaatacatgtatataagaaaagtttgaacataaatacaattaatgaagtatttctgaatttttactcataattctttttattccaaagcaaatatcagatgttcagcaataccagattcaaaagcaaatactgcacacatgttgtcttagtctgcatgggcttccataaaaaaaaaaaatcacaaactgagtgacttaaacaacagacatttattttctcatagttctggaggcgagaagttcatgatcaaggtccggcagagtcagtttctggtgagggttcttttcctggcttgcagacagttgtcttctcaccgtgtcctcacacaggttttccttgatgcatgtacgcagagaaagagagagagagagggagaatgtgcacctgtgagagagcaagctttctagtgtcccttcttataaggacactaatcctattggaccaaggtcacccttttcctgctctgctctggcccctggcatcctggaaagcctgtctaaacttcagagttaatggcaggtgttgtttgcagtactcaagaagcagtgggcaaggtcagagaacatctgggaaaggcaagttcaaggtgctgcaggtttgcacagttaagcccccaaagtaccagctaccacttaggagggagctgagagccagaaaacaaagacaacccaggaagcaggggccaagaaagtggccaaagtttgaatataatgagagcagcaaagtccaagaaggtagcatggggatcttaattacttccttagaggccccatctccaaatatagccacactgggggttagggcttctacatatgaatttggggagaacataaayattcagtccgtaacacttgtttaccaaagaaataccatgccttttatcatattctttgcaatatacataacattacttgtagccacatgctacattgtattataacaagctaagtgatgaactgcgtattgattactctttttataacttataaaatgaaaaaattaattcggttagatctgacatcattttaatcttgaattgcatgcttttagtaatctatcttataatacgttttgtaatttatttctcagtggtttaaaatatatctcaaaataagaattaataggcttcttagaactgaaaaatgaaatcagacttttcaagtcagacttggcagtttggtttgacaaaagggacagcgtttgcttgttaggttatgtggcagacattttccacaagtgaaagatttagggctccagtccaaggttttgacaaaaatgtatttaaaacgtgtgataagatataaacattttatttaacaaaactgtatttgtaagagagtcttaaaattaacactgctcccattttccttcccttttctgagcctgttgagttaaataattgcctctacgtgaaacagtacaattaacagtcatttgataagtcttggcaaaggcttttttggtaatcttcatcaaaattgaagtgaattatagtgatgagctataatagctttgtaaaaaatcctctttcaagtcaggtagcttttaactcttagctttcaacaaagttgaaggaacacatttaaaacatcagcgtatagatcattaaaaataatgtttgatagaagatcataacatgatgtattactaaggagatattactaaggagatcaacaaattgagtgatggtttagtaacaaaacccttccatttctatctatttgtgtatgaatatggtttctcaaaccttacttctgtataaataaagactaagaataaaattgatgttaaactcccattctagcattaagtaatattcatccatgggtacatgaattaatttttaaagatcctattcatcttatcaatagattgatttccaatgcaatttttgttcaaaaagctttactcaaaacttgtaatacatgtatattgcttagatcaaatgtaaattagtagtaattgtactgataattcaatctggaggaaaattatttctctttactatcaatttacaaggatatttttgttgcagataaagattgtagggtatcaacaaaagacttctaagcataaagcatattacacttctttggagaaagtagaatgggaatatgagttcaaggagaaaaaggaatcatgtaaaatttcataccattcaagaaacatgtttatgtctttttaaaagaataatgaaatatcaaattgttatggtatttagattccattgcatacattttaagtgttatataatggctttatttttaaatgaccatcattacgaaaggtaagtacatcctttgcagccatttaaatttataatgacaaaattagaagtcaattggaatacataagaagggatagagttattacaaattcttttgaggatgttcctgcaatttaaagtcattgacttggaagttccaattgggtatgcttgcacagctatgtcagcctgatgcatccatctcattttaagaatggccctgactcacaggctggatatangttcatgtatatggaccaagttcccttcttagaaacgaactgaaaccttttttgaactgtgagaactctctcttttttaaagttaccatgcagatcatctttcttttgttaagaatnttttgtttaggcaaaacttactatgatcagttagctttctcagagagtggccattcattccaacaaaaaatatttaattgaatatcacgcaggagaagtagataaatttagaaaaatgcaagtagtttggcctgatgctgggtctaactgttggcattacagtcttacaagctatgctgagaagtaacgctaagatgatgttctagatcaggttcgcaaactggaagctcccaggctaaatatgatttacttaacatgatttatttgatctacactgtgtttaaatttttaaaaaattagttgacaaaattttacgaccaggagatataacataaaaattcagttttccagctgttcttggaaaattgaaactggaaacattgggccagtaagctgaaactgacccaagtagtgcatagtggtttccatctttaagtaggacacgtctccaaatttgctattactcctgcgtttgtctacactagcctgcttcactcattcattatgcctgcctgactactatgggcatttgagattgagacattaactttggtttattagtttcccatgggttagatggaatctgcagaagcctaaatatctatgttgcattactgtggccccattaactgctttcagtaggtcattcatattgtgctctcaactttcatagacagttaccaaaagaatttgtatatttctcctacatttgtatgcttctccaatgagaagcaagcaactgattacattcaccttttttgctttggctgccagaaagctctacatttatggcttaactattgtattgtgttaatacctcataacctgcagatccttgtccttactttttctttggtgttaacctcctagtctagttagtttcgttggtcctcatttttttatatatgtttttttattttattgtatgaatttactggaagcctctaaaattacatgtttataaataaagctgtattgatttatttcctttctaaagatggttggaggatctatgacattttggttctccttaggaggttactatggtttttagttttccttgctcacatatccatttaccacctatggaaattacttagattgtaagcttttgggggacaaggacatttttatggtggtcccacagtgcccagcatctagcactttctatataatgccctgtattgcatagttacaggataataaaagtaaaaagtaatagtattttaatttaaactccttgggtcacaaggatttttaatctgtactgactcatgaaagtcttgtcaatcagaaagaatgagagctccatctacatatagactttacacactttatcataaaggaatgtgttatgtaagactgagtgataaactttctctagtgatcaggtgggggaaagtagctctgctaccttcaactgctaataaatttagcttcatttatctttgtctgaatccttatttaataccatggactcagacttcctacactacgttctataatagggagcatataacaatcaaaattacaaatgcctatacaaaatctttacaattgaatataaagaaagtctacagaaacattactagattcatgaaagtgaataaatctgtgtatatttcagttatggcaaaacatataatctaagactacatttatagtttggattagccaagtttgctgggaagaaaatgtttttcccagtgtaatgtatgaggcaggttgttggagacactttcttcacgtggctcagactgcggtccagcwgctcagggcactgtttcatggttctgtccacagcgcgtgctcactgcstcatttctaaagttattcacttgtacttaatttcaagccattttttyttactttgaaaactctgaacgcctcattgaggacagtacatacaatgtgtgccaaggtctggtttcaaagtttagctgtttttgagttatttgactggacaaaaggtcgaaagatatctttcacagcagggaaagtgtaattttccatgtctttatgatgtttagaaatagttggagtgatttttccctaaaatttccataagtaaataacttttacccgtggcataagcttgattttgagatrccttggcaaaaaatttgaaaataaccctctccctacctccagtctccagcctcatcctcagtatgcactccagcaataagggaattggagggaccccaggttaaaatcaagacctttcatgtttggattaaaagtatgacgtatggaaagttttagcttctaaaaacttgtctttatcatttaatattacgtatgttttagaaaaaagctgggagaagagctctggtgtctgagatcactctctccaaattcctgtagggtcctgctataattcctgatggtatttgcatctcacttatncatgtaccttacagccgactttcttttccacagatagaattggcctcccactttaggacaatgtgtcctccaaatttgctagggcaactccataccttactttaacttcttgcaggacctaactctccaatcagtcgttagtgtatatttttgtgtacttggctcaaagtctttcagtgtggatgtggaccttccggagagtaatctcctccaatgaagagcaaatggtcataaggaacatgtacgagcaggtattcctgttaagccttatgctccgtctttcacccatccacttgcacaggggactagtttccttttatgatcctacccaaacgtttggcctttttggagaagtgagggaagtgaggggtagaatttttgagactcagttcagggcctttgatatgctgttcctgtccttcaacagatgtatcaagtatctctgggtcatcccctaagacacgttggtgatgaacaattcctagaactggtctaatttttttttttttttttttggataacagcacagtttatattttttgggcatcttcttgaactgtacaagtatattcagcatcatttctctgccctgtcgatcttttgtcttttcttctgtgctgtcaataacctgtttggcaaatgtctacttccattgtccactccgtgagcagtgtacaccggtctccatctcccattcctgcaggtcccttcgtggaaacggcaaagtgcctgactgtagtcctctcattctggactgactctgccatccaccagcctcttctcccatttcccagggcttcctcccacatctgtctatttcatagatcgcctcctcctcttagggaagttgagtctgtcgagttcccctgcacatcgcctgccagtccaagtctcctgcccgcctcccgcacgccctcccgcgccgcggtgtctgtgggtcggttcccagacgcgcccgccggctcttgggcctccactggctggacgtgggtctgtcccgcgcccgcgcgtccgtccgtcccccacttgcctccaattcggcaggaactttacaccagccaggaggagaaggacggtgcgcgcgggtgcgggtctggccggctggggccggcgcgggggcggcgaggggcgccgggcggcgtcggcttgcgagcgggccgggggcgtcgcgggccgccctgccctataaggggccgtgccgcctccgccgccgggcgggtgccgggcggaccgcggcggtggcggcggcggctgcgattggctcaggcgccccatccggggactgggctcggcgctgctcgttcgccctaaaggtaccaatatggcggaggtgagcagggaaaccgggcaggagcagccgggctggagcgggcgcccggcggctccccgcgacccccgagccagcctgggggatccggggctctttccgctgccccatgaggggcggcgtggcgacgcgggggtcgcggggcggcgactggccgtggcggggctggccggggggcgggagcgggcgcgggagcggtctccctccgggactaggccgcggcggctccggccccggtcgggccgggcgaccgagccggacggaggtggcggccggctgcagtgagccctgccccagggacgaggcagtgccgtgtccccggtcgctgacgcgggccgccggcgcctccgcgcctcttccccgggcccgggtgggtggaaaccggcggagccccccctccgcggccggatcgcaaagaggggagcgggctgcgccactgccctgcgggagtcgtgcgctgtgcccccggcccaccgggcccgggctgcggcgcgaaggagccgcacgcttcactttgctgggggcgcggagaagagcgggatgcggggccaccgggcttctcagaagagcgggactccccaccccgcagcccgggaggtgcgggagcccctggggttaaagggcagaccgagaccctcgacgccctctccaggagagcggcttgatagctccagttttctctgggctggaggaaggaaggctgggcgagcgaagctgccccggccatgtcccccgggactggtgagctggggggagggggcggtgtggcaggagcccctgggctggagctcgctggggcggggggcgcgctgacggtccagggagggactgaacactctggaaggagccagcatccctggaactgagaggagctgcatctctggactcgagagagaggatggggggctcgcgctttggtttgggggcgagtgtccgattcgagctggcctacgctgcaggggaagagatcggcttcggagttggggctcccgggccccaggggcgaactaggtgctcagaacgcgagttcgttccagaaaagggtgttacgtttcgagttgtttggggcttcggagagccgggtgggatttggaggactccggagatgccagggatgggggactgatggtgccagccgactgctctgggttttgcttctctgcttggaaacttgctgagctccaagaagcgacttggagttgcctctcagactccgggcttcgtcccgggtctgtgagtttgtacacttgggactcggggaggaaggcgaggcagccaagagggggcccgaaaggggccgggagcgattcgagngaagctacgtcttgcacttttggcagctgcggaggagcgctcgactccgcctcctctgcgccctgttgccggcgctgcctctttccctggctgtgcgatctaacctcacgttttcttctstctctcctaggcttcttttggaagttcgagcccaggtttgtcctattttcttacgtcttcggtggttcccagtgggtaatgtgggctcaaaggtctgttgctaaaggattcccaatagaaatgtatcctgcaggtttttcttcattgatttttaagagtttcagtgtgcatttagtaaagtttggggaagaaacagttatactgttctttgttgttttctcttgcatgttgaaaaagtaactgttacaaagttgctaagacaagcgttcttttaaggaatatggctttaattattacatatcttatttttcctccgagcctgaaacagttaatcccaaattaacttgacaccaactttagcaatttagattttaacttcggtttcttctagagattgagtaatttgtcagaactctgggactacttcactaactgtaacccctcatctcctcttacgttgtttctttttcataattaaatgtctatgagttgtgttaaaattggaagttgagaggtaaagctaccttaataaaaaagacagaacttccaagtttggcacagaaaaagggtgattttgacttctgagctgagacgatcttaggtcatctagtacagtgtttcttaactttcctgaggtcagaaacycctgtcaggatctaatgaaagcaagggatgtgtcccagaactctscacatatgcataattacacacaatctggggtttgtagaatccctgtagcaggtccataaggacctttcctcatgtgctaatcatgtaaggtatctttgtttcagtttctcatttcctttctagcttacctctttgctgtcttccctctcctagtctacaggaaaagcacctctgaactagtccaactccattattttacagttgaggagacttttaaataactttcgttagtggtggagcacagatgagctcctaaatcttccattacaacttgtttccatagagtgaatagtcagtttccttacactattactttttgtatctgctccaccttcagagcctcacttgactgtcatttaaggtattataacaccaagtagaagaaatttgcagctattttaaaaatagctgtctatatctttaaaattctaaaaatttttgttaattytgagatgaacttttttgttataactgattttaggaaaatatatacatgatgtcaaacagctggattaatggaatttttccatttggtatcactgacttcttttaagaagttgcactctaaataagccaaaagacagtgtaacctgtttttaatcaattagcctctttttgttttttgtttgtttgtttgagacgttatgcaggctggagtgcaatggggcaatctcactgtaacctccgcctttgaggttcaagctgttctcctgcctcagcctcccaggtggctggtactacagggatgcgccaccacacctggctgatttttttgtatttttagtagagatggggtttcaccatgctggctaggctgatcttgaactcctgacctcaagtgatccgcctgcctcggcctcccaaagtgctgggattaattagccagttttttaaaaagagaattttagagttggaagggacttttgaggtcctttcagtcatccccatgtattttgcaaatggaagacaggagctagacctagaaagtttaaatgacttcctttaggtcccaaaaagccaaggacaaagctgggagtagaccctcaggtccttcgatttttgacccttactgaataccttccatgttaaaggggaggcctgttgtgccaagtgatagaagagtaacagaagagcccagaggagctctgctaccaaagaggtgaaagagtcagcatctatttcatttctgcctctttggcataccatggaacttgccaagaattcctcaaaaaaagaaaatttgtaatggtggatgtgagctaattaataaatattcttatttcttttttgktgkttttttgttttttgagatggagtcttgctccattgctcaggctggagtgcagtggtgtgatcttggctcactacagcctcgacctcccaggttcaagcgattctcctgcctcagcctcccacgtagctggtggtattacaggtgcccaccaccatgcccggctaatttttttgtattgttagtagagacagggtttcgctatgttgaccaggctggtctggaactcctgacctcaggtgatccccccacttcggcctcccaaagtgctgggattacaggcatgagccaccaccccggcctatatttctttttaaattaaaccacatgtaaatcaacaagtttttaaatgagcagatatttttcaacattaaggaagataacataatgtaaacctgccaaaaaataaagtcctgtagaaattgtatttttagaactaattagagttctctgaacccagaatcaaaaataatgaattatgtgtgtggtttttccatagtgaaaaatctttggcccagttcagtgttttggtaatgatctcacactgtcctgaaatgtttgaaattttaaaatattcagtagcttgactaagaacagattaaactttttatgttgagtatgcttccatccacttcttccttcccccaacctcagtttctgatactttccttccttgctctgagggttacgggtctaattgaattggatactagagtaaaacaagtggagaaaatcctgtttttttataaatttgatttcatttctttgggattatggattttagtcatttcttctcttggtttttggagtttcctattgacttcatntttgctattaaaagatattatagttttataaacaagtatgaattatccaaaacaacttgcaatggatatatcttccaaaaccttcagatgtgattttctgtattccctacacataatcctaagaactttgttagtaatccaaagtaaagcaaagtcttacagtttaatgcttgtctgattaatgctagggaacttgaagtactgttagagaaatgtaaagtgatacaatgcttttaaaagctgaatggctgtatagctgcttcacagaaacttatatttgttttataaagcagatttttgttgtgttttctgtctttatttgagggttagaatttgagtaaaatttatattatcctgaagtgtgcatcttagtgtatagtcgattcttgtgaaatcttccattcatggaaatttaatctttctgatattttgctattgcttttagacagatgtattaaatgataagcaagtttgactttttctattagaatgtttctttaaaaccatgctgcttaaatcactttgttgttatcataagwtgttttcttgtggactaraccccttataaaagtgtttgtgaataactttgccttgttattttgctgatttagacatattttcagaatcatggggtcttaatttataacctataaattatatagtaaattcatttagtaaaaccctcatataaacatgaaaagggactggcagaagaacacaaatttttattttcttttgttaatagccttgtaaatgtgtaaagtgattcagtttgttttattccagttgggtctttgtcttctgaggatcatgattttgaccccactgctgagatgttggtccatgactatgatgatgaaagaactcttgaagaagaggaaatgatggatgagggtaaaaacttcagttcngaaattgaagacttagaaaaggtataagatttactttaatatacaaacttaacaaagattttgaaattctgttgtaattttaaaaataatctacctgaaataaaaataggatcataatccttttttttttcactcttattttgggggatagcctaataagtatgctttcatttaatttttcaaaattattttgtatctgttaacttaatttttaagcttatatcancacagtgaagtaggtacacgtaggcattttacagatgagaaaattgagatacggaaaactataagccctaagattatttctgaatcctagtctagccctctttccattgtaactactattctgctaagggtcaaacttgaatttgtataagtactgtagtagatacagagagaagccttttccttcaaataactcataatctagtggaatattttaagaaaattnaaaaagatttactgtattttcaaatataaattggtaatatcccatcccctgctcctttaaaagtcatctttgaaaaggttggcaagagtgagtgtagtttgtaattttttaagccccaagtcaatataaattcaaatgaactgtattttcatgcatttataccaggactgtatatagagaggtccctataggggtcaccttgaaaacgtgtaggatttatgcttacttaaccatatttgaaaatttcttatcagccagaataacaaaagctttcagaaatgatacttatcccctgagtttcttatacctctttttcttgaaaagggcaagcacattcttatatatatcatctcctctgcttagtagctttgtgaggcaggagtggagtattattttatttccttcttcatgttaatacacagggaaacagaagagtgacttaactgcccacttgctctgatctgttgttcttatctgtagtgaagtacaactgtatacatgtggtctctattctttttattgatgtttaatgaaacatgaaaatgaataaaagaaacagtagagacacaaatataaagagtaaggatcaagcttttagaaggaattttaaattatgttttgattatttctatatcacttgaaatagtgtattctcttaatcttttttagtggaatagggatttaggtattggtgcatgttaacagtcttaggggattgatgttaatgttcattttcaagaattataagtttttatgttcatagtaaataaactcagttgtgtgttgactgtaatgtggcccatattttggtgtttacaaatttttagtacgtcgtgttatggaaaataaggtaagtactaaagcaattttctcgtagtagcactttgagtatagaatatgtggctagattttagttactaaacatactaaaatagggtttatgtaatatctttatatattttaatgtatgcatattactgccatctgagagcttttaatagacctagatttataggtagaactttttttttttgagacgaagacttgctccattgcgcaggctggagtgcagtggcacaatctcggctcactgcagcctctgcctcctgggttcaagtgattctcctgcctcagcctcccgagtagttgggattacaggcatccaccaccacacctggctactttttgtatttttggtagagacggggttttgccatgttggccaggctggtcttgaactcctgacctcaggcagtccacctgcctcggccttccaaagtgctgggattatagcatgagccaccacacctggctggtagaactttttaaagagttcttatttctacttttattaatacataattacccccttgatgttcactgtgagaaaaattcaaaaattcagaaaagcacaaatgagaaagtaaaatatcactttttctaccatttaactttagtataggtttttccttttttgttaaaagaaaaaaaggcatttaggctgggggcagtggctcagacatgtaatctcaacactttgggaggctgaagtgggatgatcgcttgagcccaggagtctgagaccagcctgggccacatagtgagaccctgtttctaccaaaaaaatttaacaattagctgggtgtgatggtgcatgctagtagccccagctacttgggaggctgaggtgggaggatcacttgatcatcccagaagttcaaggttgcagtgagctatgattgtgccactgtattccagagtatgtgacagactgagaccctgtctggaaaaaaaaagatcaccagacatttaaacaaattatatgtatatagttttgcagcctgtgccttaaggtatcagacaggcgttagttactaacattaaaatgcatctcagcctcatttggtccatccagtgataccatcagttgtgtcagatgaatactggcattatttttctaggctcagaggccttgttgattgtaggatgtactgttgatttctttttttttttttgagacggagtctcgctctgtcgcccaggctggagtgcagtggcgcaatcttggcttactgcaggctccgcctcccggattcacgccattctcctgcctcagcttcctgaatagctgggactataggtgcccgccaccaagcctggctaattttttttgtatttttttttttttagtagagacggggtttcaccgtgttagccaggatggtctcgatctcctgacctcgtgatctgccctcctcggcctcccaaagtgctgggattacaggcgtgagccaccgcgcccagcctactgttgacttctaaacagtgcaggtggtggaggaacgcttgtatatgaagtttgcactttagtatcaggctacatcctgattctgatatgtgagggagtgcatcataggatcaaggaaatgatggtatgtgaggaaatggaggtgagagggattaggtgatttgtccaagatattggttagcaattagtggatcttttgccctaaatctggttctcttcctgatataaatcctttgacttacagaacagttcatttataagtgtgactagactctactgtgtcccttaaaatgtaaataggttcaacaaaatacccaagaagaggaagagaaaaatccttatacccgggataaggtgatggatcacacttctaagctgatttagctaccacagatccttacagactttgagacttactaattcaattttgaaaaaattgtttttatgttttaaaggacttaagtgctttattaataggctctcaaagagagttcatttgtgaagtgcttcagagactagattcaccttttccagttttgctttaaaagttttggtgcaaatgatgtgtgttttagcatcagccctctggccacccgtgtcatcccttgaacttattaatgcagtttctacggagatggtcatcttstccctcaacagatggtcattcctgtgtctttatagaaaagcggggttttcttgagtggatgctgggaacctcctgtctccctcacatgtacaaacttttatattattctttccctcctgtcctgcaaagtatctgtgatatcccaggctaacctctagattctatccctcctgccctcaatttattcttctaccttttttttttttwaatttccacataagaatcctactaatgcagatcccacatttggaagaaattctcttttgatcttgtgttgccctcagtcactctccttttgtagccaagtctcaagtcatgtatgtactttcttccctcccgttcagtctttagcttggcttcttccaccatgctataaggccaccaataattacttttttagagatggtctcactctgtcacccaggctagagtgcagcggtatcatcatgccaactgcagccttgacctcctgggcttaagcagttttcccccactcagcttcccaaagcccagggattactggtgtatcccaccaccctggctaatttaaaaaaaaattttttttatagagaaggggtcttgcaatgcccaggctggtctccaactcctgggctcgagcaatcctaccttggcgtcccaaagtgctgggattacaggcagcagctaccgcgcttgtcccaggtcaccaataattcctgattgccagatactaagatttcttgtctttctcttgctcagtttctttttggaatttgacccaagtgaccattcrtgattatccatacttgtttctgccttaatttaagtaatcctactttttcctcgttctattttctggcttctccctctttcttattttatgatcttttctttctttgcccgcattttaattaacattctccagggttttggctattatcgtctcactctgtgtgccttttctgggtgttctcactcaaacccactgctttaactttcaccttaaactcatcgttaccatcccatccttaagtttatcttgtgcttctgtctcatagtggtgctatagttacctaacttctcaggccagaaatctggcaatccatttagactcctgtgttgctttcattccttgtatcaagtaactcaagaaagggatctttccctaaatttcactcaaataatccccctccttagttcaggctctcattctacttcccttacaacattatttccaaaatacaaatcatgtttaagaattttcagacatacccattgcccatagtgtaatacatctgaaagttcttctgataagcatagatcccttcctcttttctctctaccctctccgtgggtgagctcatcaacttctgtggctttaaatatcatctagatgctaatgaatgccagatttatatctttagcccagcctggttctctgagctccaggctcctggccaacctgacttttctacttggatgtttcatagtcctcttaaacttaactgtgtcctttgcagaactcttgttgttgttgtttttttcttcaaaaaccttttattcctttagtattctttatcttggcagaagttaccaccatctaggcaattgctcaaatagaaaactggggagtcctccttccctttccctcccacgtccagtgacccatttggttccacctcagaatatgtctcttctcttcacttctctcctcttgtgtatcagtaccctcacctagcatgaggctttttaagtggtttccctgcttctcttgtatctctccacccttcttaacttttcttcatgcaggtgttcagtattttaagaagaaataatgccatggtactccctttttatgagtctctaatggctcctcattgccctgggaatgaagtccaagttcctttccctggccctgaggccctttgcgatctgtccctgcctctctttccattctcttgagccattcttcattctactcaccaaactttggccacttggcttagcagggaaccaccttcaggcctcacatatgtcttttttttttgcctggaatactcttcatgggactggccttctcagacttcaggcctccgctgaagattgctgactgtctttccctgctaccctctggaagtgggccccgagtgttactctgtatctcagggctctatttgtttgttacactcatcaaacttggcagccctatatttgtgtattgtcaaaagccttgtratctttcaagacttagctcwgtcttcaccctctgtgcatacctccatactccataccagtattcttggggtgtaggtctgcccttgtctatagtcacaattgaatattgaagccatcacattgtatcataatggctaactcatccttacatccttacagactttgagacttactcccactaagttcctcccactaagactgaattccttgtgagcagggattcttcagtaaatttcatttgtatgtccagtagckagtagctagtagccctcagccaagcacttagaactgagtaaatgatgggaaggtggaccatcagtgcataaaaggtgaaaattgccactccccatttcagggagagagtgtgaaactgtgaggttctgcggaaatactactgacaggtgcttggcaaaggctgcaacccaggcacctcttgtattagaaccaatatgagccaaagggaatgggctgcatggactctgcaaggagcaagataggactgtagagagactctaaatttgagtcttgttagcttcaatggattctttggtttggaagaaaaataattcattgaagtttccccatggtgtaggtgaacttcaccctgttctgaccatccaattcaatttatgctgattccatgctcccagaggacttttggttgatttaaatcccaagctaaaaaagattttcatgatcatttatggtcattagaaaggcgtatgtctactactgcaaatttataaattagtgttctatcatatacctgtttgtaagttcattgagcataaatctgttttagttagacacaataaattatgtaagttccatacctgcaaaggtgaaggccaaacttttgcatcccctgtgggccctgtgggcagccagctggccctctaaggaatcatcactggctcttctcaggtcactttgtgatcaactgtgggcatgttttgcacactctgctttagtgttttcntgttgtttgctttacggattattttattttaaagggaaaactaaaccataagcaaattttaaaaatctcttaattgatggatacagaaatcttaaaaatgtttaacagattaactagttcgtgagtatattgttttgaggttatttattcgaatgataaatarttctttttttgtatttttagtagagacggggtttcaccatgttggccaggctggtctcgaactcctgacctcaagtgatctgcctgcctcggcctcccaaaatgctaggattacaggagtgagccactgcgactggccttgaatgataaatagttctatacactttagtagttaaaacatagtcatgtgtcactgaacaagggaatacattctgaaaaaggcgtcattaggcagtttcattgctgtgtgaacatcatagagtatgcttagacaaaagtagttaatgtagcctactacacacctaggctatatggtgtagcatattattcctaccacagctgtatgtgcatcctggctgtatatgcagtctgcatgtactgaatgttacgttgtgcatggtaacacttattttcacatggattcctagaggggaacagtgacttggtgtcactgtgaggcatggcrtaggtattcataacataggcagcactgtagccagggtatgtaattttattaaagcagtgcagccagtgagataacttggggaactgggattcaaacccagaattaagccacagttttctcacctgtgaaatggtgataacagtataatcttcctcagacagttgttttaaaaaaactggtataaagataggagatgtagtaagaatataaaaggataattgttctttgaacataaatattgctgatgttagtaaacattcagcaaaggttttctaccaggtgtcttctaattaacatgaagaataaagcaagtggtcagctgttaaatgcaaggaaagaagctgtgaattacaagttattgattgattaattggaaatgttttcagggcaaatctttatgttaacttgaaagcaaaaaaaaaggcactaaagcaaatatttgaggaatttttaaaatagtaaaatgcttctagaaaataaaaactaaggtgttaattgttaggctgttgtttatacattaattatagctccaggtgtttggtcctgttttctgacaacagcacaaaaagaaaaactgaaacttgcctttgatttgttctgctgttttgataatgtgctttctgaacctaaggacagtacagtttacctgcagttcagtattgtgacatctgctgagtccgtgtttatgccctggcttgaacaggaaggaaccatgcctctagaagatttactggcattctatggctatgaacctacaattccagcagttgcaaattccagtgcaaatagttccccaagtgaactggcagatgaactaccagacatgacactagacaaagtaagtgtgagcatttgaaagaaaaattcagggtctgttaccattgactgcttttacttccatttaaagtattatttaataattcttaaatgtaaacttcttgttgacccattgtgcttattttggtggctgatttaaactttgtttggctttgatcaccctatgttaagagtagtattaatagcagcttcatggtactttgcatgcctgaatattctcccataatgttttcatctttcctgtgtagacacattgtatctaaacttagattttgccttaacttcttttgatcctataaacacataaaagccttgattaataaatcccccagaagccttcaaaccaagctggcttaggcgtggagtggttggagagaagttctgttttcttggctctgggagtgacagcggccgcagcagccaagaccgcggtgatccatctctaacgtaggctggttgtggggaggcctagtccctgctgaggaaaattcacacggccatggcctctgctaacagatccctgggaacctttccttgcctttcagatctcaggcagggagaggaatccacatcttggaacctcttcctgtgagttatattgttcccacttttaagtcaatgtgatattaatgtaccacagaccttaatgaccatagtcattcaacaagtatttattgagtggctactttgtgctaggcacaaggatgactgtatacttacataaaaattaattcaaacttgtttcttttaaaattatgtcagtagtcagtgctgttcattagtcggacttttaaattattggaagagtggaggttggaggcattttttcagttttattattgacagaaaatgaatataattgttaaccacttaaaagtcagactgtttttgttgtaaattcactaaaaattagcctacagctttagataagctctctgcatacccacaaattaggcaattgttttagtatatgkttgcactgattatcatttaatagtatattattgaatattatataatatmtaatattaaatatttatgtacatgaagtaaatcataggagaatttcatatttctctcataaggttccaactgcttcttaatgatatgttataaaaagatagttttcttaattaatgagatgtaatcatttctaactstagcactgcyttcttattcttccaggaggaaatagcaaaagacctgttgtcaggtgatgaygaggaaactcagtcttctgcggatgatctgacgccatctgtgacttcccatgaaacttctgatttcttccctaggcctttacgatgtaagaaacccagtggattactgataaatagtaacattgatactgtagctttagtacattttattgtgttcagtaatttgtgtcagaatattctaatattttatgtggttgagataaaatacttctataatttaaacaagattataacctttcttttgggatagaggtgaactaatatgccatttaaaaattgaaatatttggccaggtgcagtggctcacacctgtaatcccagcactttgggaggcrgaggcagacagatcacttgaggccaggagtttgagaccagcctagccaacatggtgaaacctgttctttactagaaatacaaaaaattagccaggtgtggtggcatgcacttgtaatcccagctacttgggaggctgaggcacgagaatcacttgaaccttgggggtgaaggttgcagccagctggagatcatgctactgcactgcagcctgggtgacagagagagattctgtctcaataataataataataataagataaaataaaaatggaaatattgactttatttttacaaggccattttccttctcaagactcatctgttgctatggtaatcattcttagtttgaccacaaaattttatagacctttatttgaatttctattaaaaggctcctgctctcctggttttgaaaacttatcagtgctcaaaaggtatttttacttttaatgattcatctttttcctattagttcttggtgttacctcttaatgtttatcagtaatatttaaaaggttttggggttggttgtgtggttgcaacactttgggaggctgagatgagaggatcactttaggccaggagttctagaccaccctgggtaacatagcaagaccctgtctctacaaaaaaattttcaaataaaaaacttagctgggcatagtggcatgcacatgtagtcccagctatctgggaggctgaggtaggaggatcactgaagctcaggactttgaggtcacagggagccatgaacaggctactgctctccagcctgggtgacagagtgagaccctgtttctaaaaataaataaataaaatgtttggactaaaataatttcttagatgcaatctcactttttttttttaggtatttttatgatagaagaactgtttggtcaataagttcaaatatccatgcattcgtgtgtgtacaaaaacagttttgatggacctgatatgcaactctgtgtgtgtatctcctggattagtataatcagaactccagtgttttactttctttttaaggtgaccacagtggtttccttttacctcccaaactatttaatagtataccataataattatcaggatactatacacttttttttttgagatggagtctcactctgttgcccaggctggagtgcaatggcgtgatcttggcttactgccacctttgcctcccaggttcaggcgattctcctgcctcagcctcccgagtagctgggatgacaggcaccccccaccacgcccggctaatttttttgtatttttagtagagcctgtcggccaggctggtcttaaactcctgacctcaagcgatccacccacctcagcctcccaaagtgctaggattacagccatgagagccactgcaccggccaggatactatacactttattaggattttcagtgtctcattttgaccaatgtcgattgtgagaaacatgcaggtggtttagtatacttatgctgatctcacatatttaacaacattttgtaaaatacaacaggcattcttccaggttctgcaaaaataggcagtaaaaacctttttaatttttgtcttttaagcaaatactgcatgtgatggtgataaggaatcagaggttgaagatgttgaaacagacagtggtaattcacctgaagatttgaggaaggtaagctgagttaatatagtggactaaattggcttttaaaaatatttctgaaatgatttatgataattttgttgttttgacttgtagaaactgattaatgatatggggctttttttcagtattttttttttaataagttatttttacctctcaattttcctgtaggaaataatgattggtttacaatatcaggcagagattcccccttatcttggagagtacgatggtaatgagaaaggtaaggaaagcttttgattttgataatgtttggtagataaggttaccacttgataagtgtatttaaatatctggctttataccagccttggcaatagatagatagatttgggaaacatgcagagttaggatttttaggcctgacttaggaaaaatgtatcaaagttaatcactagactcagagtttccccccacccccaaccctgcccaaggcacacatagtgcttattagccagtgtgctcagtgcctgttcgaataatggggagcctcccacggtgctgtaccttggccttcatcctgcttcagtagaagtgggtaggatctcatcacctgagataatgagaatgttaagatataatcttctggaaagaaaactcttgagggaaaaagagactggaagaaattctccttccccagccccaaaagagcaggaagtgaaatgtaaggatctgctttcacttgtatactcctaattatgtgtaatcagtttttcctcatgtttttggtgcattccaactgtagttggttttcaaaatatggaggggataaggtagtaggatataaaaatataggtaaaccttcttagttgaacttgggaatatttccatgggtgtttggccttttccctaagttgatttatccttgtgaagtcacaagggcaaaagcagcacccaacacaatacttcctgagtccttcttttttcctttcctccatgccaggtcatcctccatttaaaggaggggaggagtggttaccctggggttgttagccatggcagccactaggaacaccgttttcctaaactgctttcaaagtgttaaaagacagttatcccaggggaagcaaaacatagctgatgatgttcagatgtgccagccttctcacctcaccacccaaatgccacacttggcctttgagccaagtacatactcagcaactgtaggtccttaggtcacacatagtagaggtgatattctgtcagtgctgcagattggagggaaggtgtactttctctgtcttttgagggaataaacccaaattgttttacctatttcacttgtgaccaaagagtaaagaaagttctaggaacttctctcaaaagtcaagtcttactgcttcacaggcacactttatttttaactttccttctaactggcaatgacaatgcctgcctcctacagttgggatgataatgcccttatcatggtccctggtatctggtagtgtgttctcggtaaattatttttattagctatagtcagtatttattatgcacttgaagaacagattgcacttgaagcactggactaaatacttgggccattcatattactttatagtgtaaagtagaagctttgagtaaagtggcagagtgcattaataaaacataaacttgttttaatgacattttgttcattaatatatcagtgtctttaagagattgtggaaagtttacttttcttactgtttccctcttcccaaaaacctccctagggaggtttggttaatctattttctcctttaaataaaagttatcttgttgggagaaaaagtatacccttcttaggtatttccttattaccagatattttgggttttatttatttgcaattttgaacctctagagatttcatagagcaatttagggatttcaagagaaaagtccaatgaggttattagagaatttacacaggttatttttgccccttcattagaagagtataagataaccactatggggttttatattagactttactaggcatggagagccttcagattggtcagtatatccaaccaccaaaaaagctacttgctttggcccctggaatccttggcctataataaagttaaattttcgcttgtgtgtgaaaggccctacttaacggataatcggattactggtgtcttcaaagttatttacttgtcccactggatagccaatcaaggaagacaaagaattrtttgtgtacatctttgagtgcgttcatgatttttaatgtgttaatgggattttctttatcagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggtatacttcagcttctgttgaaacagcagccagtttacagtatcttcttgatttcttatatttgatacagatatttttaacatgtgaggtagatatcttttctgataagagttttaaaatatgcaaaatactggtttaaaaaaccataaccttgagttctagagataacttcactgtagttttgtatcttttcttctggtctttaaaaaaatacctttacatatgtcttccttgagatgccattttatatccttttaattaattaatcttattctcctttgccattgagaattatttaatacctcattcttgatgtctgtatagtctatcctatactttttaaaaaaaatttttccctaaatttcaacatactgtgtacttatcctatacttgtaattcatttatttaaacattctctgtggttggacttttagattttataagtgtattctttgaattattctcaactttatttaggaagtgattaaaaagtaatgtctattaagactatataaatttgacttaggagcatttgttaagcgcttgtgtacctgtagattcagaatactctcctgatcacatgtgggatgggggatgggaacattgcctattaagcttttcgaatacccctaagttttgcccctctgasatcattctgcttctttcatatgcrtttatcactgagaatcaccaaccctgactaataagtattcagaggtaggcagacacaaacttgaattctgaagtaacatagggaagtcatactagctgtcaaaaagaaatcccattgggtttttgtattgatatttcaagtctatattaattttagaagaattaaaacctttataacattagaaactcaaatgtttttgcttttttgaatatcacatgcatctcagtaatacctcaatatcttttatatgtgtgtgtattcaatgctattagaaaggggagctctattttatttatttatttatttacttttccaagatggagtcttgctctgtcacccaggctggagtgcagtggcgcaatgtcagctcactgcaacctccacctcccaggttcaagcacttcttctgcctcagcctcccgagtaactgggattagaggcacacatcaccatgcctggctaatttttgtcgccaggctggtctcaaactcttgaccttgtgatatgtctgcctcagcctcccaaaatgttgggattacaggcatgagccaccttgcctggccctctattatatttataattgtatattgttgatgttgagaaatatcaattttttaaaaaatgtatcttaaactgttgaaactacttgactctttcaggtgtttctcaggttttctagtttgctttttaaaaaatttattggtaatataatttttgacacctcataattgcatacatttatggagtggttttctggttttcgggtcattattaaattacacttttgttccttccttaccattattattcctgctttatgtcttaatgcattagctgtaactctgagatatttggtaataacagtgatttggtgcctgcttttggtggaagtaatacatctaaggtttttacattaagaataatactgatccttggttctactgtctttattacagcaagataatatccatctatttataactattatgggttttttctttttaaaattagaaatgaatatcagatactttttaagcagctgttgatttgatttttttaaattaaaatttaattwtacatatttaggtacacagtgatgtcttgatacacataatgtatagtgatcagatcagggtaattagctcagagatgatttttttaaatgtaggctattgatatattaaaagttttcctaatattgaaccatcttcacttccttaaaacttacttgggaaggtagatagattatttaactttcaattgaattctgttattcctgtttattatgttcataattccaagcagatttaataggaatatattctaatttttaaaagtggcacctttcatagtagatggaaataacggagaccgttataatcctagtctgaagtgccatgcctattattccaggcctgctgctgttcccttatattaaaactaaaagagacagggaggaaatgacatcaagggacagactgtaactaatttttccaaactagaaaaagaaacatctaaaataggggaaactctaatcttagacctagtgtttttatttgtttgtttttaaaaaaagtcaagaatgatacaggcaggtgacttctgagaggtagcatgaggatgaacaaactcacatggtaccagagtcaatctgcatgatagttatatagactaaatgcttgggcaaatataccttcaaatgccctgaaattagagaggatttcagtgtttatcaagactccaatatttatcaaaactcttacacctgttttttaaaatgctgttaggtatgaayttttaatactttttattgaatatccatcccaggcattatatgaacttctcaagtgtaaccacaatataaaggaagcaatcgaaagatactgctgcaatggaaaggcctctcaaggtaagaaacacttgggtttaagagagggacatgacagggatggtcatttggggatcagaataagcaaagtatcctaagggrcagagcaatcctgtaacacttttgtaagatctggttcagctccatagcaaataatttttccttttcttgcactctatttttagatgtatcagagactgttcaaacacaaattagtcacccccctgccacctctactttctggaagaaatagttacagaacaaagcagaccccagacatgacaatatgtccaaagtaattaaaaagaatggttttatgatttcattgaaaaaaagattttttctttttttttttcagccagacaggaaatgaaaaggagattaaagattaaaaaagaaacatgtataatatattccgctgaatttatttcaagaattgtatttttagtaatcatgtaataacattttatagttcttatgttttgtgtgtgtcaaggaaaatggttaacttctatttcagtattttttgtcattatataaatggattgcatgcaccatagctttcattaaatatgtgtagaatgaaaataatacttagtaatattactagatgacttgggaaggtattaaaactaaaaataatacatttaaacttatgaattgagatagtctattaaaatgtctcccttagaaaagctgcttctttgaaaaaaaattattttaggctctcaaaactctcaaagtactggtttcttccttagttcaaactatttttcacctttattacggactgctattaatggctttggggacctggtctcccatgtcaaatgagacacttcagagatacagatgagtaataactaatcttaagtctaggctgtgactctttgaagaccttccaggtctctgccccaagtagatacggaattcaccaacattaacatctgctgggaaattgaatgggatttattattttgagagcatggactgtttcttatttccttwatatttccagagtatagcactccacacaccaatttcaaataaatatgtgttgattatgctttacttatggtctctaattaaagaayttgtggttttgttttttgtcttttttgagacagggtctcactctgtctcccaggctggagggcagtggcatgatcacagcttagtatagccttgatctcgtgggctcaggtgatcctcccacctcagcttcccaagtagccggaactataggtgcccgccaccacgcctggctagtttgtttttttgtaaagacagggtttttccatgttgcccatgctgatttcaaactcctgggctcaagtgatcctcctgcgctggcctcccaaagtgctgggattacaggcatgagccaccgcacctggctagaacttgtggttttgaagtaagaccaaaacagagcttctttcccccaataaaggaggtagagtttttttttctaattgaaaaatacgctcattgtttaaaaaaattttttttaatcagaaaaacaggcatgttatagaaaacttaaattctcatcccataatgtagtggaaaaaaagcagtgtttatatttttgtattctagacttgaactgtagtatgcatgcttttggtaattctaactgaaatctcctgcatacagagagagagagagagagagtgtgtgtgtgtgtgtgtgtgtgtgagagagagagagtgtgtgtgtgtgtgagagagagagtttgtgaccttttacagggaaaacatactgaaaatcagtgattcacataagaaaatttgggggcccatgaattttattttaaaatttttcttagaaggaatgactgcatggacggaagaagaatgccgaagctttgaacatgcactcatgctttttggaaaagattttcatcttatacagaagaataaggtaaattaggcagattagtacagataaattactagttacagtgaatgtaagcaactaatttataagtcacttaagtaggaaaaaagaacaacttactaatgttcccttgccatagcatttcagatatcattctaacatgactaatttgctcagagatgccacagcctgcttatggaatggctgatagtatattcacatatcttttcacataaacagttgacacagaaagtggactcactgtattttttaggaagtctnactctcatttctccttgactttcctttcttatcaagccattcagaggtttgtggcctcaaaataatttctcttcagcagtgagagtagctgttgctgaaggaagaaacattgttactaaaacaactagaaacatattctaacaccaccaaatgctggtaaggatgggaagcaacaggaactcttattcattgcctgtaggaatgcaaagtggtanggccacgttggaagatagcttggaagtttcttataataccaaccatactcttaccgtataattaaataatcctgttccttggcatttacccaaatgcgttgaaaacttatgtccacacaaaagtgtttatagcagctttcatcataattgctaaaacttggaaggaacctgtatgtcctttgaggtgaaaggataaacaaagtgtggcacctccagaactggactattattcagcactaaaaaaattgagctaacaagccgcaaggagacatgtgaaatcctaaatgcatattattaagtgaaggaagccaatctgaaaagactctatactgtagctttccaaatatatgatattctgaaaaaagcaaaactatggaaacaataaaaagatcactggtgccagggccgaggcaggagggagaagtgaataggcagagcacagaccattttcagggcaatgaaactaccctgtatgatgatactgtaatgatagagacatgtaattacacatttgtcaaaacccatagaatgtacatcatcaagagtaaaccctaatgtaaaccatggtctttgcgtgttgatgtgtcagtgtaggtacattgatttttttaacagatanactactccaatgtaggatgttgaaagtagaacttcaggatatataggaactctctactttctgctcagttctgctgtgaacctcaaactactcttaaaaactaaagtctattcaaaatacatatgtatgttcattagaatagtttggaataattctcattaaaatatgctctgtttatttcctcttttcatcctaaaggaaggcagggttctgaagcattttggtgggtagctcagtattttatgcttttataaaagctaatggactttagtttttagagcagtttcaggtttacagcaaagttaaccagaaagtattgagttgccttatgtcccttccactcctatagttattattatatcttttattattaatagtgtgrtacatttgttaaaattaatgagccaatattgatacattattattaattaaagtccatagtttacattaaggttcgctcttcatgttgtacattccattgattttggcaaatatataatgatayatatccaccagtacagtatcatacagagtagcttcactgacctgaaaatctcatgttttattcttccctctgtcccttccccctcctccctaacaacttctagcagccattgatctttttattgtctgtactgttgccatttcagaatgtcatatagttggaattatacagtatgcagccttttcagattggcttctttgacttagcaatatgcatttaagttttcaccatggggttttttgtttgtttgtgtttgttttgaggcttgatagctcattcttttttttatcactgaatagtattccattatatggatgtaccagtgtatttattcacttacctgttagaggataccttggttgcttccaagttttggcaattatcattaaagctataaatattcatgtgcaggtttttatgtggatgtaggttttcaattcatttgtccaaatacgaaggagtaaggattacaggatagaatggtgaaaatgtgtttattttgcatgaaactgccaaactgtcttccatttagtatttccagcagtaatgaatgagttctattgctctacatcttcaccagcatttcgtggtgtcagtgttttggatttcaccactgtaatagtttttaatgccatctctttwttgttttaatttgtaattccctcatgaggatgatgttgaccatcttttcttatgcttatttgccatttgtgtgtttttttttcaggtgttcattcagattttttgcccagattttaattgggtggtttgtattcttgttgagtttaaggagttatttgtatattttggattctagtcctttattagatacatgttttgcaaatattttcttccattttgaggcttgtctttttattcycttgccagtgtgtttgcagagtaaaagtttttaattttaattatgtccaacttagaatttcatctgattgttcacacttttagcattttatttaaaaaaatcattgccaaacctaaggtcacctagattttctactgttgtcttctaagagctttatagttttgcatttacatttaggtctrtaatccattttgagttaatttttgaaaggagtaaggtctatgtctagattcatttctctttttttttatgtggatgtccagttgtactagcatcatttgtggaaaagacattcttcctccatggaattgcctttgttctttggttaaagatcagttgactgtacccgtggggtgtatttctgggctctctcttctgttcctttaatctatttgtctttccccacccccccaataccatactgtcttgattactatagctttatagtaaatcttgaagttggggactgtcagtactttgattttatcttttcgtaatactatgttggctattctgggtattttgcctttccatataaaattagtttgttgatacccacaaaataacttgctgggattttgattgggtttgtgctaaatcggtagatcaagctaggaagaactgacgtcttaacaatgaagtgtcttcttatccatgaacatagaatatttcttcgttaagttcttctttgatttctttaatcagagtttggtagtttttctcatacagattttgcatatattttgttatatttatacccaagtattttaattttggggtgctaatgtaaanggtcttgtgttttaaatttcaaatttcaatcgtcattgctgttatataggaaagcagttgacttttgtgtattaaccttgtctcctgaaactttgctgtaagtgcttattagttacaggcgattttttgttgattctttggagttttctacgtagacagtcatgtcacctgtaaacagagacagttttatttcttccttcccaatctgtatactttttatttctttttcttgtcttactgcattagctagaccttccagtattgatgttgaaaatttcacactttctgtatgtttgaaaatctaatgtttctcaaagatgagataaagygtataatttaagacatttttaaagaagtctggattgtccttttaagtaaaaaaaaccatcagttttgtaatgacttatgaaatttactctatccattcattccgtaaacagttatgtccttccacttcacttaccagacattgttttaggcactagagatacaacagtgaataagacagaaaaggtctgtagccccacgaagcctgcattctctgcgaagacttatagttaatgatgtttattgaaaggtatactgtatttcttggtttaaaaagcttattcccatattagtaatcttatatcacaacttactcaggagtcaggttagagatactgaaacttctttatcgggtactgattaagcaagggagaaagcatttattggataaggatgaagaattttgttcatacatctgaattcatatctgtggctgtatgtggttagaggaaccctggtttgggtgtggagccaaggtggtgaggctcaaattttattgttgttgtttccaaaatctgttggatctaaaaaccaaacatactggagggagaaagccctgcctttagctagcaagtcatcttaaattccagatgctgtagaccgttggtccatttgccangggttcttaatctcttttggaaagtggaactcaaatctgatgaggctgcattccttctctccagaaaaatatacctaaatataattttgtgaattaatagatctcaatgaaatccatttatggacccctcaggggttagttaatccaaagttaagaaccctcactgtagtcaaaatcacagagctcagtaaagaaaagtaaagaatgctagtgtttaagattttcagtgaaggtgtaagataatttctggatacacacttgttttataaactaatacattctgatttttttaaaaaaaaaaccttgggctttcgaaaatggcctcattattaaatgtaaaggcattccactaatcaaagtgttcagaactttataatttattaaaagtgttcagaactatataatgggaaaataagacccatggattgaagttgtagtgttgtggaaaagaaaagttgcttaaaaaaatggttgagtttgttggttttttaaaaattcaactttttcattaggtgagaactaggacagttgctgagtgtgtagcattctactatatgtggaagaaatctgaacgttatgattactttgctcaacagacaagatttgggaaaaaaagatataaccatcaccctggagttacgtaagtactgtggccttgccttcaaagacttacttttaactgtratatatagtcataaaattactggggtgtgtttttcagggactatatggatcgtttagtagatgaaacagaagctttgggtgggacggtaaatgcttcagccttaacttctaaccggcctgagcctattcctgatcaacagctaaacattctcaactccttcactgccagtgacttgacaggtaaaatgaagacctttctgcatttagtacagtttgttgcaaaattgtgtcctctgtttgatgtcataggaccacttacttaaacaattttccattcctttttagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccarcgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctstttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatnttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctttttttcttggtttgtgtgaatatttgccaaaaatacagatattttatttaatgaatcttaagctacagcaaatagatagatattataccactgttaaattggttttagatgcagtaaataagatatatgatagatagtgaagttggtagattaaatattttccttaaatcctctataatttccatctataataaaagtccccctgtaatcccaacactttgagaggccgaggcgggcagatcatgaggtcaggagttcaagaccagcctgaccaacatggtgaaaccccgtctctactaaaaatacaaaaatcagccgagcgaggtggcgcatgcctgtaaccccagctactcaggaggctgaggcaggaaaattgcttgaaccctgggggtggtggttgcagtgagctgagatcctgccattgcactccagcctggacaacagactgagactccatctcaaaaaaaaaaaaaaaaaagaagtcccaaagtaaggattatacttttagtttaattcaggaaacatttattatgtttcaaacgctgttctaggtaactgtcttttatgaagacagacagatctgaaatttggtcaaatattattattatttgacagactacatttatggtcaactagtcttccttatccatacgattcatagtttgaccgtagtcatatctatctttcctaaacatctttttaagctaaagctcctatcttgccattatttcacaagtttgtccccatatttcatttcctctgaccagagctttatgtagttccatttttaagatgcagtgatcagcttgcccataatatccaaagtttgtacaaggccaagaaggggataaaaggaaagcaaaaatcttgactcctctgctttggttacttgactaaaaccacatcccttccttgtcagacacgaaaggaccttagcacatagggctctgtggtggacacatgcacagaagtgccttcagagcagggacaagcacacatattccgaatacagcaagaatgcaacaatgtgccatgtgagagctcagagtattttcaggctttaggagacggaaaagcctgtggaagcaggataatctagtacatctgttactagaagtcattttggccataatttccatctatggtacgctttttgagcttgctggtggtaagtgctaaagagaatgaggaatatgtcagggttgggagcagtgagggattgtaaatttcagtggggtgatgaggcaacgctcctcactgaggtgacaggaagggagagaacaagctatgtggctgtctgggggaagatgtttacaggcagagagaactaagtgcaaaagtccttggttgggaatgtgcctggcaggtttggggagtggccaggaggcaggtgtgggttgggatggagtgagcaaggggagaaaggagaggagctcttgaggtcatgagcaggttatgcatgtgaaggacttcagcatttactccatgatagggagagggttttgagcagacgtatgtcaatacctgactttcatttaaaagaatcacacttggtgatatgttctgtaagggggacaggagtggaaacaaggaaggcaattgagaggctactgaaattgcaataaactaggtgagtaaagctggtggtaaggaagtgaaggtaatcagaatctggtcatataggttccatgaatttttgagggatccagtaaagaacaccctccttcctatccaagtttggaactgagagagctggagtcaggtcgatggaggtcaaagtaactattgctaataaaacgggaaggtagcttcagggctgcagccaggttggcctgccaatatattacacctctggactcactctgtcactggctgggctggctacaggctattctctgcacaaggcagagaactgccaggacacattctttctgctggcagccagagtccacagggaaggaactagaagggtatataggacatgggtgcctagttattctccaaacataatcagggagtcactctccctccagtgggtggagagagaggctaggaacattaaccagtggaagccctccacatgaagacatgagacacagggaataagtgttcctcccaccaacactatcttgcactttttttccaccttttctttggtgtgaaaatgttcaaagagtaaagaaaatagtaataatgacctcacattttcccctcagccagctagagcaatctttacattatacatagacacaccaatttactcatggcaacacaataggtattttttactcaattctgtaaaaataaagtttttacagaagtttgtacacatcagcagtactacaagaactgctgatgcctggctacaattttataaaccaccacagagcttacaaaataaacaaaagaaaaattgaaattataagttcaaagagtaggttttaatttaataagctattgtgtatttaggtgaaaaccaattaaacttggaattgcattacaaatttgaaattgtaatgaagcaagtagcttttatcatgaaattggaacataaatataatatcaacaaaaacataagaaattcctattccaattaagtctcaaaatatttgttttacaggtagaactcagagaagtgattaacaaaaaacacttagaattaatagctgagtagaaaacctaataatttctgattcacagagttagctgacaattgtgtagtagtttgaaaaaagctcttctccttgattgatgtccctaagtgcgacaagaacaacacatcgaagtgggctgaaaacaaaaagatatacaaaaggtagagcattaacaaatataaactcatatttttaatataaccaagatggcttttatagaggtaactttactcaggttccttccattttagtttatgcatttgatttccatgaggaaatagttcttattcctgatgcaggtattctaaagagtatatctatatcatttaaaaaatcacaaatcaatgtttatacaactgactacttcttctgaaaacattgtttctaagtttaggcccccaaaactagtatcacaaaaaggattttaaaatgacattatagtttttcttgcattcatttgtatcttatatcctgaaaaatgaaaacattacttaaaattagttggagttttaaaaaaatgcttttttctggacatcataaaatattgtttgttttttttgagatggaatctcactctgtcacccaggctggtgtgcagtggtgtgaccttggctcactgcaacctctgcctcccgggttcaagcgattctcctgcctcagcctcctgagtagctgggattacaggtgcgtgccaccacgcctgactaatttttgtatttttagtagagatgaggtttcaccatgttggtcaggctgttctcaaactcctgaccttgtgatccgcccacctcggcctcccaaagtgctgggattacaggcatgagccaccgcacccagcctagatattgttacatatatacattcaaagttctaataacatcatgccccggagtatatggctaagaaaagctaatagttaaacacacaaacatacacatgcagagaagcaaaagttatcaagtttttggtttttgtttttttcctgttttgggacaggatctggctctgtcacccaggctgcagtgcagtggtgccatctcagctcaatgcaacatacacctcccaagtcaaggatcctcccacctcagcttcccaagtagctgggactacaggtacacaccaccacacccagctaatttttgtattttttgtagagaaggggttttgtcatgttgtctgggctggtttcgaattcctgtgctcaagcaatccacccaccttggcctcccaaagtgctgagattacaggcttgaggtaccgtgtctggcctcaagttttaagtataaataatagttcatgttttaaatgtcattcatcttagaaggacaatttaataggtcctatataaaataaagtttgctagcaactcaacaaaataatacaaagattgtatcttcctacagcactgttaagaaagaactcttagctctccagaattacctatattttaaaattgttatttgaatattctcagtagactttccactgaatgaacaggaaataaatgctatgttaaaatatgtgtcttctgaatacagtccttttttatttagtttcattattaagaacctaatagtgaaattggcaaaggaatcatagtgtaatttggcctctttcttcaattggatgctttcttataaggtagagaacatgatattataaatgattaaagtaaagatatatttgaagattttgtaggtaggaaaaacaacagaattatttgaaaaaactttaaggtggatacttatgaagtattgccatagaataaaaatgggtaaaaataaacagaatgagctagtttaaaggaaaattttaaatttcaaataagcctacattaacacgttaaggtgtgaatataaaaatctgagttataatttttcactaaaaaaaaaattttaccccaaattctacatagctttttcttctatatttttttaagtacagcataagcagaagatatgaaatgctcttttagcaaacgaacctttgtttgtcatagctgtaggcaatgtttggaagatactgcttcagttctatagggaaaactgcaggcacatcaaattcctgataacagacattagctgctctgtctaggaacaagcacatcatttttagaaaaagagccattatacaaggtcatggaaaacagaattgaattatgacactcaatgtctgtttttctaaattatcaaaacatgatcaaaataattactactatgttccaggtactgtcagagtttatttacgtatatatatttgcagatatatatggtaaatcataaatatataaaataaaatattcaaaaagacatatataaaacatgttttattactttttgcataaacaacatatataataacatatgtttagataatatctaccaacatacataataaacatatatgtatgttttattgtttactttttatatatcaggaaatagaggctcagaaatgttaaaggttaaatactaataaaagagtcaggcttggacttcgtttctcactaacgccaaagcccatgttaaatgtattcaaacaatcaaacttttacctatgggaaagtcaactcctaaagaagatatagatagggactcacaaacttagcaacagaaagcagatactagtctagccattaatctataaggctatattgaagcactgacataataatttctatttttaaaatgctaaaataataatgatcaaaggggagttatcaattgcctatattcactgcaaaatcagaagaaaaatagtaaattaaacaattctaaataatgtatatcaagatttcccctaattctctctaatatcatcccccaaaagtgagagttgcttaaggacttgactagcttattatatgttatactcaactgcccttggcactcagtcatatgacaaaggagtagaattagccattgatatatctcatctcacagccccatgatgccttcttaccattggaacaattgttgacatactgtcccacagccagagggttatgaatttctgacgttagccatgtactatcactcatttttaaagggccgagtcgatccctcccattgcaagatctgaaacaagtgaaagcattagctaatggatctgtatcttaaaatagaatcctaaaatacaaaaccctagaattacaccagtgcattttttcttaaaaaaaaaaaaaaaagactttagtataatcagtagggcaac

SEQ ID NO: 10893 - DNA, 18954 bp, Homo sapiens
  misc_feature (1)...(18954): n = A,T,C or G, or insertion/deletion polymorphism (see Tables 1-2)
agaaggggcttgggaaagccactgccttccaaagtggagcctgagggaagtagagccttggagaattgatccatatccaagaatacatcacatgagggcctagagctgagtggatcctaactcaacaccaagagattgaaatataagccagaatgccaatttactaatttataacaagaaaaatagccatcatgggaacaggagttgaatcctctggccagtcccttttctctttataggaaatctaaattggaagtcaaattgattccaaattaagtttttttttttttgagacggagtcttgatctccgctcattgcaagctccgcctcccaggttcacgccattctcctgcctcagcctcccgagtagctgggactacaggcgcccgccaccacgcccggctaatttctttttttttttttttttttagtagagacggggtttcaccgtgttagccaggatggtctcgatctcctgaccttgtgatctgcccgcctccgcctctcgaagtgctgggattacaggcatgagccaccgcacccggctgcttccaaattaatttttgattatgatcaaaagattccaaagaatcgcttaagcataggagttcaagaggctgcagtgggccaagatcacaccactgcactccagcctggggacagagcaataccctgtctctaaaaaaacaagaagattcctacagagcatgaagtcaagcaagcataacaaattggagaagctcaataacagcaaagtggggccagccatccatatacattcatttgctatgaggatgtctcagccatagggaccagacacacgagtcttccaacagggtactctgttctctgaacagtcctggataaactgcctctctgattcccattttcaataaaaataataatagctaacagtcattgaacaccaagtactatgttaagcatttataagaattatttcagtttactttcatgttagagccatataaaggatactattggctgggcacagtggctcatgtctgtaatcccagcacttcgggaggccgaggcgggcagatcacttgaggtcaggaattggagaccagcctggccaacatggtgaaaccccgtctctactaaaaatacaaaaattagccaggtgtggtggtgggcgcctgtaatcccagctactcggaaggctgaggcaggagaatcgcttgaacccaggaggtggagtttgcagtgagctgagattgcaccactgcactccagcctggacaacagaacgagattccatgtaaaaaaaaaaaaaaaaaagacactattattactattcccattttctacatgggaaaattgaggaaagtggtaagaaactttctcaaggtcacatagtcagtggaagagccagaatttggacccaggcctctatcgctccagagccagagctcttaaaccactgtgttcaactgcctcccagttttcaagaggcccactcaccttcagtcgtgacattccattgttagctatatccatatgaccattaggctataattcacaatgtagtcattttaccagttttaagagttccagatgcctccctactcccatctgtgtggtgtcacaaagcacccttactttaccacttccttgctgcatgacagtagtggacactgtcagtgttctgaccagatgccctgggagtctttttaccgatttttatttttatatccctgggttttggtgtgtgtttgcttctaatggtgtacatctgtgactcttcaggctgaaactaccttcagggaaactttgcttcttccctttctctgttccctctagctcttaccaattctcctgggagcacattcttgacaagtaacttggacatgaatcctcatctcaggatttgcttctggggaactcaatctaagacaatgagtgcaggggttgccaaatgcagcttgccacctattttgttagataaagttatattgaaacatggctattctcattcactttttttttttttttttttttttttgagatggagtttcaccctgtcacccaggctggagtgcagtggtgaaatcttggctcactgcaacctccgcctccctggttcaagcaattaattctcttgcctcagcctctggagtagctgggattacaggtgcctgccaccacacctggctgatttttatgtttttagtagagacggggtttcaccatgctggccaggctgctctcgaactcctgacctcaggtgacccgcccgcctcggcctcccaaagtggtgggattacaggcgtgagccaccctgcccggccatcattcacttttgtattgtctgtagctgcttttccactacaatagcggaaccaagtcattgtaaaagagactgtgtagcctgcaaagcctaaaaaatttacttgtttggccattttcaaacaaagtttacagacccctaacctggagtaagtctcttagtacttttgacttgtcttcaggggttgtcataaggattaagtaagttagaaagggcccagcacattctctggctcttatcaggcactcaacttaagtctgttgaggtggaatgtaacgtagagtatttcccaagttgtgggtcctgttcttacatcttggggattctagaaattccccttttgatttttagacttcttgcccctcctatccagaaaaggatagttcccagttaagcagattttttttaaagcatcagtttggtgaaaaaccagtcaagcagattttaaggcagtgttactctgccaatcaccagcataagaatctgctgtgaagcttgttgaacatacagattcctgagacccacattagaccatccctggaattagaatctcacagtgcagtctagttccccaggtaattttgatacacactaaagcttgagaaaacagatctaaggtaaatctataaataagtgcaatggtttaaaatcacagattcaagaaagtgtttacttgtggggagaaggggttttaggaggaccacacagagaaccttgaatatacttttcattttgccaggcattgttctaggtatccttcatgctcatttaatcaacttaaagcccaattaataaatatgcttatgtttttaaggttgagaaaatggaagcacagaaattcaagtattttgtccaggattacacagccagtataagccgagccaagattccaacataattcactgcctctggagtccaaggtggttttttgtttgtttgttttttgttttgctttgttttgagacagggtctcattctgtcgcctaggctggagcccattggagccatcacagctcactgcagcctggatctcctggctcaaacgatcctcctgcctcagcctcttgagtaactcggactatgggcacaggccaccatgcccagctaagttttaattttttttttttttgagacagggtcttactctgtcacccaggctggagtggagtggtgcaatctcagctcactgcaacctccacctcctgggctcaagtgattctcctgcctcagcctcccaagtacctgggattacaggcacgtgccaccacacctggctgatttttgtatttttagtagagacggggtttcaccatgttggccaggcttgtcttgaactcctgacctcaaatgatccacccgccttggtctcccaaagtgttgtgattacaagcataagccactgctctggcctaaattttttgtagagatgggatctcactatgttgcccaggctggtcttgagctcctgcgatcaagtgatccttccaccttggcctcccaaagtgctgggattatgagcatgaatcatgaggccagcccagagtccaagttcttttctttttttttttttttttttgagacagagttttgctcttcttgcacaggctggagtgcaatggcatgatcttggctcaccacaacctccgcctccctggttcaagcgattttcctgcctcagcctcccaagtagttgggattataggcatgcgccaccacacccgactaattttttgtatttttagtagagatggggtttctccatgttggtcaggctgatctcgaactcccgacctcaggtgatccgcccgccttggcctcccaaagtgctgggattaatggcgtgagccaccgcgcccagccaagttattaaccactaaattatacttttttttctatccctagtaatgttctatttctcaaactgagtggaatagacacacacattagatttgttatttataccttacatatatattacatataccttttttatttattaaagacttcacttaaacatacaaaggcttttacaaagagcaaagtaaaaacgacaattggaagaaaatctgttgctcattcaaactttactagcgcctccaaggctgacactaggagagaacctcaagaggtcagccgaacaccccagagccctacctttcctccagcacgtctccctttggggaatcgtatcaccctgggcggcaatctcccctccacccctagagggtgctgttctcactctctaaggcataggaccaagtttcagacaggactctctctaggtgactctggctcccagtgcccaggggcaaaaagaaaagcgctgggcattattctcgaggtgcctgcgcgtgccgcctccgatgtgaactcgcagtaccatttctagaactgaatctaaagctcagaacgggttcatgacttgtcctaagttttacaagtcaattagcgctaggacttgatctcggtcctctgagcaatccggtccccaaggctgcctgcctcccgagggtccggacagggtcttgggtacccccaacgctcaaactctgagggactgtctttctccagagggccccgggaccaacaatctcttactcctgttagccttgactaaatacagccgggactctgaaggagctggatctcgcgtcccaacgcaggcgtcctccaagagggatagacaggcgggaggaaagcggaccaggccaagcccatgcggcgccggtcctgccagctctacctggcggggccgcgccgggattacccacctagcacaaggatacggtcctcgggccgcagctccggctctaggagggcacggaaggaggagaagtccccgaaccaatcgtagggggcagaatcggctgcgccttggtagcgctgatcccagtactcgacttcgcggtacccgcagttccgctccggtaactccggaggcgccctacctgcccctggagaggccatgctctcaaccgccgggcagccagagccgccggcccttcagccaatacggaaggcaggatgcagaaggcggggcgctggtgtctccgcccaccacctgcagttgctcaacacaaacacgtggaacttccgtcctttactaagcgctcttcgaagaatcctccggctgggaaaactatcgtccagaccctgaatcctccggctgtactgccaagtcatttcctagggccgcactcaaggtgtcagactcacgtgggctcatcactgcgtcctctcatattttcaatatgaatgacttttatcaggaaatctgaaaattagtgaaaggttcatttttctcagcatccggaaggctcgaagggcaggcaggaggggcgcgaacaggggctttgccctcctggagagacagcatgaacacagatgttcccagcgcaggcgaaggagaatgctggcttcagcggttgtgggggaggtaggcaggaatgttgcttttctggacattcgttctaaattagcgcctgtgtacccagggctgggtataaactgaggagtaagacattgtccctgctcctatggagcgtggagtgcatcagaggagacaaatgcagaaaaattacattttagtggagtaaatgaagactggctactcggatcggcgcttagcctggtgggacgccaggcacgggaagcggaacctaagtgtcgaaggttcgggtttccgggggtggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatgtgagtgcgccgagggggaggggaggggagggagggagacctgaacccgcgacccaaactggatctcagacctggaactccaaaccagactctgtatccactcactcgtcaattgcgaacccatccatatcccttacctgagcgccaagcctgctctacagaaaaccggatcttaatctgcccgcatggcagaggtggataccctagagattggccttctgcactgaacttacagcctgcaaaccagcttagaagtcagatttgagccaaaattgttgtactgctgctgctgctgcttttctctgtggctttggacacctcaggtctcctcctggatctcagctttttccatgtgttcagttctgtgatctttgaacgtcccttctcaatgatggcatcttgtgaccacttgagtccattaggcattattggctactcctttccaggctgaaactatactctaggcttaaggcacttggctttcttgctaaagactcttaattcaacaaatatttatttagtgcttattatatgcctagcattatgctggttaccagagagaggtacagtggtgaataagagatgcatttctgccgggcgcggtggctcacgcctgtaatcccagcactttgggaggccgaggcgggcggatcacgaggtcaggagatcgaggccatcctggctaacacggtgaaaccccgtctctactgaaaaaaaaaaaaaaaaaagaatttagccgggcatggtggcgggcgcctgtagtcccagctactcgggaggctgaggcaggagaatggcgtgaacccgggaggcagagctttcagtgagccgagatcacgccactgcactccagcctgggcgacagagcaagactccgtctcaaaaaaaaaaaaagaaaaaggatgcatttctaactcgggcctggacagtaagttagcaggcaattataatgcatcataatcatggtagtagtaacacaggataccataaagggcataggaagtcacttaaaccaggttggaggagtcagcaaaggcttcatagagccacccttggaaggtaggaattagctatttaaggaaagaagaaaaaggtgaggggaaggagtgctgtggacagaggatcctctattaaaaatctccagctaggctgggcgcagcggcacacgcctgtaatcccagcactttggtaggcctaggcgggtggatctcctgaggtcaggaatttgagaccagcctggccaacatgatgaaatcctgtctctactaaaaatacaaaaattagctgggcgtggtggcatatgcctgtaatcccagctactcgggaggttgagacaggagaattgcttgaacccgggaggtggaggttgcagtgagccgagattgcgccactgtactccagcctgggtgacagagcaagctccgtgtcaaaaaaaaaaaaaattcagttagactgggcacggtggctcatgcctgtaatcccagcactttgggaggctgaggtgggcggatcacttgggggcaggagttaaagaccagcctggctgggcacggtggcttatgcctgtaattctagcactttgggagcccgaggcgggcagatcacctgaggtcaggagttcaacaccagcctggccaatatgttgacaccctgtctctactaaaatagaaaaattagctgggcatgatggcaagtgcctgtaatcccagctacttgggaggctgagatgggaaaatggctcgaaccggggagatggtggttgcagtgagctgagatcgcaccactgcactccagcctgggtggctgagcgagaccctgtctcaaaagaaaaacaaacaaacaaaccagcctggccaacacggtgaaaccccatctctactaaaaatacaaaacttaaaaaattagccaagcatggtggcacacacctgtagtcccagctactcgggagactgaggcaggagaatcacttgaacccgggaggcggaggttgcagtgagctgagatcgtaccactgcactccagtctgggtgacagagtgagactctgtcaaaaaaaaaaaaaaaagaagacagcctggttcctttgaggaactgaaatgatttttttagagctagagtgtagaaatcaagtgaagggagtagtaagagatgggaatgcagaaactgaggccagatcatgaaggaatttgaaagctttgttaagaagatagcatgataattaagaacttgggaccctgcaagcttcaatcccaactccaccatcctagctcaattatcttaagccagtcacttaacctaattaattcttaggctccccttcaaaaaatgggaataatacagagttttctttatcttaagggtcttggggaatcattgagaggttttaagcagaggcctgttatgatttgtattttaggaggagctctttggtgtacgaggtggaaaatatattgtagcagggtgaaagtagaagtcaggagcctaattagcaggctattgtatactcattggggctagagattactttaggctcaaatttgagtatgtagtagcagagaaggatgagatagagatatttacggtgaggaacaggcagaacttgttgacgaagggttgcaaatgagagaggagggagtatcaaagatgttactcaggttcgtgacctggtagctaagaggtcggtggtgccatttgcggaacccaggaaaaggagtagattggaatgggaagaaagatcacaaattcacttatagaaatgttgagtttgagatgcctgggctcacccagagaatgtcagataaagagttagattaagaggtagtaaagccctgggaattggctgaaagtctgtgttttgatggtctggaggcatggggagggtggcagacaagttctagactcagaagtaaccagatcatcttgtcttcttccagacacagagattgactggaaggcctacatggccgaggtagaaggcgtcatcaatggtacctatgactatacccaactgcagggtgacaccggaccacttgtgtgagtggggacaggaagttcagggaggatgtgaggggctggttaggtactagtctgtgtgacctgacccaggctcacattttctctcatcttccaggtacccagctggtttcgtgtacrtctttatggggttgtactatgccaccagccgaggcactgacatccgcatggcccagaacatctttgctgtgctctacctggctaccttgctgcttgtcttcttgatctatcaccagacctgcaaggtgagtccatgctaccagggctagagggccccagcctgggagggctgggtggtggggatggctcaggcttgctgagctgaccttgtaccttactgtgttttccctttaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggytgctgctttttcaggtcaacacctcttcctttctggtcccctctcgttttctgcatttccatctcttcccaatttcctgcagcagagggagtaaaggagtagccaagacagcatgggtcactcagggctccacaaagcgagtccaggatctatagaaagtttctgccctgccatcccccaacatacacacatgccctctttccatcctgtcttcctcccagacagcattccttgttggaattagtccttcacattctaaatactcagtatatgctcattcgcatctagtaggcatagagactatgtatctgcctcctgcctactccaggctcttccctccaacagttgtgagtgtaggtcccatcttggagtttgttggcgtggcggcgggggggaggttgctgtgrtgatggtggggggtatgtctttgggtgttgtgtgcatggccctggagctgatctccacccttcctctcccctgctcaccccagcctggcagtctctgtgaagatgaatgtgctgctcttcgcccctgggttactgtttcttctcctcacacagtttggcttccgtggggccctccccaagctgggaatctgtgctggccttcaggtacccccatctcacccttcctctttctaatcaaggagaagccacttgtcttgattgaggggctctatccctgagactccctcaaagccaagagacagggttttggagttgattctgagctagggagccactatcgctaggctgtagtttccatagctgtaaaatagggtattaaatttgatggtctctgagagcctttttgctttttttaattttaagttttgagatgggctcttgctgggttgcccaggctggtctcaaactcctgggctcaagcaatcctcctgccttggcctcccaaagcgctaggattttgggcatgagccaccctgcctggcttctgagagccttccttgctctgcccagttatgacttggtgaatccacaccttaaagcattgttatgacctgcctcctgagcttctttggccccaggcactggcctgggccggggggtggggaacgtggttttcctgctatttctagtgggaattggggaacctctgaggcctacatccccgtcccacacccctcaatgagtagcatgaaggctggycattgggaatgagccttggcagctctgctgacatcacaccaatcctcaggtggtgctggggctgcccttcctgctggagaaccccagcggctacctgtcccgctcctttgaccttggccgccagtttctgttccactggacagtgaactggcgcttcctcccagaggygctcttcctgcatcgagccttccacctggccctgttgactgcccacctcaccctgctcctgctgtttgccctctgcaggtggcacaggtgagaaaaggcagtagtgccatgggcagagttgggggaaggagtgaagggcctaagccttaggggctgcttgggggaagtgtcagttaagctcatggggtgagtctagagtttgactcacaaaaggggctygataactgtctgaatggcttttctccaggacaggggaaagyatcttgtcgctgctgagggatccctscaaaaggaaggttccaccccagccccttacacccaaccatatcctttaaattgtgggaaggtaagtcttgccctctctaggtgctgacagagtcctggtcaggtatcccttgacagctggtgacctgggcgaggaaaggggaccccaatcatagaagtcctattctgcaccactgtgctgagcacttcacatattgaagnatatttgattcttaattctaaatacgagctactcttatgagtacttctccctggtactatcataagagatttacatatgttctaatattgaaagctcacaagagaccccgagacagggaggtacacttacatttactattctcattttacagatggaaaaattaagacttcatgaggttaagtaacttaccaaggtcacacagccagtaagttaggggttcaaacccacaagaccttatggccctaggtattactctctccatattccatatttggttgaggagcaggtccagagaggttaataaacttgcccaaaggcatgcatcaaggaatggcagagccagagggctatgtgacctaaaaactattgcccctctgttttgggatagtcccccccacacacactcctgcccttggccttgaccaccgcatacagatcgtttctaccctcttcacctccaacttcattggcatctgcttcagccgctccctccactaccagttctacgtctggtatttccacacactgccctacctcctgtgggccatgcctgcacgctggctcacacacctgctcaggtaccagctgggacaacctgggggagtgggaagggatagggagttcctgttgggggtttatgtctagggcatgaggagctgcaggtctgcaggccttgcaactggatgaaacgtggaacctgtttctcatctccaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggtnggttggactctgcccttccaaataaaccttgctaagtccaactctgtgcaacctacatggaggtgggggcagccgatgcctggtccaggctgtgagggacacgtatggagcagataaagaattcactcaagcagtcctaagaggcactttattgcataggatttggggactgtggctctctacccttccactgtgttgcagggagctcagaggatggaggggagtgtgagtggggtgggaggagagggagagagcacaggcaggcactttttgtgggggcaagagggctctagggagggagtaagaagcagtgggggacaggctggcaccagcctacactttcccagcaccaagaggccagccctgggcggcagtgacttgagtgtgttgggtggggcgccagcccaagcagcagggggcagccttcacacgttcgctgggctgtagcacagcaggtgtagctgcaggttttggtcccagtggcgcagtagcaggaagagccctcgggctgcggccttgagggcggccaggtcaaggccgtcaggcaagtgctgggcccgcagccagcaatcagccttggccgctgtcagttcccactcgtcgaaggcagcggcgcatcggtgctccagccaggcgagtgctacggcagtggcccaggtccggccccgcaggtcggtgccgcccagcccttccgccccctcggaggcctcggtgtctgagccccgcccactgtccacctggcctggcccctcagagcccgagctgggggacgggctgcaggaggccgtggcactgtcaccctggccaacaccagggcccagaagtgcccagggcaatgaggccgaggtggggctgaggctggcgcggtgcacggcaaagggcgaggcacggcagaggcgctcctgcgagatgcgcacagcggcgcagaagggcgcgtccaggcggaaggagcctggtgcctcctgcagccgcacctgaggagagaggaggtggggggagaagcgagctgaaacagcgcccggccccggcggcaccaccctccacctcccgagtcctcaccaagggcaggtagtcatggtcgctgccttcactgttgttggcctggcccgggtcagggctacagagtttgtgacggcggcccatgctgagccgacagggaggacggggaggtgggcggcgaggaccttccgtgggagtggcagggtcccccaaagcacgcttggagttgccattttggtccgagtcccaggcgcctgctggagagcctctctgaagtcctgcagtggggatcatcagtgccagggggcggtctctaagcccaagtgcccctaccctttccctacctttgggtgttacctttagagtagacaacagtgggcagaggagctgcatctagatggctgtgagaggcaggaggggttcctgggggctcagcgggctctgcaggggcacatgggacaggagtcaggtttgtccaggagagtggccagtgaggtgagagctgcacctgagaggtcaccagaagaggcccctacctgagctgcacacctgcagggccccaggcaggacctccctagtagtagcatccacagctacagggcaagtgaagcaggagggggcagagctgaccttacttgtctgaagggctcgaagccagcacctccgggcatggcctgtggaaccaaggagcagtctgtggagcccccaccacccaccctctacagagggctcatagaaaaaattgcagtgttctccccagcttctccctctatcgactttaacagagtagattgccttgctaggcccagaaccagctcagactccccaactttgacaagaagtgatcaggctgaatcttcaacccatagcagagcaagagccccctggctgcccagaaattcagcactctggacaacacccagaggaagcattagctggcacattttcctccacctgcttctgcactaataaaacttggaaatgttctctctcttcatgatccaatgtggtagccactagtcacatttgactattgagtacttcagctgtggttagtgcaactgaggaaatgaactttaagtattttcctaaatgacaaagatttgtttttacgttgtgggtgctgtgaatcatgacaggatcacgttgccctctgtgctggctgctaggaagcttgtcagttctggatctgatccttgcaagagtatataacctcacagcatgcacctttaatataacctcattctcagtttccttttatttttactttttcccattgtcccgcttaattttttatcttgtctgtgatgagcctcaaatcctttgtgatcaaagcgaggtatagagagtgatcaaacacacagacctctacctttgctgtttttagcccatgcctttgggtcctgactggacccatgagcaactcaccccggtcagctgtggtctctgcccctcctcggagggccagctgctcattgtcccggaccacagaggctgctgtcagccgatggagtgcttggtcccaagcagcttctcttacaggaggtgagggaggctgtgagccatctccaggtccccacagtgtctccagcccaacacccacctcccagcacatgggctgctccccacacaggccccggatcaccacatggcagcgtggagcctggggaggcactgctggaggggccaactccccactaggaggcacagccgtgaataagaagggtggttccatcagcatgtcccagtccataggggctggggagagcaggtttcctggggaggcaagacagcaggggcatgggcagagtggtcctctgggctttacctccccaaggcctctttggtgtcagggaaaccagctccccatccaacacttacctgagtcatccaggccttgtcccaactgttggcctggctcaggacttgggccatctagtattgcacccaaagagggtttccggggtcggccggggacttggtttgcccggcctggaggggatgagaggcttcggccagccagagccgctctgtgctgacggcccagcacctcagtactcaaggcccccacctgcatgtgagatatgggggccactggtcaaggaatgcagaacccttgaccatcatacatgggtgcacagctggcccatgccccttttctgaaaccctgggtggccgctcaccagcttgaggaggaaggccaagttccttatggcctacagtgacctctggccttggccccttcccagcatcatcccactccactccctatttcccacttgtggttgttgcttgtctctgtattttcgtttatgtcttctccctctctgcatggctaactcgtgcttattcttccagatatggctctgactttcctgactctctcaggcagaattagtcaccctgactttaagcccccttaatacatgtccttgtgctcatcactggttgttacatggtatcgttggggatttacccacctttctctctagctagacttaatagtaaactctacataatatctggtgcacagcaggtggtaaataaatatttgctggatacaaggcgaatgaatgtgggttggatctcaccttgaatggagctggtgtgggtgcaggcaggggacaggagcgggagcctgcaggttctccccaggccagactgcggcagccctgctgagaagggggctccaagggagcactaccttcgggggagccagggccctgtgagcctggggactcactgctgcctgtggagcctgggcctggctcggggctggcagagcagtgggtgagcacatactgctcccgaatgtacgaggactgaaagatgcggcgccatatggctgtgtcagaggggttgggtccaggatccgtgactgggtctgtcagagcatcagtacctgctgggaggcagtagaatgggccctagccctgacccctcccagcgcccactccaatacagccacacacatacacctgggcactcactctgctccgagtccctggcagcccatgggctggacagttctgctgagacagtgcctgttcccagtggctctgaggtgccagtgggctcagtgccagggctggcagcagacggggcctcttctggggatggaaacacggacccacccgagctctgccagccaggctcttggccctagagagaatattattgggaaaaaaattaactgcagttatgtgctacctctttccaaacatttttagatggctcacagcaagaggcaacaaagctaataaaccagaaacaaaagaccagtactaaagaaggaggaagcagacatgttcactgtaagggttaatagagctgctgggaagctgagctttaagtttggccctgagctccctggcagccaggcaaaaaaaaaagtctgttatgcagctctcatgatcaaaaaggaggaagcgtgcagagttcttctaaagagataaagcttttcattaaaaaataactaccatgtccccagctcctactgtgtcaagtgttctgccaggagtactcactttatgacccctgatgacaaccacctgtgaaaaacctcatttccatatgaggaaatgggtcagtgaggtgaagtgacttgctcaaatcaaatggctggtaagtgacagagctgggattagagattgtgcctaggttatgctcatccatcactgcgtgtcccagaaaatacgctggctggtgctttctatagggaactatgtgaagccatgagcaagccttgacggaaacctcatagcaaatgcaggtgctgttttctgtggctgtgtgctttagtgaccttgggtaaaaactgaggggtaacactttgcaggacaactcagtggaagactccatgaaggggacagggtgtggtcatcttagggggcccagtgtgatctctgtggagtcctaggggatagtagagaagcttggtagagagaggcacagagaatggaaaaagggtttggaagagatgcggggacttcagccatcccaggcccccctacctcaccctagcccccctaccacaccccagcccaagcttacccctggtgggcgggaccggaagccatccaccctgaagagtgagcagtaaccgagcagctggtccccagggtagagtgctgggatctcccggggggtcagcagtgcctccacagtgtcgggcacaaaccagtccacagagatgtcactcaaagcaggctccagtgccttccgcagagcctgtaccagctgtggggagtggccacagggaagacatgggaaggaaagaggtgtcatacggccagacagagcaggaaggctgcccttcccctgatgccatctgcccagcccctaagctgatggggcacagggccaggctggggtcaggagaaggaatgagggtaggagcaagcagggggctgagtgctcagccctcaggatttggtctgtctcctggcctgagctttgccacatggatggggcaagactgtgaggacgaggctccgttccaggactaaatgggattcagagggtggtcagagacagtgtcctgacacctttggccttcacagcaccaacagctcttcccctgattggagtggggagaaggcctggtgagggcgccaggagcccccatggcctgcctgagttctgtttcagacttgatgtgtaacttgggagaaaaacttccaggtgtagggaacagggcccaggctcaagctcaccatgggctgcagcctctgcccaggcctcaggaagtaggcctggcctctgctgagggcagataaaccctggagcagctggtggcaggtgggccccagcccaaaggagaagcatctgatgaaggaaaggaagcagctgtgatcttcaggagccccttgtgggggctcagtcttacgcatctggttctgcccatcccatacctggctgtccccctgtgccacctcatgagctccagggttcggtgggtagtggcggccatgggtgaggcagcagtgagcaggaacagctgccgagggtaggccctgtgctggggctgccccacggcccagtccagagcagccagcacgtctgggggcccactcggaacctgcagggtctcaatgctctcgcagatcagctgcacagcatcctggagcgagaaggcacaggctgggacgcactgggctgaaacctctctgtaaggcccccagatccctggaccacactcacatcactgcaaggccggctctctgggaagagtggctgcaccaacgtcccaaacacggccaggttgataagcgtctggggcgggagggacttcacagccaaaacaatggcatcctgtggagggccagggagggcggcgtgaggccggccccatgggccctgatacagagcaagggaagccagatcactgcgttatccaggctgtgattcaagtgagaggctgtggtaacctgggagaggccctgggtg

SEQ ID NO: 10894 - DNA, 21147 bp, Homo sapiens
gcttgaggaaccactggtgtgcctcgaagcacttggcgcagaggagctgctcgcactcaaagcaccagaagtcggccgactctttgcagcgggtgcacacagcctgcgcatccacaatctgccggtacaccgacaggcgccgctgcagactctcgaaaaagacgttatccagggcgggtgtgtctgcacctaggggccagggcgcctggcagatggggcactgcatgcccgacgcctccaggcatcctgagcacagcgtgtgcagacaaggcagcagcttcgggcacttggcttccgcctggcattgctggcagcgcagaaactggaactcctcctccgaagcgggggctcgctgggggaccagagaggcaggtgaggcctggagaagtcccaaaagcccccacctaccggccaaccacccttacagctggaccctggagtaggacctcatattccattccagccagtcattggatgatgcaaaaccctggcttatcagcaccccaatacccccatttattcaggccctccagctctcactgcaccatttattgagcatctacttctcatcacccacagtaataggctctgagatataagaggtgtaggatacattctgccttcaaggaactcagtttggaaggtagatacactaagtaccaacctcatataaagtgcttaatgcacagtttgggggttcattaaagaggtaagcatggaacaacaatatgacccagaaattccactcttagatatataaccaaaagatgtaaaaacaaggcccaaacagatacttgtacaacaatgtccacagcaacactattcacaatagacaaaatgtagaaacaatccaagtatccatcaacagatgaatagataaacaaaatgtggtctacacatataatggaatattactcagcgttagaaagaaatgaaattctgatacatgctacaacatagatagacctcaatgacattatgctaagtgaaataagccagtcacaaaaggtcaaatactgtatgattctgaggcaggagaatagggtctggaggcagggaacctaaggccgattccctctgacttcctagaactaaatcgaaaggaaaaccgcaactctccatgcctcagtaacaaaaggaagagaggctactctctttgcaaatcaccccatttcctgcagggcagatggaaaattgaaagtacgtctggttggttgctttctgcaaccaatggggtgaacaccaagtggccaatgggaaacctctagggggtatttggaacccagaagattctgtaactggggtccttgagccctgctctagccgctcccaccctgtggggtgtactttcattttcaataaatctctgctttcattgcttcactctttccttgctttgctgtacattttgtccaattctttgttcaaaatgccaagaacctgaacaatttgcagtcaagatcctctactggtaacaattccacttacatgaaatatctagaataagtaagttcatagggacagaaggtagattagaagttaccaagggctaggggaaggagaaaatgaggagctgttgcattactggggctcaggacacaccacttcaaagtatgactgcaggaggctcttgaaatatacttctttggcatattttaagctggttattctgagaaactgctgatacaggaatagctctgaaaagctctccttttgtaaaaaagaaaggcatttatatcttaaaagaaaatctacattagtaaaatgatctatattaaaagagggctgctccagacaacttttattatctaagaacttttaatctacatagcaagacaacctctattcaccaaacagctcctctcctcaccctcccataacttgtgttatcaccatcacccagaagctccaagctcttttccgtagctcaggatgttatacaggcttcaatcatctgacctttctttgagtctcatatattgtgggactcctgagtatacatatgtaattaaatatgggttttccgctggtaatctattttatgactatttaattcataggctatttaattcatagcccagccaaggaaactagaagggtggaggcaagccatctttccctcccctatggtttaaagagtacagagtttctggagtaatgaaaaagttctggaaatagatggtggtgatggttacacaatattgtgaatctacttaatgccactgaatggtacacttataaatggttaacataggaacttatccattaggtatattttaccacattttgtaaaatacaaaaacaggccgggcatggtggctcatgcctgtaatcccagcactttgggaggccgaggtgggtggatcacgaggtcaggagttagagaccaatctggccaacatagtgaaaccccatctctactaaaaatataaaaaatagccaggtatggtggcgtggcctgtaatcccagctactcgggaggctgaggcaggagaatggcgtgaacccggaaggaggaggttgcagtgagccgagatcgcaccattgcactccagcctgggcgacagtgtgagactccgtctcaaaaacaaacagataaacaaacaaacaaaaaacaaagcaaaacaaacaaacaacaacaacaaaaaaacaaagtgcttaatacagtacctggcacatttgaagtgctcataaatgttacctagtattgttaagtaatgttattcttagttgtaataatgtttataaaagttactgtaatacggtgtcctctgtactttcatgaaggggagtaaaagggcctgaaaggcagcagagcaagaaacccaagtagttcctttgtcgggggaggtgggaggtgggcaggaaaggtgtggcaagagaagggttcgttggggaggcttccttaagcagaaaccacatgagctgggaggccttggcaaagatacctcttcagtctgagccagtttctcacctcggatctgggaagttggttttagttttgccgtgcctgggacatgcccctggctccaggccagcgcaacaggggtactacctccatcctccctaatctgaagtcctgcatctgaggcaaagttgaggcagggctcgagggtgggcggaagggcccaggcccggaggccactgacccttctcaccttgcccaactgctcagtggagaaaccgcagcccagcgaggccgccccaactcctccgtgtcctcttttctactctatcctaccctcccttccctgccccacccgagacggtcaggaccctggtgtctggacttcccgctttgtgtcactctctagggtacttgaccaaatcctccgttagaccctctcttcccgcctctccccaccacagcaaaccaacaaagcttaaccccatcatcccctaacccaatagtacctctgtagggctggggctggggctgggctggcggccttcagagggggtctcggggggaggcatggtgggctcctggggccgggcggggtcctgctggggcctcggagatcgggcgggtgcaggctccatggaccccagcttagtttcgattctcggtttagatcttggagtgcgtgaagagaagctgaaggggaggcgtgagccagttggctgagtcccttgagctgtccgaaaggggaggtgccggctcagggcccgcctctggagaggaagtgagacagaagctgggggcggttctagggggcagagaggccgactgtgggttttaaagacacgcccagagcggggaggaggtagaggcggagagctgcagacctaccgctgacttacggtaaagcgggagaggtagggcagagctgcaggggggcagccctgctcccggctttgatccattcatccgttcacactggcactgcttcgtgccacgtcctgccgggagctgggcgtacaaagatgagccacacgcagcccctgctttctaagagccgtagatgtaatggaagagcaagcctgcaaacggagacattctggaaaggagagcccacagctgggacctgcaaaagcagtggaaattcaccagggatttagggttgtaggtggtggggtacgggggacacttgaaacagaaaagatagctcttgcaaaagcctgtttgggaactaattttggccattttcagatttaagagggaattcatgagaaatgatacccaaggagtgtgctaggacaagatcctagctgaggagattgaaccagttctgtgagtgatgggaagttgctgaaggatttggaaccagggaacaacacgatcagctgtgcatgatgggacagtcactctgacaacctaggagcaggtgccctggtctaggacagtggctgtgggatgcagaggagggacttgattcagagatcctgggaagccagtgactggaggtgagggagcaggatgatgccttgagtgacagctggaaaggctggtggatctgaggtggtgggggcaggagggagggggagagctggagagcgggtatgaagagggtgaggggagagccagctaggtcttcgccaatggaaaagcatgtcagactcccagctggtaaggggaaaggggcacagttccaggtgacctcactgggtcagcgccccggcttcaaacttaaaccatcgcaaccactgtgctggctcctgtgtacccattccgtactctgttccaacttagaaacagactagaaaggatgatgatagggcctggctcttgtaaaccttacagtctgcagggtggagagcaggggttgggcagatacgcaacttcctagggactgtaaggcctcaggagcctgcccttccctccagcctggtcagtactcccaggcctttagagaatcagtccatgaaagccaaatatggtgggcagccatctgcacaagggacctggaagtgggctatggcaggatggggcttcggaggccagaggcgattggctgaggaggcagagctggggaagctttattcatttctttgcttgctttggaagatagcctgctcccagactaccccaaagtcctgttggaagttaacacttctcaaaggaaattcacgagttgcattcaggttttctcaagccctggagaggcaagttaattccaggtacctggatcaaggggcatgctctttctggacctgcaggactgagggcctcacctctgtggtgctctggggcccctgccctcatgtagctctgtgctatccccttcttccttacactcccatgctccccgaagtctgcatgtgaaacttctttctttttgtgccaaagttcaggccttcctactccaccttgatcacggtgacctggccaggccattacttaacaaataagtattgagacctgccctatgccagtccctgcttgctgggctgtgggttcacaaagaggaataatttgcagactatgtcccagagaaacccaaagtccagatatggcatgtcctgcctccagtgtgagagaaggagtgctgagaaggctgatatagcatgtccttgatcctggagaagattggcttcctgtaaaccctgatgagatcttgctctctcgctccgactgcagtgcagtggcacgatcatagctcactgcagcctcaaactcctggactcaagagatcctcccgcctcagcctcccaagtggctgggaccacaggcaggcatcccacgccaggctaatttttaaaaattttttgtagagatgggctctcactatgttgctcaggatggtcctgaattcctggcctcaagcgatcctcctgcctgagtctcccaaattgatggattataggagtgagccaccgtgcccagcttcccctccagcttttctagggctgagtaggagaagaggggaggaggcgatgaccccagcgggctccgaggaacgccgatcacacccagtagccctgggctgcagttcggtcctcccagcgcagggggagccatgcgacggcggaagcgggccccggccggcctcctcttcctgcgcccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccggtgagtggccgcctggcacggcggacccgggggggaccggccggcaacccccaggcccgaatctctgcctccgaggagtcggccggcccggtgccgtcgcaccctacgaggggggactgagaaagggatacgatgtggagagggggctggacccggcgcctggtgctagcgccgatccgccctccctagggtcatggggctttggccccagagccagccagcsttgctcctatcttccaaaacctcacctcaccacatttgtcctcggctcttatcagccctttaggcctgggaagacgtttcaggtttctatttcgcatagaagaaaccgaggtctaggcagaggaggccaccagcaccctaaaggcacctgctgcagggaaatggaagaattttcgccctagggggcacctctagaagcccgggaactaggcatctcctggatgtgcaggccaaaatgacaggtcctcagctgcctgttggatctgccctgcttctgtcttgccctcaaagtcttctgtggctcctttggcctacaggccagatcccacgctgttcagcctaaccgcctaaccttggatttgatccctccctggccttcctgtcctgaaagctctccctatccagaagtctcttgagaggcctggtggatcagagccaggcacaaagtggagcctcagtgctctggggcttagcccagagggcagggcttcctggaagaatggagcagggctcccgactgcttcctgtccagggttgggaggaaagcggcaaataacctcatcccagattctggagctgtctcggctttgctcccaacttgggctcctgaatctccaggggccaggacatttggcttggataagcctcatctttctagccctgcccctgaccccgacccctaacaattttcttgaattgaaataggcagggtttttttttgtttttgttttttgttgtttgttgtttttttgagatggagtctcgctctgtcccccaggctggagtgcagtggcgccatctcgtgaaataggcattttttaatggtcattaaggcattaaagttgggtgtggaatagaaaataataatctaattcctcatctgtggctcccgttgataagctatttatgatttatccctgtaggctaaggcatcatcttcataaggactcctggaaagcacacttctggggctgatggtataggaggaatgtgttttgccagcagtattcagtgcatgtttacagatgcccaggtgctcctggctccatgccaggtatgggtaggcaatataaattaaacgagaggattgacccctactcagtccagtgaggagagcatcatcacgcggactggattctgagattgaatggctgttgcctagcagagaataaggccttgtgagggttgttggacttgggacaaatgagtgttgatgtatgggaggagggaacagaccctaacttgcagctgcccaaagatacgggaatattaggcaaggagccagattgagagccctgagaaggaaggagcctctcgaggggaaggtggrcgtaaggtacacttgcccaagttcactccgcttggcagctgtcgtggcaggtccagttgaccacctctgctctcacctgcagatgtaccccagagctggccctcctgcctctgtcatggcctcatcagtttcctggggttcttgctgctgttggtcaccttccccatttctggctggtttgccctgaaggtaaggctggctgggtcagcccccagggtggttgggccacactgagagctttggcattgatgaataaatttgcctatcctctgtcccctttccctaaatattattacccctttgtgtaatgggctaggcaagaaccattcattcacattggtcaggggaggaaactaaggcttgggcttgtctaaagtcatactgggagccagtagggggtagaagcaagtcccaaactcctaagtcctgggatctggacactggctttaaggtacacgcagatgtctttgccaaattatcttctctttgggttagaataaattagaaatgaaaacacccaacttagcccagctggtaatgcataataggaattcaggcctcattttccataaggggtggtacagtgggaaaaggatgaaccatggagctatagttcagcatcgcacgtgaaagctgggggaaggtggaagcccaaggaggccttgccctttgtgtagccctaggcaacagtccctctctagaaaacctctgggtttggtgtggtctgcaagggggtccttaaatggccttatatcctagttctaaaactgccacagaaacaaatgccatgtgaccttgaacaggtttctttgcctctctgggccttcatttctcaatttggacatcactacttctctaggaggtccagggacctaaagttgacaaagccctttccccgggggtgctgttagggcagccsagccttttctcctaactaatccaaggacagacagtttcctggtatgagtcatgtctaacttcagaccacagagatgaaaagtttctctaaggatcaagtcaatacagtgcagtrgttaagacacatggcctttggagttattcagaactgcattcaaatcttcactatttcacttagggctatgcaatttttgagcagtcacttagcttccctgagccttggttttctcatctggaaacagtgctagggatacctaactgtgacccaggtgaggaggagagaagtgaggaagggacctaggcagacagcattggccagcctaggctgaccactttcaactctttcccttgccattgtggacagattgtgcccacctacgagcggatgattgtgttccgcctgggccggatccgcaccccccagggacctggcatggttctgctcttrcccttcattgactcctttcagagggtggatctgaggacacgagccttcaacgtccctccctgcaaggtgaggggcttctcagctgccttgacagaggaactgggggcctgtccagaatgtactgtggtgccaggacctcagcctgtgagtcaccatctgaggggggaagggggaagaagagaccagaaaattgatggaagctaggaggacatccttgcttcatacacctaaccctacatacttggtgacaccatttgcccttgaggagctagctgccaagcaggtggttcaagctgggtggccccagtgggcctgacctccctgcacccccagccccttgagtgtctctctctcatggcctcccccaacagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctggtaggcagcccctcacaagacggagcttgaggggtggcaccggcctggctccacctgccaggtcactttgagmaaagagtcagaccactctgggcctcagtttaccatatgtcccaatagtgtaaccacctttgaagagccagtgcctgggtggggccatgagttgaggaatggcaggtgggcgtagaccataacgatcctgggcaaacttgtccctgagaagaggaagtggccccggcagacattcttggggtctgccccttagtttttacccctcactgctctgccatgatgacactggcttctacagctctcattccgggcctgactcatggggcaggcagatgggtgatggagcagggaccctcccagcccagtcacctgctggggaattccaggctcaccatgcagcgtgtgcatgcttgtgatttttgtttccttgtttggaacagaacaaaggaacatgaggacatttggatctttttcctgcctcttctccatgtgtatattggagtttgccctaaatctcttctgctacaagatggggtagaaataaatacacatgcagagttgtgtcccctgcagccacactcaacttgtgcttcctcttgtgtcctgacaggggaatgtaggtgacatttctccccattcctcttggctctgctttgccctggggaatcaaggttagaggacagtcgggggaatgggataaatgccagtcctggaggtcccactggaagcagcgaggggaaattcctgaggaaatactatttgagatcctaacagtagctcttacgtgcttagcagtttatggtttacaaagtccttttgtctggcccagcatttctgagcttgacattttttgctgcaagtcggtactactgttttattttggagggaggaagctaaggctaagaaataatttgacttgcctctgagagctatggtcaagggcagagctgagccatagctagaccacctgcctccatcccaccatcgcccctcaatccagtgcttgatctaacacaactcagatagcaagtggataacaacttttattcataaaaccatgccccgtgttaattcacctttaggaagagaaaactgatctcagtcttgttgcacattgttttgatgtgagacaggcagtttggggaggtcagttccacaccaggatgtgagagtcctttaagtcccatttcccagactgagtgagcacctggtagagtgagagctgtgcctgtggttgagacagaacctcaggaggtccagcacaccgccctcaggccctggttcaggcgtacacttattcacatgcccctttttgcctgattttcttctagagaaatcagagtccccacctctcacttgctggaccttccttagccagttaccactccttacctgccagtgctccaggccagctgcctcagcccttcactgccctcctccagccccaccactgctcattgctctctgcagcaggccttgcctcctaacactcaggagaaaaactctaggatgagcactctgcttcctccagtttcaccccttcaaacccacctgcctctgtgctgctttcctgcctccttgcctttctgcctcccctctctgaggctcatccctgtactgcgcagtgctgtgggccccctgctatcccaggatgccttccctccactccatgcactctctctctgtcacctctcctttctgtgtagaaatgtgccctccctttgccacagtgccctctagctcccactccctttctccccttttcttctgcaagactttcatccatgctcccagcccctgcccctacatccttcatcctggcctccttgggctcccaagacagcgctggccaacatcacagtgacctcccacatgccagcccagtgggcacctctcagcccttcccttacatcacctggtggcagcatttgacatggtcgacccagcccccagcccccagaaccccctgtacttcctccttccctgtcatccctggttactgccacttattctcctgcccttgagtttccagggtttcatcactggcctcttctcatctgtgacctccctgggagagctcatccatctgggctgtctgctgcctgtggatgctgattattcacaatgtcctgccctagccctgatgcttctgtaccctgggccatttctccagctgcctactggacaattgactgccccacagacacctcaagcttacagtagtaaaaaaaaaaaaaaaagttgccatccctcccttcccacccccgtgtgtcctctctagtgaatgccacactcatccattcaggagcctgactcctccccactcccgccccctctcatatcattgcacacatcgaggcagccccgagcctggtgcttgcacttctctagtgccctgttgtggctcagtacagttgatagaggcatgcctccctcagtggatcttggcttcacagctcccctccaccctcgccagagctgcatcattccttggctgtattttgaaacaatgtcttccttggtctccatccctcccctcagccccctataatccagcatccacagcagccaggaggatcttgccttaaagcaagtctgctgtatcacctccctgctcaaactcctccctggggctctttgttgcctcagaataaatcaaagtaagcagaaacaccccacctctgacccctcagctgtctccagtcctcagccgacatgtgagggtccagctaaatggaactctggttcctcgcagctccacgaacatgccaggttttcttgtctggggttttgcacatgctrttcctgttgctggaagggtcctcctccacctgaggactccctcctgctggcaccaccctcctctgctgggggctcaccacaggccttgcttctgtcttggctcttaccacagctgaaaggtcattgccctctgcctgtgttcccaggctaggagtgtctcaagggcggtgtggtgcctccatgtccatgcacggccacacagtctgcccaaagaaggtgctcaggaaaggtttgttgaattaattacatttctcctcacactgtcctccagctggagatcaacgatgtgaccagggcctgggggctggaggtagaccgcgtggagctggcrgtggaggccgtgctccagccgccccaggacagcccagctgggcccaacctggacagcaccctccagcagctggccctgcacttcctgggaggaagcatgaactcaatggcaggaggtgccccgtccccrgggccaggtgaggagccctggggaggagagcgggggtgtttaccagcttggtgccagcacagactttgctcactatcccagcagctctgtgcagtacacaccctgcacagatgttcagcccacactgaccacagccaaggcagtgagaggaggccaggtgtctgagtgtgtagaggccattggcagcctccatgggaggaggcgacatcaccagaagggcagctggaaagaattttatatctgaggctggagtagtttagaaactgagtttgcagtttaggctgaaaactcaggggcacctttctggtagaggaggaagttgaacagaggcctgaaggggatctaagaggaaactgccacaaaaggtgcagaggccacagtgagtggtcctgaccttggcaacacgatgacctcctctctgcctccttccccaaccctgttggccacccccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcgscacccaaagcgcctacttcctggacctcactacaggtgccgctgccctccttgcctctccttcccatccagcttgctaggtttcttgttacctaccccagtggtgctctcgtagactgccccctgctcctgccaataatttggggtgaacccatggcaggcaggggctcagacaccatttccaggcattaactatgccctggtctccccgccatccgcaggacaatgcagccaggcttccaataccaagaggcctgcccgtgttacaggcctgctgcctgtcaggctctgtgccaagtactttttgtacattatctcacccacttctcaccatgagcctatgctttaggaattgtcatctctaaaggaattatcatcacagatttggaaactgaggatccaagagttcacacagccaataagactcaaacccagggtattagaacccaaactcttaaccagtactctcctcccagtgggaaatgccagcccctcccacccccatagatctccttcacgttcctccattcccctactgacactcggttttcttttgccccacaggacgaggaagagtgggacacggggtgcctgatggcatccctgatgtggtggtggagatggccgaggcagacctgcgggccctgctatgcagagagctgcggcscctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctcygtcctgcatgcctggcgagctggggcccagggcagcatgaaggagagccctgcgttctgtgcttcttaccagaggtttgcaagcctcagacaaataaatgtggtgtttacaatgtataaaagagaagaagccaagcggggctcctgggggcatggggtgggctaggagggtccacaaggtccatgctgccagcccaggcagggattgacatcctggtggctgacacagacagaccctcacaatatttgaagctccttctcctgagtgtctcaaagcccctggaagcaagggtggggctgggtggggagttctgttcctctttgtagtgggatacaggttcaccaggaaaggaaggcatgagtgtgccagagtgtcctgcaaacactgaggggcaggtggggtggtcatatcccattcaagagaggagttggggccaccgtcagcttcccctcctggtacactctgtcactgcttctccgctcgctgacgggaaggaaacagtcatcgaggtctggccccaggcccagcccagccctgctttctgctccagtactctcgcccaaaccccaggggccccagagaagggggcctctgacttcttgagtcctaagaaaggaatcttactccttggagagacttctgggaaaaacaaaaccacaaaaatcaaagcctccccttaagaacagcccccagcctgtcctgtggcaccgcaacttccctctccccccaggggtctctgcccttcctgggtgcctggctctgtcttgtttgctgtctgtccctgcctttgccagacactgccttgtcccgcctcctggaggtcctccacattgcctgaggcacctccctaaagcccagcacagacccctctgtcactgccatggccattgaggttcaggtttccagggccccttcctagagtcccaggctgctgcacctgctgttgcccctttgcctacttggaggcctctcatgggccctcccagggctttctagctgaggctgtctgttccaaagcctgccctccaatccccgcagccacactgtggccaccctttgaggcccagtgagacttgtcctctgtgcccttgcctggctctctgcacccattccacattgtgtgtttctgctccttgcatatatggctgccctccctgctggactgggagcttcctgcatcagcattcacctgtggattccttccattgctattacacagtatatgaagggctgcccaggaaaccccaggcatcttcaccatgaaagctggcacggccccttggctggggtagggctggagggtagggaagacaggaaaaatgagatcacaacttaggggaaacccaaactcttctttgtgagcatgggaagatcaacataacgtttaggggaaaccgaaacttttctggatgtctgtgtaggtggagagtaaggcctgcccctgccatgaatccccaccctgtggaggggagctcgatccttggccagcactccaggactacagaggactgagcagaccctgcagtccacaggggaggaaggacaagggccacctaaagggtcggtgtgaagagggaggaggagggtgtgtgtcaatcagagaaggctttcctgaggaggtgatgtcctccacatcccagctaccaagtaggtggacaataagaagagatggggaaaatcattcagcagaggagaagtccctgcaagggcacagctggaagaggcagtcaggcaactgggcttcggggaactagaacctgaagtaccagacaggttgtgtgcgggcatttgaggggcagggtatagaaatagtaaccattactgtgtgccaaatatgtccttataccggactagacacttcttattatatttttcttcaagataacctggtgaataatgataatagtttaagtatcctagttaatatattaatatataatgtgttattttgatgttattgaaaagtattttatttttttttgaaacaagagtcttactctgttgcccatgttagagtacagtacaatctcagctcactgcaacctctacctcccggattcaagtgattctcctgcctcagacacctgagtagccaggattataggcgcataccaccacacctggttaatttttgtatttttagtagagatgggatttcaccatgttgaccaggctggtctcgaactcctgacctcaagtgatctgcctgcctaggcctcccaaagtgctgggattataggtgtgagccaccgcacctggccttatttttaagcatttaaaaaaaattttttagaccgtcttgctctatcacccaggctggagtgcagtggcatgatcatagctcactgtagccttgaactctggggctcaaacgatcctcttgcctcagcttcctgagtagctgggaccacaggttgtgccaccacaaccggctaatttttaaaatctcttttgtagagataaggatgtctccccatgttgctcaggctggtcttgaactcctgggctcgcaggatcctcccaccacagcctcccaaagtgctgggattacaggtgtgagccactgtacccagccaatatttaaattttggttggctaaacatttaaaaagataggaaagcatattatgaaaattctccctccacacatatttcccatgccttcccccatcccctgcgattagtttcttggtaattcttcctgaaggttttgttttttaaaaaaaaatatatgcaagaaaatccaaatatgtatcttctgggtttttgttgttcctgtttttatacaaatggcaacatagaaacacaatgttgcctttttcacttaacattacccactgaggatctttccatgttaccacagacagcctttccctgtgctttcttgtacttacataggattccacagtatggatgtatcataaattattcaacctgtcgtggaccgatagacattttgattatttcttgtgttttgctattttaaatacttttgcaatgaataacctttaacatgtgctatttgtggtagagtttatctataagataaaatcctagaagtggaattgctaaatcaaagcatttataatttagtaaatattgccagaataccttctctggggattataccaatttacactcccattgtcagtggtgtttttttctcatagtcatgtcaatacactgtgttattaaacttttgggtcttttgacattctggaaagtgaaaatttgtatctcagtgtaatttttttgtttattgttcaagttatttttttgttttttgtttgtttgttttgagacagggtctcactctgtctcccaggctggagtgcagtgcagtgattgtggctcactgcagcctcaacctcccaggcttaaaggatcaccatgcctggcttttttttttttttttttttgtagagacagggccttctcaagctggtctctaactcctggcctcaagtgatcctcccacctggccctggcccgctaactgctaggattacaggcatgagccatctagcccagcctgtttattgtccaattgtttattgctttgtaagtcttggatttctagctccagcaaagaacagggtttggtttggtttggtttctcttcccctagcatttacatattttttaaaggtgtaatttacatacaacaaacacccttttaaaatgtattatttggctggcttgcgcctctaatcccagcactttgggaggccgaggcaggtggatcacctgaggtcaggagtttgagaccagcctgaccgatatggtgaaaccccatctctactaaaaatacaaaatttagccaggcatggtggtacacggctgtagtcccagctactcgggaggctgagacaggagaattgcttgaacccaggaggtggaagttgcagtgagttgagatcatgccactgcactttagcctgggcaacagagtgagactccatctcaaaattaaataaataaagataaaataaaaagtgtcatctgaggtgctttgacaaatgtgaacacctgagtaaccaccaccccctacaatcaaatacaaaacattcccatccactcacaaagttctccacgtcacttcccgtcagtgcttgccacctccagctttgagcagccactgacctttccataaccgctgatcacatttcacttttctagcatttcatatgaatgaaatgagtgcacagtactcttctgtgtctagctttttccccctcactgtaatggttttgagagtaatacatgttattctgtgtatctgtagtttgttgtattgccaacacattccattgtctagatagaggcacaatgtattcattcatccattgatgaacatttgagtagttttcaggtttggttattaaataaagctcctccagacatctgtgtacaagtctttgtttggacatatattttcatctgggtaaatacctagaattgctggattgaaaaactgtcaaacatttccaaagtggtcctgtcaacatgcggtatagtcagtcttttaaactttagccactctaacaggtgtgactgacaatgttgagccacttttaatttgcttattgggcacgtgtcttcttttgtgaactatctgttcaatattttgcttatttaagaaatgggctattaatattgttgagctttaaaagttcttagtatagctggatgcagtgacacatgcctatattcccaggtacttgggaggctaagggaggatcagttgagcccagaagttcgaggccagcctggacaacacagcaagacctgatctcttaaaagaagaagaaagaaagaaaaaagagagagagagactctccatacgttgcctaggctgagtgcagaggcacaatcctggctcactgcagcctcaacctcctgggctcaagcaatcctccccactcagcctcccaagtagttggcattataggtatacattaccaaacctggctaatttttatattttttgtagaaacagggttttgccacattgcccaggctggtctcaaacacctgagctcaagttatatacctgccttggcctctcaaagtgctggaattataggcatgagacaccttgcctgacctgtgatccattttcgaattaatttttgtatatggtgtgaagtaaaagttgacgttcttttttttcatggtgatatccaatcgttccagcactttttgtttaaaggtatcttttccccattgaattacctagaaaccttttcatttgcttttgtgttattttgagtgaggttgagcatcttctaatatgtttaagagccatgtgtctccttttctacaaactgttattttatctactttgttcatttttctagtgctggttgtttctatttctgtttttgacatttgggagctctttaaatattaggaagattagccatttttgatatgagctgtaaatttttcacccaatttgttggtttgcattttgtctttgcttataatgttttctcatgaaattttaaaaatgtatttgaattgataaatattttatgacttctggattttgagtcataagtaaaaaaaacctccattctgagatcataacagaatttaatgtattctcttttattttttacttgtaaaattgtaaactcatttggaatttaaataagtataaagtataaaatattgatcccccttttttcaacaccatgaattttttgtgttgaggtctatagtggggctttctgctctgttccattgggctaatgtttatccattctctaggaccactttaattattggggtgccataaaatgttaaatatctataggaggaattctttttaatgcttcttaagaaagaccttctgcctttttttgttttaagagacagagtcttgctatgttgcccaggctggagtgtagtggctattcacaggtgtgatcatagcttactgcagcctcaaattcctgggttcaagtgatcctcctaccttggcctcccaagtagctgggactacagatgcaagccacttaccatggctgactagtgtttgttttttcaatgaactttagaattacctggtgtagttttttaaaaagaatactgtcagtgtctttatctgactagtgtttg

SEQ ID NO: 10895 - DNA, 16567 bp, Homo sapiens
  misc_feature (1)...(16567): n = A,T,C or G, or insertion/deletion polymorphism (see Tables 1-2)
ggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctgagcttgcctccttgtctcttcttgggattggtctggtgggagaggagtcacctataaggctagggccaattggaattcaaagttcttcctgagaagcctggaatctctgagcgcctgaaccagagggccaaatggatgcttcataccccttatcctcttagcttcatattggggctaggagtggactcatcagcctctcccatggccacaccttcccctcctgcgcacccgctgctgcccacctgcattaaaagtagccactgaggagaaaagccttcttagggggagaagctgagcctggtgaggatgccccagcacagagaatggtggctatgtttatggcagggactggcctagggcagaatggaccgatgtgggttcccagagaagtttgtcctagaaacaatagaaaagggtaggcccagaccctatccacaggtaagccttaaattccaatgacaaaacaccggtgctacacaaatctcatcccccttaagtagatcagcagcaggaactgtgaaaggcagatgagaaatgggaaagggaagagattggggaagcaatgtaggtcccagcacccaccacccctgcagaatgggccccagacaggactgctatacatctgcatttattatgagcagcaggtgggacacttccagcaacagtaaaaaaaagtaatttacaaaagcaggtttcagtgaagccatctggttgttacctaaaagaggagaggggtatcaaaataagaccaatggcccttctttcctccttctctccctgcacccctgtgctcctggggcaagggctattgagcacacacctctgaggatgagccaccagagctgattcctagtggcctgtttggtggattgtctgcagcaagttttaagccctggatcttgaccccctttcagccagctgacttcccagcagcctctccaagtcactggggtctgacttctaagaatgtaaatgtacagccatgggatgcctgcgtccacacttctaggtggtacatcccaaaggcagatcgaggccttgggccatgtgagctcagaactgagagtcacatttggctcaaatccgtatgaggggcagggaaagaggcacaaatgtctagtgtccctacccattccactgagtctgtctccatcaaccaaggggtcatgctggtaagagctttaaggaccctgctgacctgactctggggaggcttccctgggctgtgccttggaggctcacgcatccatcccattgcagctcttacccttgggtgctcacacgtagatgccaacccagagcagcaggaagaggactccaaagcccatgaagagtgaggccactaaggagatgaggagctctttatagatatcacgagtgtacttggtagaggtgacctcgtaactgggcacagcagttaaggcaaagcgaaggggtggactgtggagtgcagagagcccagcccacggcaatctgaggagaaaagcattggctcaatgccttctgggaggcctatctggctcagagcagccaggcagaggggcctaagagatgccttggactctggtgctccactgccatgaagaaaatgagacccagaggagttaggtcacttgccccaggtcacacagctcatgagggccggagctgggactagccctcagacctcctgacacctgagtgcacccttccttataccacctttccaactgtagcacccctattccccacctccactccagccaggtcccctgctcactgtcctggaaatccaaagaacaaactgagctcacctgaacttgggaaataaggctataacctgcccctgggcatcactagccctcctctcctccttaccttctctcagccccaatccaatgtacaaaaccggcggggtccatgtacctagcgtggtttctccctgagcttcccacatcactaatgctggtcctctggctgctcagtgaaaggatacacgaagaaccaggcggtgaagaacatgccaatggccaaaagcaccacggtcagatgggggaagacagctgggttcactgggctggtatatctgctcatggcctcgagctcctagaggagggaaagagatcagagctatcaaagaatcccacgatttcagcctggagagaacatgcggttatcaaggagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttntccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcggtaataagttccaccttatggggtcgtgttgtatttttcctaagaccttggacgagaaacatttctgacacttgagttgtttaggcccctttcctgcctacctgtctgtgggacgccgtgaggggatcaagggctacatggtctggtcctcagtccacactccagcagcgcggccggcttgaggcaagagccgaagggttgaacaggcctggagaggggacattagaggtttctgtctgttgtctcagttaaccctggcagcagccctgagagacaggcatggtaatcgttcttcttctgtagacgagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagrtcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatccttyttaatagttatacatttaatacatattaaaatataactaatagaacacaaatattattgcttatgagttttccagtttagttttttaaaaaaaattctaagtgaatgaaagtacgggttttagttggaagtagcaaaaatcgtgagggtgatttgggaaacactgctatctgggaaacactgaactctgaagtgcaatactcttttgagcccagtgactacagcatgccagacccctaaatcaggacctggggaggagccatggagttaacatttcagactgagtggtggcgagaaaacgcaaagggaaagacttgaaactctagcaacattataataaaagtagaaactcttatgtgctgaggcgatgatgaagagagtttagagaagcttgtgagaaagccacatcacctccattcagatatgtttgcaatcctttttcaaggctgccttattagtcagggttctccagagactcaaaacaaatcagatctgtttgtttagctggtgtatttgcctgtctttcaggtctgccattatggtccctggactcctcaagccaggccaagcatcctggccttctgtggtccttgatggagacctatgttgcaggttttttttgtgtaataaataatgctgctaccttagaatatcaacagtatcttatttctctaagcacgtggttcaatttctggtactcgttgagccttactattgagtaaattctcctgctagactgagttttttgagaatggggaccttgttcatctttttatctttagcagtgctgacatggtgtcctttttgttgtgtggaatttagttgaaggcatgaagttggtgagataacaccagttataacctttctcctttcctccgtctctgacttgcctttcytttttagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcracacctgactgccagtgaagccaaaaagctgccaatccaggaattccacctgagcyggattctgcaggagctgggccwgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggakccagaacccaagggatccactaagaagaaggcaaagactggggcagcagggaagtttaaaaggggaaaataaatgtgtttccccattatacctccttcaccscagaatatttgccgtcttgtacccttaagagctacagctagagaaaccttcabggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggakacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgtttraaagttatgaagaaaaaagtcaataaaattctaaaagtaaccaaaatgtcatgttctttgagaacatttgaaaatatcccaagtgaccatggctccaaatagctttccttttcactcttaacatgctgtaattgcacttgattaacaatgggtggtttgagagtggccacaagatggcaccatgctccataaaatggccatagcagctagatggaacttcagccattaggaggaggatgttttgtttattttattttgctgggagaggagttttaatacgttgaatagatttctagtctctcactccatgagatcaaaggagtgcctttaagaaagcctcacaatttagatcaactacctcataacatccaagcatttactttgccactacttgtaaactgaaagctgccattcagaaaccattttcttgttccttttgtaacatcaaatccaagatactgtttcccatagagatggcatgtttttgagctttgaaagttttataatcctgataaagcttggcccatttgaatgtctgacgttttagcattcctgtcagggccatttgaagttaacagggacacttatgtaactgtccgaaatttaagctggcaatgtcttgacagattaaacaggtagggagcctgaagaccagtagttttcaagtcttttaatggagaaacctattcttcaagtgtaatcttatgtgaaactttaggatgtacaggttcctctggttgaagctggaatgggataaagtttacccagcaacggcctcataactagggtactttttgaaaactggtgttgacaaaaagttctatcccaagggcaggtaacttttgaaactgattttcccagattataccaagccacacaacttatttgagctctattttctgattcaggtagattgcttctaaatctgcagtaatggtgataggaactaaagacggtaagatttctttttttttttttttttttgagacagagtctcttgctctgtcacccaggctggagttcagtagtgcgatcttggctcactgcagcctcagcctcctgggctcaagtgattctcccacctcagcctcccaagcagctgggattacaggcacaggccaccatgcctggatgatttttcaattttttgtaaagatgggatctcactgttgcccaggctggtcttaaactcctgggctcaagcaatcctcccgccttggcctcctaaaggctaggattacgtgtgccattctctcccagtgctgggattacaggatgagccaccttgcctggcgaaatgttaagatttcttaggagttattgcctcagtgcagtagctcttaataattaagggcttataccctgtggtggtcaagaatgtagtggttttcttttgtcttttgaaggtaagtttgtctcctatagaattttgttaatctgactttctgtgtgcacactgcagggaagattaatgatgcctacaaatgtttttgctcagagctgttctagttggatggttaagaggcactgctctgcagtcaagctctgagggatcacacttgcagaggaagatttaggcagataggacttagggagactatttggaaactagaaatgagtttaaaagtaaagagaggccaggcgcagtggctcacgcctgtaatcccagcactttgggaggccaaggcgggtggatcacctgaggccaggagttcaagaccagcctggccaccatggtgaaaccctgtctctactaaaaataaaaaattagctgggcgcggtggtgtatgcttataatcctagctacccgggaggctgaagcaggagaattgcttggacccaggaggcggaggctgcaatcagctgagatcacgccactacactccagcctgagcagcaagagtgaaactctggtctcaaaaaaaaaaaaaaaaaaaaaaaaaattagcctgaggtgggaagatggcttgaggccgggaggcagagaatgcagtgaactaagatggcagcaccactgcactccagcctgggccatagagccagaccttgtctcaaaacaagtaagtgtaaaaataaagagaaaataattcaaaatggaaagctgaaggacaaaagggcaagggcattgcctcatgaataggaggaagtgatacgtgtgaaacttggtgagattattgacaatctcacatttgaacacgggagtcatcagaaggactttgccttgctcttccttgccatacttcacccttgccttggtgttttctggagggtcctgatgtttcttcctctgcccaatacaaaggggagtctagtgattcaagaacttaagagcacagagaggtgaacagtaactcgtagcagaggcactcaggaatcctgtgcacacacagatgaacatcatgggttacaaatgaagtcttttggtcaaaattaactttatttttcaacttcatagggatgtgataacaaaattggcacacacaaaaagaatactgatattgggcctgatttaaaaaatgcctctggccaggttgtaaaaaagtgaaagtaacaaagataaacatagaagttggagttgtaaaaaagtgagttggaattcatgctgccatgatctacttgaccagaggcagcttttcctctctaagcctattttatatctgtcagtggatttgagatcactcattttaccattgtaacattccgagccttttgtcactgtgtgtccctttgtggccatgtaagagaccacactgctgtaggctgagaaggccacagtggttcaggtgctttgaggacttggtcttggctcaatagagcctcactggtgtttgctcagattgggcagcctatgcccaaagctacttggctaaacaggctggtgacaccacacccaaaaggtggcaaagaataggaataggaaggatcagcacctattttggagtgaggaagccaatggaggtacaactcctcaattctaagtttttgttgttttttttttttttgagacagggtcttgttctatcaccccaggctggagtgcagtggtgtgatctcagctcgctgcaggcttgacctcctgggcccaagtgatcctcctgcctggacctcccaaaagtgttgggattacaggcatgagccactgcatccagcttgcttctaattttcctacccaggctgttttaaacctagttctccagctaagtaaaatgtgcccaaatggaaaacatctaaatcttctgcagcccattcttcctgtgtctttgtgttgacaaacctctaatcttccatgtctttgtgttgacaaacctaaccttccatgtctttttgttgacaaacctctaaccttccatgtctttgtgttgacaaacctctccatgggtggtgcatctgaccctatcccaacatgccttaggacgctcatctccttgactgtctgccatcccctcccaaaactaagtggaggctctgtcttttcctcctagtttgaggttctcttctcccagtgtctaaaatgatcaatatgcctagagtagatgctgctgaagaggcaaagtagtaatcctgccacctggaagcaaaggctgtgggttggagggggaagcgggtgtgagggctgatgataagccctaggaggctcctgagtcatattcctatgtttgctctctggagagatgggctaaactgtttatcttttaaaaaccagatgattaaaaagttacattttagtattatactgataggaatataggataatctcttctaaagcctatttggtttccagaagagttagatacttgaacaagagtggacagagtaagatacctagctacagcaatagaaatcacaaactgttctgtggttttaatcttcctatttctgatttagaagtatgaagtgatcatatttaatctttctgctcctgctcaaaaataattctataacatcatttaggttatagaaagtttctacttatagcccttacattctttatgaccgaaatctgtgtctttcctcatgactgataattatctcccaatttggtcacttctgctaattgctattttattaaacttgaaattttaggttgggaagcaaagggaaaccactgggcatcccctttgtttctagggagaaaagactaacttgtcccatctgctcacttgcttatggagctaaaagacccccagtcctagaagtgttctgttcctgaggagtggttaaagaggtgaaaagaagaggtgaattaaaagatgaaagagctttttaaatagccagcaactctctctaccatctgttttggtaagagctagcacctcttgttctctttagaccctggagggaataaaccaaaatcagtggttccaggatccttcagagccaaaagaccccaataccacagtcttgacctttgccctgcctgcttctgaaactggagaatggcatctcccagcagcctaaggcagacataggtcatacctatccctgggcagcgagctgagctcccacagactgagttgtgctggatctcagaattctaagcattaatgtttccttgctgttataattcttgctcatcaggttcaactgccttatccctctgaggtttgcaaatgaggatggagaagccactgagaaatggaccagtgagctgagctcaccttttatatgagtggattttttttttttttttgaaatggagtcttgctctgtcgcccaggctggagtacaatggcgtgatctcagctcactgcaacctccacctccccggttcaagcgattctcctgcctcagcctcctgggtagctgggattacaggcgcgtgccaccacgcccggcatgagtggaattttagtgttaaatctcttcctgactctgggttcagtaggtccctcctcttctgttaccctcctggttctctctgttcaccaactacctgcatgtgccaaactagaaaaaggaaataatttacacccctgccccaacagctccttccctcctagggacttctgtgtccaccccccactttgggtcttagaactgtggctagaagataaaagggaggagtttgagtcagaggctttatgtccccaaacccaaccccctctgagtattaaactatagtggcattgtccctcaagctcccctctgccttggctccagagtcttcctcctcttcttccagactgggcagggtggctgttgttattggtgaagataggcatctagccagagctgccctgactcctttagtgagctgcagggacaaaatgggggcagacagtgagggagacaagcagagttgaacccaccggagatggagcagtgaggttaaggccttcttccatctggaggttttcctcccctctactttagagaaagctagcttgggccatggtactgaggggaaccccaatgagggcaaaggcctgacctggccacaggtccaataaagaatcctgcctttgccatggtgaactccatcccacacgactgggaacaccttctgttcactccccaccctacatgtcatcatttccattgccctgccctcttccctccctactagccatcttcctggtctcagatactcactggatgatgtcggcgaaggctgacagcaggggcttggactggtactctatgccatgcttggcacacaaggactgcaccaggggagccactttgtggtaattgtgtcgaggcatcgtgggaaaaagactttagggagaacgggggagtcagtggttcctgcttctctgctcccacctgtacccaacacttacaccctccccaggaccctgcttccccaggctccctactcactggtgctcaatctggaagttgaggtgtccactgaaccagtcattgaaggcagacttgtggacattgcatgtggcctggagctggcggaaaaggtcaggggagagcatgttgaatatcagatggaaaggccagcccagcattctccaggtaaagctggctgaggaagggacatgagactgtcttggtcactcccttcacatggttgcagaacaagagcctcaggc

SEQ ID NO: 10896 - DNA, 31085 bp, Homo sapiens
  misc_feature (1)...(31085): n = A,T,C or G, or insertion/deletion polymorphism (see Tables 1-2)
agactaaaaatgttattacctgatccactaattacacatgtagaatttatcctaagaaaatgttcagaaatagaaaccaatatctatatacaaaaatatccatcgcaacatttatacaagcgaaacttctacacaaatgtccaacaatagggaaaaagttaagtatattgggagtatatatatgtgtgtttatagatatatgatgacttactatagtgaagtaaatattctcattataaaattttaagcttagcttttttgttttattttaaagagagatcatttgtactggaaagttacattaaaggcccagcaaaatgcttacaacaacgcctagaggactccagacccattccccgggcaatctgaagatctgggacctacctacccaggcctcccttctcccacttaatagaggcaggtctgagggcctgggaggaagaaggcaccgcagagaagcaaggacaacagccttctcctctttgaaccagggtggccttataccaaaacatttattgaactcactgctaaggaactcatgtagagaggaactaaaagttataaataagttctggggtaaattctagccccaaatatactaaatttcatgtgtggcttcagctctttggatctgtcaccttgtctataaaacagtgggtttaatatatctgtccctaaggcatctatattctatacaatgataagaagactgggccgggcgcggtggctcacgcctgtaatcccagcactttgggagtctgaggcgggtggatcaccaagtcaggagatggagaccatcctggctaacatggtgaaactttgtctctactgaaaatacaaaaaattagccaggcgtggtggcagacgcctgtagtcccagctactcaggaggctgaggcaggagaatggcgtgagccctggaggcggaggttgcagtgagccaagacagcaccactgcactccagcctgggtgacagagcgagactctgtctcaaaaaaaaaaaaaagactgcattaaggaaatcccgtgaattcctccatgagcctgcctctgccccatcccaatctcccacactcttagaatgcagcaaaatgagagtcctgtttctagctctcgctctgcctctaatagaggtatgattgggattctccctttagtttaagcactatatgtcataaattatttttaatattacttaacattaatctgcagaattattacagatgacttttcttaaaacaaagactgattctgtcaactttattagtgcctactgtgttgtagtcactgcacccccataagttatccaatttcacagaaatccagatttttcaaaaatggttttggtctttaatggcctgaagggctgctactgaggggaggctgcagcagaggctgagcacaaccggtattgcttctcctatatgtgttgactttgtaaaggatccaggctattggccaactattatgtttaggatcttttgttaaaatggatcaaaatttgaactcacaattcaggttattccaacagccactggcagttaggttattcaattatggcttcattacaatcggcattaaggtctttttttttcttttctttagagagaaaatggtgggacagttaggaaggggtctcactatgttgtctaggctggtctccaactcctgagctcaagtaatcctcccacctcagcctcccaaagcactgggattataggcacgagtcactgtgcctggcctggcattagggtcttaagctcatttcgttctgttccttgaggattaatttggccagaacagttagtattcacaagtggcaacctaaaattaagtatgtgattcatatccaggatgaggcaagttcccttaggatcaacagggcctgcaaggcaaaggtttcctttagttgacctggatatgggtttattgcagtctgtgtgaccacctgtgtaggtgggtaaggagatgagagggcaacacgacatttgcctagtggcctataggcttactcacctgtattttttcaggttgaaatcatcagttgattcagcaaattttttatttatttatttatttagagacagagtctggctctgtcacccaggctggagtgcagtggtgcaatctcggctcactgcaacctttgcctcctgggttcaagcgattctcctgcctcacccccacaaagtagctgggattacaggcaccccccaccacacccggctaatttttgtattttagtagagacagggtttcaccgtgttggccaagtgggtctggagctcctgacctcaggtgatccgccctcctcaccctcccaaagtgcagggattacaggcatgagctgccacgcccggccaattcagcaaatttatgtgggattccacctagaactccaaaccaaggtgctctgaatatgtattggtagtataaacagaatccacagccctatcctggattataagctcgttagggaggtagcaaaatacatgacactgacctaagaacacatgaaaagcaaagaaacatgaatgcaaagtcatgtcatataagctgtttaaatcctgagtaagatgaatttaatttgcatctatcctactgacctataatccgtgactcacttgtctctctcctccagtagacatgactaggcatgacccatatagtactgaactttgtattcccagcaccttaccaaagtaggtgctgggaatacaaagaggagacaccccacaaatgttaaataaaacacttaatgaatggttctaggtaggtggggttgatcaaggaattatcttacaagtggtatgggttttttggttttttctgaggtgcagtctcaccatgttgcccaggtgattctcctgactcagcctcccaagtagctgggattacaggcactaatttttgtattttagtagagacagagtttcaccatgttggccaggtgggtctcgagctcctggcctcaggtggtccacctgcctctgcctcccaaagtgctgggattacaggtgtgagccaccgcgcccaacctagtctttttatagaacagttatctctgtagccaaacttacatcatattatttaattttccttgattcgggggaggggggagggatagcattaggagatatacctaatgctaaatgacgagttaatgggtgcagcacaccaacatggcacatgtatacatatgtaacaaacctccatgttgtgcatatgtaccttaaaacttaaagtataataaaataaaagatttacataaaacatttttccttgattctgtattaaaggaaagatgacattattttcaatgtctgcaaaatatttcactgatgggcatttagagtgtttccatttcccgctatcatagatactgctttaatgaatattttttgtttataaatagttttctttttttgtgtgtggatatagaatcttgctttgttgcccaggctggagtgcagtggcacaatctcggctcactgcaacctctgcctcccggattcaagcaattctcctgcctcagcctcccgagtagctgggactacaggcgcacgccgccacgcccagccgatttcttttgttcaggctggtcttgaactcctgagctcaggcaatccgcctgcctcgacctcccaaagtgctaggattataggcgtgaggcaccccgcctgacctataaatatttttctaagaacatttccttaggctatattcctaaacatggaattattgggaacatttttatttttctattttttttcatctcttcagtattcaaaacattcctaaattctggccgggtgcggtggctcacgcctgtaatcccagcactttgggaggccgaggcgggcagatcacgaggtcaggagatcaaagccatcctggctaacatggtgaaaccccaactctactaaaaatacaaaaacaaaattagctgggcgtggtggcgggcacctgtagtcccagctacttgggaggctaaggcaggagaatgccatgaacctgggaggtggagcttgcagcaagctgagatcaggccactgcactccagcctgggcgacagagcgagactccatctcaaaaaaaaaaaaaatcttaaatttctatataagttgtcaaactattttttccagtttaatcaacttacacttctaccagcagtatgagagcttttatcccactgcacagtcacataggaaaaatggtttatgtaaaggacctctcttctgttatttaatacccatgaatttcttatatagttgtaatcagcgaacccatactactttgggttctgcttatttcacggggaaggattctatatctatcaatatagttcacattctagccatttaaaatcattctttaattcttcattgtgttaacagatcccaataagcttggcgattttcttattgtcaggactcgggtttatttccagtttttgctattaaattggctatttctgcatctttgcacagtctcccctactttaccaagagtgaaactgcttgatcaaagaatagaaaatgttttgtagctcgcattagacactgccaagttgttgggcaaggtttttaaaaaaggaatattggctgtacagaggtgcagctgtgtggaccatcattcctgagcagggtccaatagcctggcatcttacctggaagtcaggacatctaaacttccctatgggaacttggtaagccccttccccatttcgaacctcaattttcttatctataaaatgaagaatttggatggaatgaattaatccttttctaccagaaatctagccatatttcacctagtctattctgtatcaccctctcctgactcctacgtgctcagaatctagctcagtgcttgggacagttatgtttcctttccctttgaagtgcccaaataccagtgtaatgagaaatatggcagagcctgagagttcagagcacaggccagggtcaaatctcagccctccacttacaagctgtgtgacaaaataacctcccccgggctcagtttcttcactgtaaattaggttaattgttccaacctcatagggttgttaggagaattaaatgagttaaggtttgcaaaacgctaagaacagtgcctggcacacagtaagtgctttataaagtgtttgttgaataaataaaattttggacctaaactctgggtctcttcaggactgcaacagctttgtaactggcaaccccacttttaggtgcgttcccactcctctaaaacccagagatctaaatgccaaatctctctgcttaaaaagtctcccagggctcctaggcgcctccaggctagaacagaaatgcctcagcttgaagacccaggcttttcaggtgaaacacctaagggtcaggagacgctaggatcatcactcaaggatcccagtgaatttttccaaaatacaataaaaataaaaacaaaaagaggcaaacagggttataaaaattgtggggcattttaaatgtttcattgaacaaattaaagcattaacagccctcccccaaccaccaccaagcccaagagaccgtaaatatgctgttcacaagataactgcaactttcaagggctctcaggctgctacttcgggcagcacaattggcggcacgacgtggcaagcaggcagtagtttccaaccctggagggtcagcgtctggagaccccggccaaggcatccacagcctaaagatgatgtccgcgaccgcccgggcagcctcgtgcacggaaaaacctcaaccccggccccgcccacccttcctgcggccaccccgcagccctggcccctcagtccatccactcctgcagcgcggccccgcacccagggcctgcactagaaccgctgttcctaccgcggcgccccctgggagccaacgccgcgatgcccgcctgacgtcaggaagtcgaatccggcggcgacgcctttagggagcccgcgagggggcgcgtgttggcagcccagctgtgagttgcccaagacccaccgggggacgggatctcgctccccgcgccacgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggtgagcgcagccaggcgggggcacaggagagggcgggaccggaggctgagtgcaggggagacagagttacgcactccgagccaaacaccgactaattcggaggaaagcccggaggcgcctgatcatacctgttgcccggtgattgggtgtcctgcggatgcgggatgaaaaggcgggagagaggcctggagaagtggagtctggggagtggggatggaggccaacaacacgcacacacaaacaaagggtcccgcctccctgccgtgcattccatctgcagccccgagcctcaggtctctgggcggggacagaaccccgagctgggtaggctaggagggaggagagcaaggatgcaggccgcctggggagggagggggtcagtggccaggggagggagtcacatcctgtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggcaagcggccgctggcgtacataagggattgggaatggcatacacttagcgaggacccccagagctgttctcgaatcgccggggaggccactgagccgcaggccagcgaggtcttcagctattccgcggagcggaccgctgtttacgctctggggcggtaggcccttcgcggggtcctgtcccttcttcccttggtctcactgcggggtcggcgcgcgccccagccccaggcctgctgcttccctttctagaccacagccctcagagctaaggccccggcgcctctctgctgggttggagtcctggggactcagtcctagggactcgaaagtcggggcgttcccttcaccgcgtttcccccttggcggccagaatggcgtcccctccccttgcatccccctctgatcccgtgccctgcagcgtgatgccctccactgtccctatccactaccctggcgtcccagagtgtgccgcgggtcaccaggttcccataacgtcgcagcagagcttagacgctgcggggcgaagacccgccccaccctctgacgcgaccagcctagtgggcgaggccagagcttgcgcgggtcaaccagagtgaccactcgggagccctgactgcggccaagggcgcaggcgtgtcccggcgcatgcgcagacgaaacaggcaccaacgctggagcttcccgcagtgtgatttggggccgggnatgccgcggcggggacggcgattggtccgtatgtgtggtgccaccggccgccggctccgccccggcccccgccccacacgccgcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggtttgtaaaatgcaccaatcagtgctctgtaaaaacgcaccaattggcgctctgtagctagctagaggtttgtaaaatgagccaatcagcaggacgtgggcagggacaactaagacaataaaagctggccaccccagccagctgctgcaacccgctccagttcccttacaggctgtggaagcattgttcttttgctcgtcacactaaaccttgctgctgctcattctttgggtctgcaaagagtgttattcctttaagagctataacagcgggaaggtccacggctccattcttgaagtcagtgagaccatacccgccggaaggaaccaacgcccgacacagccccacccatctctcctgtttctcacctatactgaaattcttgggcaaaagctgtctgtggacacacccaggggaaaggccagcccaggcaggtgtttcttagtggttcccctcagccaatgcttcccattccttgatgcatccttctaactagagcagatrctcggtgatcttaaactgtggacacctgggagcaccctcaaaaggcagctgggcctagggagatggcctgtgcttctgtgtcaggagttggttccttcaggtgggctygtggtctcgctgacgtcaagaatgaagccatgaaccttcgcggtgagtgttacagctcttacaggtggcgtggacccaaagagtgagcagcagcaagatttattgtgaagagcaaagaacaaagcttccacagcgtggaagggtacccgagcaggttgccgctgctggacgttggggggtgtgagggggagcagcctttttttttytttttttttttgagacggagtctccctgtcgcccaggctggagtgcagtggcgcgatctcggctcactgcaggctccgcccycccccggggttcacgccattctcctgcctcagcctcccgagtagctgggactacaggcgcccgctacctcgcccggctaattttttgtatttttagtagagacggggtttcactgtgttagccaggatggtctcgatctcctgacctcgtgatccacccgccttggcctcccaaagtgctgggattacaggcgtgagccaccgcgcccggccgggagcagcttttattcccttatttgtccctgcccatgtcctgctgatttgtccattttatagagcactgattggtccattttacagggtgctgattggtccattttacctctagctagctaaagagcacggattggtgcattttacaaacctctagctacagaaaagttctccaagtctgcactcgacccaggaagtccatctggcttcacctctcacttcaacttgggtacagccttctggcgggcaggaggatggcctttggtgcgaacactgccggagtccagggggctggctccctcacctttcatcttctcccggcacttgcaggatccctttgtggccttccacatcaacaagggccttgtgaagaagtatatgaactctctcctgattggagaactgtctccagagcagcccagctttgagcccaccaagaatgtaagaccctgtgtttgctatgtcgcaactattggttgttgagggggacagagagggggtggaaggagagtctagatggnatcacagtcatagtaatcacagtcagtagtagctctggggagtcttgaggtccctgcttctcttgcatagtcatgaggtcacaggcccaagggagcatggctttgcaacctatggctcccccaaggctgccactaccatggctgccatcattgttatcatcattgttatcatatgagcacttactatgcaccaagcataaactcataactcttacacatttacagatgagataacaggctcagggaggttaagcaacacagccaaggatcacacagttagtaaatggcagagcaaggacttagtcccctgaactcttaggcactatcccatggcacctcctcctgtcatcctcattgtcgtggtatctttgcctaggactgtggacttcccacagctacctcagtgggaggtccttgagcctgagagggcccttgtctccagtagcattggggtgcagatgagaagaataacagctcctcttcctcttctgcagaaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggtgagagcctttggcttgtcaagtgcacagcaatgctcagcatccctggggaaagctccttgggtgtttgaggaaggccaagagtgcctgccctccaagcagggcagatctgaaggtatgcaggagtgagtgcaggaacatgcattctgctgtcttgacctgtctgctctttagccacatggncatcttcatttctctcactgcctttttagctgcttctccaagggttctcttcttcctatgcggtttgttctctgccacagcccacctgtgccaggagccaagtttctggtttcttagcaaagcttggctccctccccaccactgacattgcccaatatgttaataatgattgagcgctaattcttgactgtcaggacccatttggcaagccttctgctcatgtttcagtcctttctgtattctagatgtcagtccatcataagtcatgagcttcaggccaggtgtggtgactcatgnctgtaatcctagcactttgggaggccaaggtggccggatcacttgatctcagttcaagaccagcctggccaacgtggtgaaacctctactaaaaatacaaaaaggccaggcacagtggctcacgcctgtaataccagtaccttgggaggccaagatgggcagatcatttgaggtgaggagttcaagaccacctggccaacatggtgaaaccccgtctctattaaaatacaacagttagctgggagtggtggtgggtgcctgtaatcccagctacatgggaggctgaggcaggagaattgcttgaacctgggaagcgaaggttgcagtgagccgagttggcaccattgcactccagcctgggcaacagagcgacactctcaaaacaggccaggtatggtggctcacgcctgttatcccagcagtttgggaggccaaggtgggcagatcacctgaggtcaggagttcgagaccagcctggctaacatggtgaaacctcgactcttactaaaaatacaaaaaaatcagccaggcttggtggcgggcacctgtaatcccagctacttgggaggctgaggcaggagaattacttgaacccaggaggcggaggttgcagtgatctgaaaccgcaccattgcactccagcctgggcaacaagaacaaaactgtctcaaaaaaaaaaagtcatgagcttcggagctggcgaaacagaagaacagagaagggatggtgatttgccccaactcacgtgtgagtcagtggcagaggcagaactaggacccatgtttcctgactcctgaggtgcatcacaggccttggcagatgaaggaagtgggagaggctgaaggaggcatcgaggtcagtgaaggcgacactggggctggtgggctgctctcagtgttgactcttctcacctaggcccaggctggctggctgcagcatgactttgggcacctgtcggtcttcagcacctcaaagtggaaccatctgctacatcattttgtgattggccacctgaaggtcagtgggatggggaggagctctctaaaactccaggcaatgaagggctgccttgggggaagcttttcatactcgtgtccctgcttttctgtagggggcccccgccagttggtggaaccacatgcacttccagcaccatgccaagcccaactgcttccgcaaagacccagacatcaacatgcatcccttcttctttgccttggggaagatcctctctgtggaggtgcgtggaggtatcagtggaaaggtcttggggaataggaggcagccaacataggggagttggggaagatgcccacgatgttgtcagtgtgggcaagacactggggctgggctggctggggcttttgccattttggaagttctggaaggcaacaggcaatagatgggggctgcccaggagggagtcaccatcctccctagagagttcagtcagcaaaccgttactgcataaaaggcacctcattttgcaaaggatccagcggatgaccagaaggatccaaatgatgagatagcctatccttgaaggtgctgatggcacctcctggaggtgcttttttgacactcttgccccaggcaagtattccccttgcactttgtatttctctcccacacttaggtatccttcttgtcacagtcttctctgtccagggctggactgtcttactcttctttcatgtccaatatctggaacattcattcactgagtacttcttcccaccctgctgatccccagcctgatttcctgggtggtcagcgttgggtttgagatgtcgtctgaagttgtaagcagaaataatgtagctgctgaaggaataatgcctgggggtggagatctggtgagcttttagtgagcattaggcaatggaaggttctaaaaggccagcagaattctttgaaaagttcatttaaagccctttgtcccaaggctgtaggctgcagagttcttccaggtccacctcctccactttgtgacatttcagcttgcgaggaattaaattgtcgttaaaacacatttcagttctaggcatgagttcaaggtagcctggcgttcctctcgcccctggccatgagaactttgaaagggctttggcagcactggttggcctggcatgaggagctcatagcttgaggctcatgccccacctgtccataatgttcttattttcccatcatgagcatggacttgggtttgttacatgtccgataccattatggtcagtactatgcagatgacgaagcagccctgtcccccgtctgactcccatggctgcttcaagggcagtgtggttatttgctgggcagtggcatggggcttgtgcatttctactgtcactacagagggtttaaaaaaaagacatgggcaggttaagtggaagggaacagtctcacaccactacctttattgcttcttggtacttgggttttcaggaaattcctatcagcagacatcaaaaacagagaatgaagggacgcagttggcatgtgcctgtggtcccagctacttgggaggctgaggtgggagcatcgcttgagcccaggaggtgaaggctgcagtgagtatgatcacgccactgcactccagcctgggtaacagcgcaaccctgtgtgtaaaaataataattttttaaaaagattaaaaccaaaaaaaaattgtaaacagagttcaacgtaacttacagattaaaaacagtaaaatatgacagaaactgagaggtagtcatgatcagatatggcctccttcgggtgccgacatctgaactgagacctgaatgatgaaaagggccaacactgcaaaaattcagggaaggaacatttggaacagagagaacagtcaagtacagaggctcccggatgttcagggacagtaagcaatgagagaatgagaagaccagaaaactagggaggggccagatcatgtagggccttagaaagccatggtaagggtgtggtaagaagtttgggttttattccaatagcaatggggagtcacaggagggtttctggtgggtacagcaatctgctttgcactttaaaaggcttgctctggctggaggtggagaggatgaattatagagggtaggtataatcacagatataacctcagtgaggcggctggagcgagtccagaccagaccacggaggagcaggtgaagccaatggatttgggatatgttttggaggcagtgtaagcaacgcttgctgaggacctggatgtggtggtgagaatcaccccatctcgagcaacattaactgaggaaaaaattgaaaaaggggcgcccttgcttgggggcttcctattgtggaactgttatggaaaggagccccatccattgcttcctccttgaatggcaaatgcctttatgatccctataacttgtcccattatgtttagacccttggtggtcagaagggttctatttagggcagtgtcccctgcccctccttgtcctccaaaaattttgggaggcactgacgtggatgtcatggggtcagcacaggcatcaacatccccagagggatggaaccaagcagcctattgcccaggcattcactaacaggcagcccatcctcagcctcatagctggccggggagaagaaaggctattttgggtcccagatctttttttttttttttgagacagagtctcgctctgtcacccaggctgaagtgcaatggtgcggtctcagctcactacaacctccgcctcccgagttcaagagattctcctgcctcagcctcctgagtagctgggactacaggtgcgtaccaccaagcctggctaatttttgtgcttttagtagggacgtggtttcaccatgttgcccaggttggtctcaaactcctgggctcatgcagtccgcctacctcagcctcccaaagtgctgggattacaggcatgagccactgcacccggtctctgtttacaaatttatcaccagcttcatcccctaaggttataagctccatgagggtgggaagtctgtattgttcacctctgtatcctaagcatctagaacatagcccggcacacagtaggtgctgaagaacttgaatctgttaatgtagaaaggatgtttcatctagctgaagtgtcttgtacagaataaactctcaataaatgaactgtggacacatggaagggtgagctagagctctgctcaggggttgagtgctcctcttgtgcccttgtggttgtctggttacctgaactaattggagtgcgatgcagacatagtcatggagtgagacagcagaactttgctgtcttgtttgtgagcccacancaggggttctagactggctggttgacatggtggccccagcctgtctcttcagcagctcggcttataaaaaataaccaccacctactggggaaaactgctggaaccttcagattgccaaattgttcttggtgtcttttccagaaatatttgccaaactcnaattagccttcaggagatttgataaagctcatgtttaagtcaagagaccaaaagattttgatggggagaattaggggctggatatagagggaatacttaacctgtataggggcagatatggttgtccatggagattctggtgtgaaaaagtacgatggcggccgggcgcactgcctcacacctgtaatcccagcactctgggaggctgaggtgggtggatcacctgaggttgggagttcaagaccagcctgaacaacatggagaaaccccatctctactaaaaatacaaaattagctgggcgtggaggcacatgcctgtaatcctagctacttgggaggctgaggcaggagaatcgcttgaacccagggaggcagaagttgtggtaagccaagatcgtgccattgcactccagcctgggcaacaagagcgagactccgtctaaaaaataaacaaaaaagtacgatgggagaaaggggagagggcagtggggcctggaaacctcatgacaaagagaatgaacacaagagggcctgtggtcctgtagactctgtgctgtgcacatccctcatgtgagcatgggccatccagctgcaggccatggtgtgacacactctgcagattacagtctagggcttcatgttccatgtgctggaggtaaggctgggcctcttggagctttccaatagcaccaacaagctgtcagccctggaggaggcctaaacctccaagcaaggaaaggtcaagtcacagagggaggaatcactggtctccgaatgctcatgtgtttgcttttcttcacagcttgggaaacagaagaaaaaatatatgccgtacaaccaccagcacaaatacttcttcctaagtgagtgtccccatccaacacaggggagctgcctcaggagggaatgctgagggaatgaggaggatgtggctgtccaagggattatggtattttaaggaaaggggctagaggaagtaccccactcccacccccagttactccctgcatgacagcagtttgccatctcagctgagcgaagtgaagttaggctgatgattggttgaaggcaaactagttcttcccatccaaccccagtttccactgggaagctgggtgtttggggtgtagaggggcctcttgctttatcctcaaccttatctttttttttttttttttgagacggagtcttgctctgtcgcccaggccggactgcggactgcagtggcgcaatctcggctcactgcaagctctccgcttcccgggttcacgccattctcctgcctcagcctcccgagtagctgggattacaggcrcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccygcccctcaaccttatcttaaactttgtcaagatgggccaaggtaacctggtagagcccagtccaacccccagaggaacaaaggtacagatagttctggaaggatgggtcctgaggagagaatggaagagctgttagaacgaagaagatctttctgatgactgccacatattcccagctttaaaagtctgtcccagctactaaggaaactgaggtgggaccatcctttgagcccaggaatttggggctgcagtaagctccgattgtgccactgcactccagcctgggcaacagagtgagatcttgtttcttaaaacaacaacaactctgctccataatgcctaaaatgagctttaaacgcctttaaattttcaaattttttaaagaaggaagggaaggagtccactgatcttattttagtttgaaggaattcatcctaactgcctatcaccaactatcacgaatagagaaaggcgatggggcagaagggtagagcagagacctctggaagaaatagttttagaatccatggcacatcaagatggaggagccatgggtgagcattgtcatgctaggagttatgggtagcatcaggtgccacagagaagggctacagaaaaggaaatgaggaagcatgtagaatgcaacacttcttcaactcccagttttctttcaagagaggcccctctgttccgtcccacagctgacctccagggcttcagattggggtggcacaagcccatctccctagtttaaggaagtgagcttcacagcctgtgaaggatccacagggtccctcccaacacacacacactttcctgctcctgccccttcacctgcatggtggagctgccaggaacaaagggcagatgactgtagggacagggctgtggccaaggtaagtaagagagtattagcacccttttaaaagtgtgggatccttggagtgtgtatgtagaaaagagaagaaaaatgaaaaataataaaggtgtgggagcagagcaagtcccatgcgtggggcctgagttcccaagcacctgtcactgaagagtgccactcgcacccctcaccttccctggcatcctcttgggagtttttgccttccccagacttggatttatgcccaccttcagtgcctgctggttccagtggattgcagagcactcaagcacctggaggggagacagaagggatggttggaagaggcagccccctgctagaggccatctctcccaacatcaactggccctttcatgaccttcctgtgctcatgcctcctctttgtctcggtttcctccccagttgggcccccagccttgctgcctctctacttccagtggtatattttctattttgttatccagcgaaagaagtgggtggtgagtatccatggcccaagaagcccacatccttgtctccagcacccagagtgggggataggggttccccaggggaaacttgagactgactctaggcctaatttagaacaaaataatagaaccagacacagatcctccttatctctaagtgggacgaaatgatttgagcttagcaggcagcctgattcccaatgtgtaatttcatgcggtcagtgtctccagaggttcttgtactgggcataatgccagggggctgagttgggaatggggaagatgaatgagagacaatacctactttcaaggaaacttctgatgaagcagaatgtggttattaatcagaaaagaggtacaggcaataggttctggggactccaaaaggggcctgactgcacctggctttgtgaagtcacttttctagctggccttgaggctgggcagggtttctgacaggcagaggtggagcaggggggatgaactctgagcagagaagctggaaatgaggggtaagtttgaccaccagacatattgtggaggactagtgtcaggggaagagtatggtgcttggttcagtgatgagagatttgatcagggcactggcatggactgagccatggtcctggcygattcatttggcggcatgctgaaggatttagattggctaggaagagctagaggcaangagaccttgtaggccttggtacttttgaaggggacatgcaagaagggctggggggtgccaatgggaatggaagaaaggagcagtggcactagatantgcaggattggacccctgagaagctgaagatgastgagtctggataaccaggagaatggctgcaccatgcaaacaaagagctgctgagaggaagaggaagagttgttcgtgactgttatgctcgctgcttttctcactataggacttggcctggatgattaccttctacgtccgcttcttcctcacttatgtgccactattggggctgaaagccttcctgggccttttcttcatagtcaggtagtattcggtgggggcggatagggactggtgaaggaaatgttggggagtgaccagtctggtctaggggccgtgctggggctttgggtaacagtgggtgtttcaggagttggcttgggaaagtagacaggctggagcagttatctgaggggggaatcagaattctgggctctgtgtgtactgtttttgtctgtgtaatacatctaacaggttcctggaaagcaactggtttgtgtgggtgacacagatgaaccatattcccatgcacattgatcatgaccggaacatggactgggtttccacccaggtaagggacagtcactcagaagactggagcataacacaactattgaaaaggntgcgtaggtgaaaacagcaaaaacaaaaagtcccccaaacagcattttctcattagcctgaggctcttgttctgcaaccatgtgaagggagtgaccaagacagtctcatgtcccttcctcagccagctttacctggagaatgctgggctggcctttccatctgatattcaacatgctctcccctgaccttttccgccagctccaggccacatgcaatgtccacaagtctgccttcaatgactggttcagtggacacctcaacttccagattgagcaccagtgagtagggagcctggggaagcagggtcctggggagggtgtaagtgttgggtacaggtgggagcagagaagcaggaaccactgactcccccgttctccctaaagtctttttcccacgatgcctcgacacaattaccacaaagtggctcccctggtgcagtccttgtgtgccaagcatggcatagagtaccagtccaagcccctgctgtcagccttcgccgacatcatccagtgagtatctgagaccaggaagatggctagtagggagggaagagggcagggcaatggaaatgatgacatgtagggtggggagtgaacagaaggtgttcccagtcgtgtgggatggagttcaccatggcaaaggcaggattctttattggacctgtggccaggtcaggcctttgccctcattggggttcccctcagtaccatggcccaagctagctttctctaaagtagaggggaggaaaacctccagatggaagaaggccttaacctcactgctccatctccggtgggttcaactctgcttgtctccctcactgtctgcccccattttgtccctgcagctcactaaaggagtcagggcagctctggctagatgcctatcttcaccaataacaacagccaccctgcccagtctggaagaagaggaggaagactctggagccaangcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtgscttctccatcmtcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctangactgggggtcttttagctccataagcaagtgagcagatgggacaagttagtcttttctccctagaaacaaaggggatgcccagtggtttccctttgcttnccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagayacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggagktcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatcccyatgaagttgaaaaataaagttaattttgaccaaaagacttcatttgtaacccatgatgttcatctgtgtgtgcacaggattcctgagtgcctctgctacgagttactgttcacctctctgtgctcttaagwtcttgaatcactagactcccctttgtattgggcagaggaagaaacatcasgaccctccagaaaacaccaaggcaagggtgaagtatggcaaggaagagcaaggcaaagtccttctgatgactcccgtgttcaaatgtgagattgtcaataatctcaccaagtttcacacgtatcacttcctcctattcatgaggcaatgcccttgcccttttgtccttcagctttccattttgaattattttctctttatttttacacttacttgttttgagacaaggtctggctctatggcccaggctggagtgcagtggtgctgccatcttagttcactgcattctctgcctcccggcctcaagccatcttcccacctcaggctaattttttttttttttttttttttttttgagaccagagtttcactcttgctgctcaggctggagtgtagtggcgtgatctcagctgattgcagcctccgcctcctgggtccaagcaattctcctgcttcagcctcccgggtagctaggattataagcatacaccaccgcgcccagctaattttttatttttagtagagacagggtttcaccatggtggccaggctggtcttgaactcctggcctcaggtgatccacccgccttggcctcccaaagtgctgggattacaggcgtgagccactgcgcctggcctctctttacttttaaactcatttctagtttccaaatagtctccctaagtcctatctgcctaaatcttcctctgcaagtgtgatccctcagagcttgactgcagagcagtgcctcttaaccatccaactagaacagctctgagcaaaaacatttgtaggcatcattaatcttccctgcagtgtgcacacagaaagtcagattaacaaaattctataggagacaaacttaccttcaaaagacaaaagaaaaccactacattcttgaccaccacagggtataagcccttaattattaagagctactgcactgaggcaataactcctaagaaatcttaacatttcgccaggcaaggtggctcatcctgtaatcccagcactgggagagaatggcacacgtratcctagcctttaggaggccaaggcgggaggattgcttgagcccaggagtttaagaccagcctgggcaacagtgagatcccatctttacaaaaaattgaaaaatcatccaggcatggtggcctgtgcctgtaatcccagctgcttgggaggctgaggtgggagaatcacttgagcccaggaggctgaggctgcagtgagccaagatcgcactactgaactccagcctgggtgacagagcaagagactctgtctcaaaaaaaaaaaaaaaaaaagaaatcttaccgtctttagttcctatcaccattactgcagatttagaagcaatctacctgaatcagaaaatagagctcaaataagttgtgtggcttggtataatctgggaaaatcagtttcaaaagttacctgcccttgggatagaactttttgtcaacaccagttttcaaaaagtaccctagttatgaggccgttgctgggtaaactttatcccattccagcttcaaccagaggaacctgtacatcctaaagtttcacataagattacacttgaagaataggtttctccattaaaagacttgaaaactactggtcttcaggctccctacctgtttaatctgtcaagacattgccagcttaaatttcggacagttacataagtgtccctgttaacttcaaatggccctgacaggaatgctaaaacgtcagacattcaaatgggccaagctttatcaggattataaaactttcaaagctcaaaaacatgccatctctatgggaaacagtatcttggatttgatgttacaaaaggaacaagaaaatggtttctgaatggcagctttcagtttacaagtagtggcaaagtaaatgcttggatgttatgaggtagttgatctaaattgtgaggctttcttaaaggcactcctttgatctcatggagtgagagactagaaatctattcaacgtattaaaactcctctcccagcaaaataaaataaacaaaacatcctcctcctaatggctgaagttccatctagctgctatggccattttatggagcatggtgccatcttgtggccactctcaaaccacccattgttaatcaagtgcaattacagcatgttaagagtgaaaaggaaagctatttggagccatggtcacttgggatattttcaaatgttctcaaagaacatgacattttggttacttttagaattttattgacttttttcttcataactttaaaacaaaaacagcgcatgaaaaccagtgtcttattccaaagtctcaactcagctgattgccaggtgaacatcaccatcttactcctctgaataactagacacaaattacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactggccaccagttggccagccaggaaatcatttctgtacatcttttgtatcccccttttatctccctctctcttctccaaaacttgttgctatctatcactttcatgtaacaatggacttagtgtccattaaactgcctgagaagtggtttgagcctgacatattttcctgagctaaaaaaggaaaagtacctctgtggccttcttgccattaagatcaagtaaaaaagggactagcactactgaaaagggtcacgctagaaaagccttagaatcctctctccaccccgtgaaggtttctctagctgtagctcttaagggtacaagacggcaaatattctggggtgaaggaggtataatggggaaacacatttattttccccttttaaacttccctgctgccccagtctttgccttcttcttagtggatcccttgggttctggctccttgcgcttagctgaagagagtgagccggtcaccttgaagaaatcatccaggcggccctgggtgctgccttggcggctcttactcagcctcttgaccccactgcggattcgctcctcagagaactgcttttcaccacacatgaacttgatcagctcttcttcatttggctcgctccacttcagctccacagactctgggtccagcacctcaggttccaagaagagctggtgagcctccttgtggagccaattttctggcacagggtacttgttggggtcaagtcgccgcacgatctcctcgatgctcttgtgcttctggatgaggtccacagcccgcttgggcccaataccccggatactctcacagtagtcactgcctagcaggatgcacagatccacaaactgttcctggttcaggcccagctcctgcagaatccggctcaggtggaattcctggattggcagctttttggcttcactggcagtcaggtgtcgcattagcacagggctgccgaaggtgaggcagtccatgtcctcggtagccgcagcatagactttgccagccttcaccagggcagcacagctggcctctgcctcactgggtgcatcaagataagggatgcccatgaggctcagcagatgtttgcactcatcattgtgctgcttagtgaccttcaccagccgcttagtgaatttttccacctcctgctcggccccagcagcctgagcctgctgcagctgcttctctgcctcagcccgccgctcactgcgtttggccagctcgcctgacttgagctgtggcggcttgccatcaaagacatacacgggcttgatgccgttctccatcatgcgaatggtgcggtagaacatgcccatcaggtggctggtggtctcaccctcctcattctgcagcacatccccaccctggcgaacagcaatcaggaactgataaatgctcatagaggcatcaatggccaccttacggccaaagtagctcttgatgtcattctcccggatggcactgggggccacatcagcaattagtttggccaggccttgaattcccatggcaacacagaggagggatgactaaaaaagaaaggcaagtcagagacggaggaaaggagaaaggttataactggtgttatctcaccaacttcatgccttcaactaaattccacacaacaaaaaggacaccatgtcagcactgctaaagataaaaagatgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagtttcaagtctttccctttgcgttttctcgccaccactcagtctgaaatgttaactccatggctcctccccaggtcctgatttaggggtctggcatgctgtagtcactgggctcaaaagagtattgcacttcagagttcagtgtttcccagatagcagtgtttcccaaatcaccctcacgatttttgctacttccaactaaaacccgtactttcattcacttagaattttttttaaaaaactaaactggaaaactcataagcaataatatttgtgttctattagttatattttaatatgtattaaatgtataactattaaaaaggatttttagggggtgcaatttaaaatcatcttgccatcctggccaacacggtgaaaccctgtctctactaaaaatacaaaaaaaaaaaaaattagctgggtgtggtggtgtgcacctgtaatcccagctactcgggaggctgaggcaggagaatcgcttgaacccaggaggcagagaatgcagtgagccgagattgtgccgctgcactccagcctagcaagagagtgagactccgtctcaaaaaaataaaaaactcatcttgtgcccactgttggtatgtgtccaatactccaagaaatattctactggggccaggcacagaggctctgggcagtaatcccagcactttgggaggccgtggtgggaggatcacatgagcccaggagttccaggctacagtgagctatgattgtgccaccacactccagcctgggcaacagagcaagaccctgtcaagaaaagaaaagaagacaaaagaaaagagaaagaagaaacgaaagactccatcaggccttttcattgttcccactctttcttcacagggttctttctagagcatcaatgactgttcaattcttccttctaattcagtccaaacacttcagcatggcatcacgatctttcatgttctggttcccaacctaaccctacattctgggatctcaacagaaagctggaataaggcccgccttttcccacttttccttagctgtgccctcctctcgccatcctctcacgcgtccttccaggtccatccctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtcccacagacaggtaggcaggaaaggggcctaaacaactcaagtgtcagaaatgtttctcgtccaaggtcttaggaaaaatacaacacgaccccataaggtggaacttattaccgcttttctacaatggaggaaagagaggctcggagcttacgcgactggcccaaggctcacagggggaaaagtggcgggacctcttgactgcgaatcccgcgcactccagaccccggctccccacggcccccagcgccaagcggaccccgtcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctcccgtcacgtgacctgctcgccacgcacagcctcttggggcgcgtagtgcaggctgcgtcccctcagacggctgctctcatggcaaccagtccctccagggagaacagagtctctcagcgaccctggcgtacccttctccaccgcttgtccccactccacccacaccaggtccccgcaggcccctgctccctctacacccgaaatcgcaggactacaagtccctcaatgccacttgcgccggaggcacttccttttccggttgtgctaggcgcctgctcctgccgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggatttta

SEQ ID NO: 10897 - DNA, 78568 bp, Homo sapiens
  misc_feature (1)...(78568): n = A,T,C or G, or insertion/deletion polymorphism (see Tables 1-2)
aatgagtggatgggtaggtgcatgggtgaatgaacagactgagtggatgaataggtgagtggatggttgggtgggcagatgggtaggtgggtgtgcaggtgtgtagatgggtagatgggtgaaaaggtagggggaagaatgagtgtgtgggtgaatgggtggatggaacaccttcaagaggacagactctctcctctggttgttggtgtccagaaagtgcagatgaatcacactagtcagtaaatacccgttttcctttgagacatctgtgtttactctcccatagctccccagtgccccaaggagaaaaactatttgctaccatacccatcagcgagcaaacacaaataggctgcttaatgagatgcaaggatctcccaatccgctgggcatttcaggggaagtgctggtgatacccaaactaatggggattaggcagaggtggaaaaaactcccagagcttcccctaggaagctgtcagtccttgttctcctccctcttgtcatgaccaccaaactgccatcactgtcaccacctccagcatctcctctgtcaccacccccattacaaccactaccacacagatttttgagattctgactgaaaattgtgtttaccaggtaaaagataggggcttgtaggcgcccctctggcaagagagaacaactcgtctcttggtggtgggtaacattttaacccctgggttaccagcaaagccttgtggtccagctcccacttctagcctgtttggtcctgtgatccattcatgttaccttatagcaggagggacaaggaaggcagggagagaaaagttctggcagtgcagggaaagtcgctgttttcagaagcaagaaggtctgaaatcctactaggagaagccctggtgatccagagctgactccaggtgtcctgaggtccatttcacatggatttgctagaccttgcaactggctaatttctccctctgtgacagtctgcagcctagcctccagagcttttctctggcctccccagacaggctgagattgtgctatttgggtaaacaacattccccgcggttgtcagagacagacttatttacctggtagcagcagttccttcctacccacctcgtcagatgcatcaggactcagggtgggaaccagcactcatcacattcaagggtggaagacccagcatcggaggggtgggcaacagacctcacacatactacgggatccagggctgtgtattgcaaagtcacattcactgtttagctcggaggcctctctggactttctacgtctgggaataagctaggctaaagctatcatgccccagagctgtgatttcatccagttatcctataccctgcagccaagctaaaatatagtcactatatctccctcggccatgagcagatactttatactttaaaaccctgcatgctttgaattcccctgactgcttagccaaggtgtcatattggctcccactatctcaggcagtgaggaaaggtggtcactcaatccctgcctccacagggcaatacagtcaggggatggtgctcagcttaggaattctgcagttgtctttctgcaggcagctctaccctactgcagttactgaccaagccatcccatcctgcagctgctgggagctgagttggggcagggtacagctgtgccagctgtcggagatagattacactatgaagctcggctgtgactcacattccagcacaggggaaatgcgcaaaagttctatgctgtctttggggtgctaaaaatcatcctggctttgtcttgcaagatgttcggcttgcggagcatggggcagatggaggacccttccatctgggtcctccatggggaggaggcagggggcagatctgtctccagccaactgcctgtcacacaactgccacagctactaataacaacactcagcatttaatcagcccctttgtggatgcagacgctgtcacactcattaattagttaatctgcacagccccgcaggaggaagagtcatgttattatccccactgggactcagaaggaaactgaggccagagtgggaacttggcacagagcggagggagcacagcctgacagctggactgggaccagtctacgacttgtctgttctggtgccctcgctcttgtcctcctccccagctcctgtctgctcacagtgctggtgactatctccaaagacacctggccaaatgctgtcagaactgggcctgaaggtgctcagagagaaggccaggcatggctttggcgtggagaggatgcacctctggtagctggaccaggtcaggtctgtggggagtgtgtgctctggaacagccaccctttctgatatgtttcttccaaagcgtcttggaactagaaatagaagtgatgagggtgcccctctctctcatcaaaatgcctgtttcctgtgcaggcggctctgggttttgattgtgtgtctggtggttttagaatggaagggaggagcaaatccatcaggaggcaccattgtggttccactggaaactgggactggccatctggggatctttgacacacgcagacacacacacacacaccatgggtagaacccacacccccgtgaaggacctcttacatcattgtacccagtggtcgatgttgctggaagcctgctgagatgccttacagccatggctcagccctcaagaagaaggcttaggtcagtctgtcaggcaaagaatcctgactgaataagaatcgggcaggagacctgcagaacacagaaataaggcgttagaggatggaattcgctagtaccttctaggagtttgtgaccaattgcaaaaataaagactgcagtccctccctgtctttccttgcttgttactagagttgttgaagattaaatagttgaccatttccccctttaagaaaatatgaatcacaatttgaaaatgtttttgttatctttccttttcctttcacctaacatttatgtgtgtatgtatttttttgagagggagtcttgctctgtcgctggagtgtagtggcgtgatctcggctcactgcaacctccgcattccaggttcaagcgcttctcctgcctcagcctcctgagtagcttggattacaggcgcgcgccaccatacccagctaatttttatatttttagtagagacggggtttcaccatgttggtcaggctggccttgaactcctgaccttgtgatctgcttgcctcggcctcccaaagtgctgggattacaggcgtgagccaccacgctgggcctattttttttttttttttttgagacggagtctcactctgttgcccaggctggagtgcagtagcgggatctcggctcactgcaacctccacctcccgggttcaagcaactctcctgcctcagcctcccgaatagctgggattacaggtgcccatcaccatgcccagctgatttttgtatttttagtagagatggggtttcaccatgttggtcaggctggtcttgaactcctgacctcaggtgatccacccgcctcagcctcccaaagtgctgggattacaggtgtgagccaccgcacccggtcacctaacatttataatagtggtgtttctcagcctttcatgtgcattcaaatcacctgggaatcttgttgccaacctgagattcttgggcctgagattatgcattcccgttaagcttctgggtggtgccaatgtctcactctgagtagcaagagttcaaaggatttggtgatggtaaaagtaaccctttaattcagttaaatgaccagatgggatcaatcaccttgaagatcttgaaataatagtagcctcatgacatcaagtgtgaaggtgactgttggtacttgtctggtgaagacaactttggaggaatgggaagaaggactggcgtgtgtcgggacacatgtgtgcacatggacacatgtgagtttgtgtacatgggacagctaagggatggatccgtagtagacagcctttttttttttttttttttgagatggagtctggctctcttgcccaggctagagtgcaatggcacgatctcggctcactgcaacctctgcctcccacgttcaagtgattcttccgcctcagcctcccgagtagctgggattacaggcacctgccatcatgccaggctaatttttgtactttggtagagatagggtttcaccatgttggccagactggtctcgaactcctgacctcaggtgatccacctgcctctgcctcccaaagtgctgggattacaggcatgagccaccgcccctggccgacagtctttggactggctgttcaggtcatgattctcctcctctgggagtgtctctcaacggggaaaagtggactgacatgtttgtatcacaaagcactttctgccctggccatagctgattgaccgtggcctgatctggactaataagattctttttttctgggaatcgggaactttgaaccaagagacatccaatctggcagttttgattctgattaatggcaatgatctagaaagaagatccctaaactgatactgctacagttgtcccttaaagcctcccctgatctctgcccttcctgagccttgaggaattcaactcctccttgaatcccctgaggtgccccactgggtatatgcgcccactcctcattttccttgttacctacgtgagtttgctttctaaataatcacaggtaacacagaactccttccagaagtggctccatctgcttcaataaaaggcagtcctggcctcacagtctcatttccaacccaaatgtccacgtaattttcagaccgaggcttctgctcaagccgggcaccccactacccacacctccttgttcacctatggctcccacttctactgaactgcgcgatcactgtgattttgggggtggcaacagggcctaggaaacattttagaggcacttctcttgcctgaaagaaaacgttcttcccctttttgtctctgatgaatctttactggatctttgggacccagctgagtcatcccgacctgcagactggactcccatccccaggcttaaattcctttccaagggctctgtctgtcctctcggcttagcttctgtgttaaaaccccctccatctgcgtctcctccccagcagaatgagctccttgaagtcagggcccgccttctgctcctctctgtgctccactcccccagttcagcacagtgctcccagggaggtgtaagcgacttacggtgaatgaaagggcgtgaaggggaacaggaggggcggttttcttcatttaccagaaattcaaaattgaccaagtaaacccctttggagaccaggcacgatgctgggcactgggaacgggggtaggggtggggggtgggggggtggtagggaggagggggtaccagggtaccacgggctctgtcgcccgtggggaaggatgggcatttacccttcccattcatcaggatgggagggccacggactccccccacggcagtgccgggtagacccctgcaccacaccgtgccaaggccctttctcacagtcacgccaggaactctagccatgctctgacttctcaagcagagttcagtcaccccgaggaggtgggacccgtctctctcctccccacaaatgaaccagttctccagtgatcctacttccttttttccctctcccacgctaaaactggtcacgagggacctaaaggaggggcaggcacccaggcggctcccttccccgcacgcatcgcggccagtccagcccctcccggccgcccacgggaccccagccgagcctgagccaggcgcccaccgcccccacgcgcagggccggcgcccgcggaagactcggctctccctggcctcgacgccgctcccctccctggcgccagggggcgctgcctccccacgaccgtcgccatggtcaccgctggcggcggagaggggtttacgtaaaggacgcagcgtcccccggggggcggaggcggccttcgcgccggcgccggcgccctgcggaagcggcgttagtgaatcggggccttggggagcccaggatggaggtggcggtcgcggcggcgggccgagccctgcggcgggcgggaggtaaggggggcctccggcgcggcgggccggtcctgggcgcgggcgcggtgcgagcggcgcggcgggctgggcagtgtccagggcgcgcggtggccggcccgacgggtcggcgggcggagttgcagctgccacgcgcgcccgtggcaggtgtgaggtctgtggagcccctggcaccagcgtggggatggtgacacgcgtggcacgggcgtgggcaacgtgggtccggcacaggcggcgtggttttcctggaacgggtctcagaagactcgcctccaccttggtgcggtggtggccacgcaggtgtgaggtggtgcagctgtctgcacaggtaggtgatgggcacggccttcggactggttatgggataggtggccagctcgtgccggcatggtggtgccgctagcatgrgtgtgaggaagtgctgccattgcttgggtgttgggatggttctggccttgggcttgacatgatctggggtgatagcactgggggcttgaagaattggtgttctcagcatggctagagttcctggcatgactgtgagaaagggccttggcacggtgtggtgcggggggctacccggcactgccgcggggggagtccgtggccctcccatcctgatgaatgggaagggtaaatgcccatccttcctcacgggcgatgaaggggacactgcctctgtcatgggggtccagttttaatgcctgttgggtacactggactgaggagggcagaaggctgggagaaggttggtgtcctttataatgggcataaacaagagatgccaggagaagcttctaccacaagggccctgatggtaacccagatagagaccttccaggcactaccgttgtcctgggctaaggtagagagaaccattcatctagcttttcatctagctttgggaatgaagggaggggtggatgattttcagtggtgatcggtgtcccagaatatgtcctgagaagcaagcaggaccaagaggtaacccgggtcagcgagtgagggagtggtatggcgcaccatctatctgtagtcacggggtcctgccttctccctgggttgatgggttcactccagggtatctgggagttgcctctcttctttgatgctggggagcctttgggtccagaggattggatcgattggggtatgcttgaaagatgattctgcagccactgggaatctgctggggccaccgggactcccacccccaggcttaaattcctttccaagggctctgtctgtcctctctgcttagctcctatgttaaaacccctccatctgcgctgagattgtgtttgctctcaccagtcctttgggaagctttgggtgaaggtctcactcagcatcacctagtgccttactttacagagaagcaatttgcagctcctcctagagaagtcttacagtgtaggggaaatcttcagttctttgtggatctcttgggggagtgggatcagtggtagaagaatcacagggttgagcttgtgctggggaaggcacttatgagtccaaaaagatgatgttgagggtagggtggcaggtggtcgccaaattgccaaggtgggtgcttggagatgctgatgagttccctataaccggagcactgtccgatgcctttggagccatatcactttaattccagtgttggctgtgtgaccttcagcaggtgacttcaccaatcaaggcatgtcacatggtggtctggtagtaaagaatgaaaggaaatggtgcacgtggaaacactttgcaaacagcgaaagactgtacaaaggtcagagagtctcatcaagtaaagagaccagggctggaggcaggagccataggaaatggtggcacgggatgtgattgggaggaagggagccggaaggttgagggcctgtcatagggaattagaggccctgagcgcacatgctcccggtgggggcaagtgggatctgttgacactgtgagtcagctgctgagctggaaccaggcccccggtctccagaggacagtcctgagcatggccccggcagctgtgaagtcctgcaggagtggcccaagcaggaggaagcactttgcttgggcagcagacgtgcctcattgccagggtaggtctgggaggtgtctgtggctgacagatctagggtacctgtgtgggaggaagacttgggaagtgtgtgtgttttctctggagaatttcctttggctctgggttctgagaacgggggtggggagcagtcacatcagcgtcttttgggctgtggcctgaaggaaatgaagtgggtcagagcatccacagatcgatgtggctcaggtctggatggttctgcgggaggttgaggctggatggcagggggacgggggggggaggtgtggaggatgccctcagacacataggggaaaggaaagggggctacaggcacctctgagggcagacaggtgtggcacctctcccaatgtggccccacttctggctgaagtgccttcccaggtggggaggatgagggtggctgcacagtgctttgctctctgccaccaggagcctaattcccgacaacaagctgcagagcctgagttgcagaccctgccccatggcgctggaagtcctgtttttctctcacccaggccgtttcttcagcattccatgcgggtgtctgccttagccagcaacctgtttcacatccttgctccccgaggaaagtttttgccctgtgcccaggctgcagtgtcaagccatgtgggtggaaggaggacacggccctcccagacccagggttgtgagctgacttttccatgctatggactcgccctgtccccgtagctgccacgcagacactgtccagcattgcaggtgcttccctggtcattcccatgttggtctgaggggtatccatggcctgtctcacccgctccctgcagtgcttcatacctcccccgaggagttgctgggcacttcagctcatgtctggaaagctctcttaagtgcagagtccattaaggaggaagcctacagcctccctgttgtgaatattcagtattcaagtctcctcagctcaccctccacacctcctcctgtttgttctgatttgtggctcagccttatggtttggggctccaggagcccttttcagccaccctttgccttctgcttgggatgctgggactgcccaccagagctgagtggcaggcagggcagatctgaagacactgagaggaggagttggcctctgttccccaaaaggagagctgagctttcttcccagtcctggggttttggggtagcagggagcccagccaggttagcacccttgtcattgtgcacagatgctgatttcgagtaagttccagctgaggcagggggccagtcacttaggagtggacctcgagggcaagcagctccctggagctacaatatttcaactctggtccccagtcatattcccattttccttgtccatgtttctctaaaagttgctttcctcagctcctggcaattcctcagctgccccataaatcacagtgcctggctgctgtgctttaggggtgccggggagccaggcatctgtggccagaggatgctggaccagagctgacagcagcgggccagaaggctgcagctgaaggcacagcttgtcactggaagccactcctcccccagtccctctcctcgagaccagaggggaacctcagtgtttaatcacctgttggcccatcactctgtgatttcaatttctcaccggaatagctttacattacactccagtggactgggcaagtagcgctgggggaaatatcaatgagcatgtggtcagaggaagataaatcttttagaaccgcggagcccaggacattgcaggatgcggttacctccccagcggatagggctgaaaatggtttattttgattttctttttttgtttctgatactgacttgggctgggcgtggtctttctgggttggatgggaagcgtgagtgtgggtgtggacgtgggttgtgtgtgtgggcaggaaagacccaggaaactgccttatctgtgaggacctctttgctgctgaggaaggagtccagggagatgccgtggaggggattggtgtgaccacgggtaagggtgttttcatggggtgtttggcaggaacgcctaagtcctctagatggggatggggctgttattaccgcggggctgcccggggagtgcacgtgtgtaaagttgcttgtgcccataagtgtttctgtgggaagtgagggcggagggggtgtggagcgcctggtggtgtgggagcgcgcaggctcccgtgtctggctggcctggtgttggtgggtgtgcggagctgggggttgccgggctcttcacagcaggagggaacagtgggagtcggaggaggctgccttcaggctgtgggagggcagagggtgggtttcatacctcatgttatgactctttacatgaggagccgagtgctttctcagtattccttagaaggaagctgggctgcaggcggggctctcacacacccttctgtgtgctacctgggggcgtctcacacgcctgcttccatgctcctccttgaaccacctggaagtcagctggggacagtcccctcccccccatgacagaagatagcattgtagcccatgggtagttatgacttcagactctggaacctcacggacccagattggatgctggcacacctcagtttcctaatctgtaagatggggacagtaaaacctccgagagccgaatggcaagaattctcccaggtaatgcctggtgcgtagagagatcctgatgaaaacacgcactgaaaaaatgtttttgctcttgcggccggaatcctttccatagagaagtggttatgtcgtgatctgcatatattagcagtagggaagatgtaatgggtctcattacttgataagaagttagctccccacatccttgggatagacagaatcttgcatatctgttagcagtgtcatcagcaagagtatatcttagccttgaggaatgtttccacttggacatagtcgatagttatttcttgagcgcctgctgtgagttgggggttagtgagggcatgcagatgaggtggtcataccagagcctataaggtgtagattctgacctcaagttgcttaaaatctgttgagaagatatagttaatttctagaaatgagtgatgccagaggtcaaaggagggagagtgactcgagccagggaggttggggagactcgggtggccacggcctttttatgtgggccatgggtaccggtgggagtgaacaaaggaaggtgcttgtagaggaactggcagcaacgggggcgggttggcggggtgactggtggctgggaggggaaactgctgcccgtctgttgtgtgctgtagggcgcatacaacagaagtggtgaaagctaagattggaaaaatgagctggagctgggtccccaggagccatgatggcagggctgaaggtttggtttccaatctgtgaacgcatgggcattcactgaagtgttctgagcaagggtttggaggctggtgccacccaccaggaagagtggtatggcagcagggtactgagggacaagagtagggggtgcccaggtacagagggcttgaaccagggcagtggccactctgcaggggaaaggggagagacaaagcctggttgattatggaagggagacagaaatcatgagattggtcagtgtggtcactaggaggggaaggggtgggaagtggggccaggaagctgagctgggcctcggaatcgctgcctagaatgtgttgcccacacttgactttcagcgggtctgactcccgtcagtgctgggcgggagtgtgaacggcaggctttcagggctgccctcgaggccgttcccatccctgaggacccactgagggggttccagtgttcacagcacttatttccaggcatttgatcattttctcaccaaattaccccttgaaatttcgcctgcctgagttcagcccaggaggttactattctgggaagtttcatcaaaaccttttcagtgtttgggagttctctgagcctggaggaggatggaggagaacagggcttgccctcacctgtgtttgggggctgctcctgcaaaccagtcctacacctggagacggtcctggccagggagcctgcggctctggggtggaggtcgggacggtggccctccgctgtgtaaggtgagacaggatgctgcctcgrattcatcctgaatgggcccctcgtcattgtctctcctggagccatttaattaattgatgattgatgttcctggacttccttgaggttaatctattattgatgtcccttcgtttatataacatatgctgcacctcccagcccctggctgctcctgatgggcaggccacaccgtggagtgggctccctggggctgcacctctgtctcctggggacagggccctgcacttagctttctcaaagcctttcaggtttggggtcagggagggcaccagggcgtgtctttaggaggctttgctcagccacaaaataatactagtaacaataacttccattttctgaatgtggatgaactgaacccaggagagtgtatagaggatgtcatttactccttgcaacagcaaccccctgcacgctcccatccctccaacctccatcttacgggcggcttagggagcttgcatcacctgctcagggacactcagagaggcagggagccagggtttgaacccaggatgggttctttttggtgtccctgtccatacgccacctctccctcaggtcccacacaatcccacctcctccatgaggccattctccatgctccactgactctagcactcttttttttttttgagacggagtctcgctctgtcactcaggctggagtgcagtggtgtgatctcagctcactgcaacctccgcctcctggttcaagtgattctcatgcctcagcctccctagtagctaggattacaggcacgtgccaccacgtccggctgatttttgttttagtacagatggggtttcaccatgttggccaggctggtcttgaactcctgacctcaggtgatccacccgcctcgctcggcctcccaaagtgttgggcttacaggcatgagccaccgcrcctggccaaacaaaggcatcttgtagcactctcttatctgaatagcgctggcgcccctcagagagagcatgtgtgttcccctcactgatctgtgtcctcactgaagcataacaatcatggcgaaataacatttagggagcacaggtgccaggcaccaagctcagtactttttgtatcttctctcatttaatcctcatgaccataacaaggagcatgggactgctgggcctggagtgttcctggctctgctgggcagctgtgaacaagtcacttttcttttgttagcctcagttgccctgtctgtataatagcagcaatgatatttgtcctgtctccctcactgttcaaaggtgacactggatgggaaaggcctttgggaaagacattgtactaacaaaggattagggatggctgggtgcggtggctcacacctgtaatcccagcactttgggagaccgaggcgggcgggtcacgaggtcaggagatcgagaccatcctggctaacatggtgaaaccccgtctcactaaaaatataaaaaattagccgggcatggtggtgggtgcctgtagtcccagctacttgggaggctgaggcaggagaatggcgtgaatccgggaggcggagcttgcagtgagccgagatcgtgccactgcactccagcctgggtgacagagcaaaactctgtctcaaaaaaaaaaaaaaaaaaaggattaggattgctcgtacatgagattcaagagctggcatgaaggctgggaatacttaaggctgggcacataaacccaagccaaggcatctgcacccaccctctaagccaccccagcccggcagatgaattctgcagcttgccagctgccaagaacttgcttgaggaacctgtgtggccaggagtggggcgggagatccttagagtggctgccaggccctggtctgttgtcctggctggatgagcagtgcctgggtccttggaggcggtccctcccactctgggcgcctggattttgtggaagtgcagggggcccgtggggggttctgggccctgcttcctctcccatctcccacatgcagcctaactaggtcagttcaggctgggtgtggggaggaaggaggatagctcgccaggcagccacccagacctcccctcacccctcaacacatgcggaaagccttgtgaggaggtgagccctgtgtctgttccggaaagcgacggggccaccagcctcacagtggcaaggctcccggggcactggctgggaatcctctgctttctcatcagctttactcggagcgcatttcagtgctgggctggggctggggaagatgacacrtgctgccagggcctgaagaaaagggcagagcccttggacttgtgggtgggggcaaggcatgcctgccatcgctcattggaaattgtggccaggctactgttaggggatgttttgtttcacttcccaagtttccgccttctgcgggccgggattacatcaggctcccctggcacgccctttagccaactcccacttcatccaagctcctccactgccctgggacagctgccccgctgcagttttggggcaggctgcagaatcactgcgcagccctaggcccagtggctaaggggactgtcctggccttttcagcctcatctgcagaggctgggaactcccagtgccctgcctcccagttagcacctgcccacttcacccactcgagtctgcctggtctccaagattatccacttctgattcattctctctccctctttaaattcagcatagcacaggccttcagacatgggctttagcataaagacagagctttatatgagaccactactacttgtgcaagtcacttgacctgtttgagcctcagtttcctcatcttttttttttttttgagatggagtcttgctctgttgcccaggctggagtgcagtggtgtgatctgggctcactgcaagctctacctcctgggttcacgccattctcctgcctcagactcccaagtagctgggactacaggtgcctgccaccacgcccggctaattttttgtatttttagtagagacagggtttcaccgtgttagccaggatggtctcgatctcctgacctcgtgatccatccacctcggcctcccaaagtgctgggtttacaggagtgagccactgtgcctggcctcttttggtactgcttctatccactgccttttctttgtctaacttttcctctctgaggcctttaggggaagccagtttcttcctcagattctctgagtctccccgcacaaagcccctcagccctttcagctgccctcctaagagttgggggatcatgacttggcctcacagaattccatgccatcctctctggtctgggcagcctctccagggcaatgggagtgcagcccaccgggtctgcagagccccagctgaggcctgagcttccaggcaccgcaaactctcctgggctgcagggccagagtcagccccagtgcacccccagggccagaacaccagccgtatccaagtctctttccccctaggaacttaaggaatttttcttaagggttgtttcagtttcatacctttgaaaagaacttgcttctcctttgacaccttcgctgggactggggccagaccgkggagcagataatagttttgccacgtgtagtctcccatytccccatttattcaaggacatttattgagcacctacttgccaagccttgtgcctggagctgggaataatggtatcacttygtcctgagggagttcctgggttggcataagcggacactaccactctaccagcagccacaatggcaaaagctatgtggtgagtcctctctgctacacagtgctttatgtgtagggacacatttaatgcaatgaacagtgatggcttccattttctagacactcacccctctaggctctgtgctcaggacagtcccatggcacccatggaggaagcactcgtttcacagcaggggtccaagtctaggacctcagcttccttggggaattgagggaatctgttagaggctgcgtgtttgtagctgggactcaggttccgtctgtctggcccctgctctcagggtgtgcacattcccctcacctggcatggggtttggggattctgtgagccacgggaggaacagccgcccacaaaaggaaggccccctttggctatcctcttgctgcgaaggccaggccccgctcccaggaagccctcgccgctccccacatgtagacccatctgtggcttgcaccaccttgttactcccactgttgtccaaccgaccttcaccgaccctgtacctcgccggccgtggcaggcggctttcaggctcgcacagcatggctcctctcaycccacacgcccctgccagtgccactccagattgttctctttgctgcctgcctgctacaccatgcagtttagaacacagcctaatggagggctcggggcacctgagcagctgcctgctccatttcttcrcccctttaatccctcccttccccaggtgaaccctattcagcaggcttccggcagcaataacaaagctgggcacccagcccaccagctgctcagtgctttataaaagtttaaccttaatggtgtaatgaactcccatcataaagcagctggagcagtgcatcctgggatgtataaattataggaaccctctgaaattgtaattggaaatggcaacaacaagaaggttgaaagtggctggcctcattgggctgagcacagctattctctgtctcctttcaaaaggcacacaaaactgagtctggctgtgaagaaagaatatcctcagcccaaatcgagctcctggttcttccgcccgagttcccacttcctgcctccaactgtgtctgcagagcctgcagcctttggaggtgggacccyccccaacccaacctggccctgtgctctggctctgtgcccgcagacagagtgggctgagagggaacaaacacagccacaggggcaggctccaccatgctccagggagcgctttggagcagttgatttgacctcctcgagtctccataaagtggagtgaacccaccttggagtgctggtggtgattgaatgggaaaccgcagggggtgttgggatgtagggttgagaactcaggccagacggtctggctgcctgttgcagctcctgctgggggtagtcttgagtccttaaccaggtcctttcacctctcagctgcagtttccacctgtaaaatcagggaataattggcctctgaggagtgttaggaggtgacatgagatgatgctggcttgtgacagactcagcatcgtgcttctttgatgggcacacagatcactggggagcttgccaacrcagattccagtttaggctggctgggcccagatgtgcatttctaacaactcccaataatgctgctgctgcaggccctggagcacacctcaccttgagtctggagggcagtgtttgacccatagtcagtgcattagagcctgctgtgatcgtacgtccaggcagaacccagggcctgcacaggtgcccacgtggcccatgagccggcagcttcagcatcacctgggaccaggttagaaatgcagcatctcagcatcccttcaccaccaccctcctccacatcagaatcgctgggaggggagcctgcagccagctctggaagttctgcttatgcacacttgagcagtcctggccaggactcatccttcagagcaggatttctgagtgtagattggttaactccagcctcagagtctcctggggttggccatggtagaacttggaacctaaaaatataggttcctgagccctgccttgggcttactgattcagaattgctgggcggggcctgggagtctgcataagtttgagagttactggcgaccactcattgcctgagagatgggaagaagggcagaatccccgctccccactcccaccctttatgcataaacctttgcatctgccagggggagaaggaacaccaggctggggtcaggagttccgggttcctgcaggatcctgtcaccaaagcccaggaccccagagccactctgcctggggcccagctgtggggttttctcacaccgagaagagggaaacaacccaacatccccgagtagagagttggttgaatgaacttccgtacatcttgtatgtggactactccacaataatgaggaaagatggcggtaggaaaatgtttaaggagaagtgctcaccttttagttcagtaaaaaaaaaaayggtagatgccgaatggtcccacaattagatggaggaaaaaaaagactagaaggatgttaatagttgatagttttcctagagggatcatgggtgatttatattttcttctttttggtttctattttttttttttttggtgagattgagtctcactctgttgcccaggctggagtgcagtggtgcggtctgccttctcagttcaagccattctcctgccttagcctcgcaaatatctgggactgtaggtgcccgccaccacatctggctaatttttgtatttttagtacagacggggtttcaccatgttggccaggctggtctcgaactcctggacctcaggtgatccagcctcccaaagtactgggattacagatatgagccactgcacccagctagtttctattttctatagagaacttgtatttttgtaataaaaagataagtctttttctttttctttcttttttttttttgacatggagtcttactctgttgtccaggccagagtgcagtggtgcaatcttggcttactgcaatctctgcctcctgggtttaagcgattctcctgcctcagcctccagagtagctgggactacaggcgcccaccaccatgcccagctaatttttgtatttttagtggagaccgggtttcaccatattggccaggctggtctcgatctcctgatcttgtggtccgcctccctcggcctcccaaagtgctgggattacaggcatgagccaccatgcccggccaaagataagtctttttcttatgcataagtcagcgtgtctggtctggggtccccggtcacagtgcacctgccctgcctgaggtgaggctcctgcagccaggggcagcccagactcccccactggggtgactttcaccatcgcctccctcacctccagggtatggctgatgatccccagggcttcacaccgcttctcccgctttcttacttcctctctgctttgagtcttccctgatgatgcccagcactcctcccattttacataagaggagagggtggggaggggacagctgagaggtgggaagcccccagcttgcaaacctctgaggccaagtttagtttggcatcacctaggtgactaaatctaaattccagagtctaggcacataggatatgctcggagagtaatggctgcatgaatgaggctgggaaggcagccaaggatggggcagaggcccaaagctgtgtgaccttggcacgtcagcattcctctatgagcttagggtactcatctgtaggattcggggaatcagggaggcgtggcatctgagttccctgggcctctccagctctgaacttctggggactgtcacatgtcttcagtcctgcttccttgcctgtttttttctaagcaatttttgctgcccaagaagacctcacctgtgtgttccagctacccagtgagtttgcgcgtaaatggctgctcagggcagggctctccagtcaagggcttgagcaaggccactgctgtccccacagccaggcttccatgctgtggcaggaggaagggagaccaatgctgggacatgagagcgatccaccacccatagcagagggccggggtgcctgggtgtgcttggacctgacattggcctcacgtgcaccctttgtgcctctgcgccggctgcctgtcagttgtcaggtgtctgcctttcatcctttcctggccaaagctgcctttattcaagtgccccctgccaggctttgtgtctgataccccatttccggcagccctgaatctgtggccctttgagctgctgttttccatcgagtggctccgtggggaggaagggtgggagaaatccattcaagtcatttgttttaaagacattgaagtaaacccatgggattcatgcggtcacatgttttcagtcttctttcaaagtaatagttgggtttctggatcgctcgcattacccacttccctgcctgggaagagcgagaggcctggtcttcaggaagaaccatggagaggggaagcctggaagataaaagctgggggcctggcaaaaccyaaacatgtgcangtctccccgccagtggaggggctctgcctggggagcaccaagcacctgtgttctggtgattccaggaagcagccccacgggccctctctgtgtactcgcaagcgtgtttttcctagcccagggagcctgcagaaactacctttgccagcaactgagaggcagggttgggagctaaagtggtgcccagcctccctgctggctggaatctggccctgcacaaggtgcatctgcccacaggctctggggaaccgggtgggaggaggggcaagaggaggggagccagctttgctttccccgctctttctgttcaaccatcaggcacctctaggaagctttctctgtctgcctggggctgagcagtggtccaggcatcagtgtcggagctctgtgctcactgacccgccccggtttccttgttattctgcactgtgagctacttgaggatagggcttggcatcctcgagttcatgtccccagaagctcctgcctaagggcctgctgagtccaacccactcccacttcccagcggggaggagcagtgggagcttcttgtctgggagctttcaggtcctaggtccactctctggccctggtctgagcctcccaccccgctccagccaactggtctggcgagtttgtggggacctggccacaggcgcttctccagggacagaatgtcctgctgtaaggaggctttgtgcctggctttctgttcttcttggctcctctttgctcctcctctctctctttcatcccagggagggtactgacttctggcttaagtctgctctctatcttgcctttttggggtccaggacagcatatagtgggggtgctgggctcaggcagagcagtggccttgcctggaaggagggcaggggcagggcccttcaggaatgaggtagggtgtgcatccctgcgtgccccggtgagaccctggaaagccagatacccagagtgtggntgacaggctccgggccagagcccaggggctgtggtgaccgttctcccacctccttccccgctgatgttcaagggtgagggaccagaggcccaaagacggcagcctgcggaggcctcgctccaggactccgcccccactgagactcctccctgtccccaccaccaggcttgctctcagggagcaggaaatgagagtgggggagcctgggtgttcctctcaccctctgcgggaggggctgggcaccccgttccgtaggtgtcagcggaaccgtcaccagcggtgggcgccagtgccgggatttccctggctgactcaccctcggcctggctgtgcctcagcctaggcatgagttctctgtgaaggtgtctggatagtgacagcgattcccatggagtcctgggagcgggagagtgggggtggaggtgcccactaccctggctgcctgccttccactcccagtggacctgacgcccagccgtccgtccgtcaaggacaccacccccacttcccagcggggaggagcagtggggccggggcgctccctgaaagatccctccaggggccacatgcctcccctccccttcccctgtgggagaggcaggagaatagggaagccattgattccctccatccctcccagagtaagaggcatttcacagactgggcgacccggggttgggggtggggtggggtggggtggggagctgtgagaggcaggaagtggggtcagcacccggatccaaagaccccttggagaaaaggggaaaactgtagtcccttcccctagcaaggtttgcgtgaagcacatctttgggccatcccagcctccttggcagcgagcaggcagcggcaggcactgtcagtggggtggaggtgttgcaattacsgtgtgtagggggctgggggaggactgagcagacagaaatgtggagtgtgcggcttgtgagctggcctgtgggggcagtggcagcagagctgcgtggggtgggatgggaggtgtggatctgggtggtttgccccaagatcctcaccttcctatcgccaaggggagggaggtcacccatgacctccctgggatggcatagcaggggatggtagcctctggggactggcctgccagggctgagggcacagggcgacattcaggaccctggcatggttcggtcttggcaggcagacttctcagccccctacctgctcacctggccagtgagaaatgaagcggtttctgtgccccagtgccatggacagctccagtgactctgatgaggctgttggctgtgcaaattcctttgtgggtagccccagggtaaggtggccctggaaaggaatgtggttggtaggcccaaccctayccagcctcctgagcttggcccgctgctgtggtcaggagcatagaagccgggccagggcgagggaaggcctggcctaaactgagatgggccctccaggcaaggccagcattacctcagtcctcggaaatgcatcgctctgcttgggggaatggccacacgtggctgagccccaggtggtgccaaggacaggaggacagcagccattcctgcgcaggagcacaccaaggccccaggagcctgggctgtggggcagggttccaggttctgctcccagcctgctgctgacctcgatgtggcctggggcagctgtctacatccttcctcaccttcctccctcaaatgagcatttgtgactcagtggctcagaggttccttcccactcagatattctcctgtttttttttatttttattatttttttattttttagacagggtcttgctctgtcacccagcctggagtgccgtggtacaatcatagctcagtgcactcactgcagcctcgaattcctgggctcaagtgatcctcccatctcagcctcccaagcagctgggactacaggcatgccctgccatgcccagctaatttcctcctgtgatggccctgggtagccaggtgtctctgcagtgaggagcagtgccagggccctttcttggaccctccatttcctcctcccctgggagtcatggggcaaagtgagataatgactggaagttcccagtaccaggtcttctggcagctagttgggctctcagtgagcaatggctggtactactgcccttatcacccttatgtttacattatcatcagccttattgtggagttgccttctcagagcctgttgggggctccctggaaaaggcagtgtgactcttgtcctgggctggcatcctggcccccagtctgctcaagaatcagaaggtcagactgggccagccagagggtcagggcaggcaggcagggtccctgacatctctcctgtggtgcctctgcagcttggctgagctgcaggctcccatctgcagaggggcggcccagctctctgcaagttggctgggagacctcagaatgaggagcgcatgttctccaaacatcttgctcacagcagatggcagccacaactgcctttctctctgcagttccggtgcacttccctttcctttgctcacccccctgctaactttggtttctgcttttggagatggggaggcagcctgcaagcctccagagccacttctgatagtgggtgaagcttggtgcacgtagcacggacagtttccaaaggaaaggaaacctcgtaccccacctgcttccctggggaagctcactcttaccctgcttcccacatgccatctctgagtctctttggccaaatgtgccggcagcatgatctgagaggagcaagggagctggcccgggggccttgtctgacatttcttgagcagctgctaggcaccaggcgtggtgctgggtgccaaggacacagagatgcagagtgtagccctgccctcctggagctcccancccagtggggagcccggaatggagggggcactgattaggtctgcccttgggggttggcgggccctggcagcttcacagaggaggttgtgtttaggctgagctttggaacactgaggagttcccaggggagcaggattggaaaaggccttttgggcaaagagaacagactgtgcaagggcacagaggcatgcagaccgcctgcagagcacgctcaactgtggtgcacagcagagcagagaaagcaggacatgctatgcaccctcagaaagacagggcctcctctggctgcgtatgggtgggggccagcctgaagctgaagccctggatgggagccattgggggaacaggcctttctcagttggggggaattctgccctgagtttggggccagtagacgcagcagcccctgctggtagaatagaactggaccatccttccctcctggctggccctgcagccacaggccagaagtctggtgttggccttactgccctggagctaaggccagggggtcacagatcagccaggtgagcatgccctgggagagtgtgtgggccagacctccatggcactgcctctcctactgcgacctgccctggctccaccccacacccacaggtggcactaagctgagcacccacatatccagaccctcttctgtgccaaatcctttctcagtggtcccacatgggcctcatcccatttaaccttcacaaaggccatgtgcrgtgggcatccctggccctgaggtcctttgacttgctccaagtcacccagccaaggcrtggcccagcagagactccaggcctaggtccgcctcaccctttgcagactcatgccttgcctgttcttccctgcgctgcttctgtcacctcacagtcaggcccctccggggagtacagtggagggaaggccaaagcattcatcctggaagaccctccaaatactgtaggcagagtgctggggacaccaatggcagctgtgggcagggccacccgaatgccaccccatagggcagcgggcccacagcatggaggccctccgtgtttgcttttcccagccctgcattagctgtgctgctcacacctggctgactgtttgcccaaggatttctcccctggaaggagggtggggctggggagggtggcaggcaggtggccggctgcctctgggcactccgtttttctgcagacccacactgcctgcgaatgccacaccaccctgcatccccaaggctgccccagcagtgcccggcctcgcccgcgcagagcatgtgacttggcagtgcctgggcctggcatgcctggcgtgccagggcagcggcagcagcagccgractgtcagtaaggagctggagaggcccccagagccctcctgttggggcactggtcctgggttgtgggggtgacgggatgcatcagtgagacttttgtatggcaggaggcagaggagcacataactgaatctgggagtatttatggacacgtctgcgccttccttttctgcagcagcctgtctgcaggccctcctgcaaggagagcctgtcttgattcaaccagtccctgccctgaccttctcttcaccctctttctgatgagtcagccccaggaacttgaacttggacttctccagcctctgggccagccctggaggcggaagccctggacctgcctccccaacacctgccctcctgagggtgtggcctgcaagcgtccttttctgtcagattcagctcatggccagtgactccttgagcctgtgatcgtggtcctcaggccaaggggaacagattagataattagctgctgatggatctggcatcctagggaagagggagccctttctctcccacagctgggaccccaaagagaggcttgcattagccaggcaaggagccgggtgcctccctccctgcagtcctgcacagccccttccttctcttgctgctgtgggtatctgcctaaggagagctggcccagcatacccacctgggacacacccagagagtgccagcctgaacggcactgccaatagcccgatcctcaggcctttcaccctgcacctccctgctcctccagcaacgagaccccctgcatgtcactcacatgtggccccgggccaggcacttggccacctcacagtgagcgatgctgggaggctggtgttcttgcaatcccactgacaggtgaggaaatctgatttgtgtcatgctttctccagcatcgctcagatgttgttcatcccctttttcccggaaccggggcccaaagaggttgtgacttgcccacacctcttgaatggccaggccccatgtccagcctggattctctgacaccaagccccatgtgttttccactgtgccctgcagtaaacagaagtgctaataaagaagcgtgctaatacataattaatcccacctccatcccttgggccttttctctctcagacgccctgagcaccgcccagacgtgatctcatgtgtcctaccaaggccccagaagagcagagaggaggctgggctctgaggggccatggggactaggagccagcctctccgctgccaggcccagccctactgcatgcctgctgcccgcctctccctctgctctaggtagggaagctgccgaggctcgggcatgtctcaggcacctgctgtcttcctctggtctcgtggattgtacgaacctggaggaggaaagcagccgggattcgatgagcccccatgtggtggggatgtgtgcgcgcaggggcccaaggctctgcttaaagggaaggagtattgctgaggcttgttctagtgccttcctctaaggaaccctcagtatatcttgtttgttctcacattcgagggaagttggcaaagggcagttctgtgtcacagggaagggggtggatgaggaccccgaaaacmtgccctttaccgagtctcacccccgagcctgctgaggtcacacagcggcagtcagtggggggttaggttttcttgttttgtttttagagacagggttttgctctgtcacccaggcttcaatgtagttttgcaatcacagctcacagcagcctggaactccccagctcaagtgatcctcctgcttcagcctcctgagtagctaggactacaggcatgtgccaccatgcccagataaatttttttttttttaataaagacaggttccccgtatgttgcccaaactattctcaaactyctggcctcaagtaattctcctgcgtcagctgcctgagtagctgggactataagcatgcaccaccacatctggctaaattaaaaaaaattttttttgtaaaaatgggttcttactagtttcgaactcctggcctcagtgatcctccagcctcggcctcccaaagcattgggattacaggtgtgagcccccacagctagcccatgttaggttctctctctctttctctctctctctgtctttaactctgataattacaagctgaacatgttaggtttcgaacttagttctgacagatttcaaaagtggggatcatcaaagcactgggccatggtgtgcaaattcctggcctctctacctccaggacaatgttggggcccagaagaaagtgggtgagaaagatgatagcaccttaaggctccgagtcttctgtgggattatattcctgagccagaggctgcagacccttataaactgagcattgggggatgggggtaaaagtggatcctagggaaattagagatcatctggtcaaccccctcatcctccagatgaagacactgagtctcttagaagagaagtcatttccccaggtccttccccttctcacttatagccaggccatggctgaggtgccctcrgggcccccggttgggagagggcttcagtctcctggctgcatcctgagaacgtagctttctgtgctctttcctggaggtgcgccctccctcccacaggatgctgtacagaggtggacgcaagtcacacggccccagatgcatagggaggtagagggaagccaggcttgtcaatgctagggagccctccagtagcaggaccactcactgcattaccacaggcaaatcacccacagccccttcctgccacagttgcctcatcagtaaaatgaagatgccacatttcctccctgcctcgcccacagcgtggtcgttggtagccagtgaagttgcatatgtgggcagttcaggatagggctttggatcccaggcatggccagcagatggtgtggaaagaggccagggctgggagtcaggagccctgggttctgggtgcagctctgctgtggctcctacgttctcctgtttctgtccttctcaggccgtgctccgaaatggtttctctttcaggcagcagggacgtggtgagctcccccaacctgccaaacctttactcagtgcagggaacctggcaaggaagaaaacaggcgagacccctcccctgagaagccacaccctggtggagggagccagatggtaaacacattcaccagaactttagatggtgagaagtgctgataggaaaactgagtcctatgatgggggcgcttggggtacctaagatttggcaggcaggtcccaggaggggatgtttgagctaggagctgaatgacaggagggagccagccacgcaaagctctgggggtgggggtggggttggggttctctccaggctagaggaggagtgaggacaaaggcgttcggcacgcctggcctgttgcaagaacagagagaaggccagggtgcctgggaggctggtgagggcaggcagaggccaggccacagggctggcaggccaacgtaagagggagagggctttctaagtgtgatgaacagtgtagaatgactggaaatggtgagtgggtaggatggaggatggaggatggatggatggatggatggatggatggatggatggatgaatggattgtaggtgcagctatggggtgatcccttttctccccatcatgagggtcataggcaacactcctgtaacaaaagacaggttaacaagaggaaagcataacaaatgtatttaatcaaagttttacgtgacatgggagccttcagaatgaagatccaaagatccagggaaactccatttttatgcttaagtttgaggaggaatgggcaactatgaagagctatgattggacacaaagagtaagaccccatgggagcagactgagtggggaaacccagcaaggcctgctctcagatccttcttggcctctctgtgctgcattccttccttcagggtatggggcaggattctgagtgggggtcttatgatctactatcaaacaaagtaggtcagagaatttctttytttttttttttttgagatggagtctcactctgtcacccaggctggagtgcaatggcacgatctcggctcatggcacctctgyctcccgggttcaacagattctcctgcctcagcctcccaagcagctgggattacaggcgcgtgccaccatgcccagctaattttttatgtttttgatagagacggggtttcaccatgttggccaggctggtctcgaactcctgacctcaggtgatctgcctgcctcagcctcccaaagtgctgggattacaggcgtgagccactgtgccctgcccgaccaaaggatttctttatggccagctcttacgcagaaaggcaggagaaggctaatacttttaggttttatgggtggctttaggggaaaggagttctggtttctgtgacctgccttgggaaagaggaattctagtttctatggcttgcctctggggagagtgaggggtggggaagagaattctagtttctgtggtttgtgtcgggagagtaagggatagagacaggaaggcaggagatgttcagagaaaagctttgcttctgaggctgtttgtgaggcgttcactttggggtaccattttctgagccccaacatgtggttgggagagtggatgactggcatacagagaccctctttccattcccctcctgtagtaggttgaattaactctgagagctcctctgcgtagtcctattcatggtcgggcccggatggcaggaagagtggggagctgaatgttcaggagaaatgcctcaaaccccctcaagcacatgattgggaaccctcagcggtgggagcagagcccactgactgctcctgagtgggactcctggactgacatcctgacctgccgtgcccgggctcgcctgagctcgggactgggctgagctgagactggggggagggggaggacacagacttcacctgtgttcacagagcccagggctgactcccggagctgttgctctgagggtgggatgggcagccccaggcctccgttctcaaggcgttcctctgggatccagtgccccctctgcccgcccaattgcacgggccagacagctggggtcgtctttgacagcgccagtgttacagcgagcagtaaacatccttaatacctgccctgtctgtccccattttgtctgctgaatttccatctgggccacccacttctcttcaccctcgcacccaccttggcttgtcattcccaggctcagagtccagggcctggccctgccagcctgcctgctttggcctcctctctgctggcctgactctggccttttctccatcctccaggcctccactgtcctcacatccaggccctgctgccgagggtatcctccagtgcttgttccgcgctgctctctcctgtggttgcttccctctgctagtccttcagaaacagctccagctcctagttctataggcagcctccccgcctgagcacgtgtcagaggatttttctttgttgtatgtgaaggttcacttgaagtttctttccttctggtctgcaggctccataagggctggcaccatgtcggcttttgtcaccatccacccaatccctggcacatagtaggcactctggtgatttgtggatggatggagaatggctgcatgcactaacttgactttaaccagatttcacctgtgttcacaccacccagggcccaccctcagggctgtttccagccttttctactctgagagcctgcccctgccctaaaccagggactctggaaccaagccctggccatctgtgggtgttggtgtcttcacacctgccgaggccaggaccacctcctgtccttgctcctgggccagcccagcctggggtttgaggcctgggcctgtctgggatctctggaggagggaagggctcactcagaagcgtgctaccaaatggaagaatgaaatcgtcaaggactcatctgagcaactgcagaacagtctaacagggcccctttcgaagtagagtacaccccagggaggcttccagggtggtgacaagtttggaaaccaggctgaatcaagaatcgaggacaaccgtaggactgagaagttgggggcggggaagggactcaggatcaaatggctttggagccttcacccttgagctgggctccagagggcagtgggcatggaggagaatgaatggcagcaggtctcaggctgagccaatggccctgggtgccatgtctctttcgggtcttgggctggccagggctctgctcccagggacctggtgtctgcaccccacccatgaacatgtcgaggtgcaagttggaggaagctctaggtttggaagccatctccctcagtgttggggttttatctgctggccgagggccctgctcgtggttgggggtgggctctaacctgtgaggattttctggtcgtcaggctctgtctaaaacaggcggggggtgcacccaggaggcctcagagcccatgattctaggtcacctcccacaacatccagagacaggagtggtatttatagcagccggcggccactgaaggtggaggagtcagcatgagctgtgacgcaggctgaccccgccgaggtcccctagctctcgctgactcccttaccaccacccccaccccagagtcttcctaggactgggcctgctgaggaagcaggcattatcagattgcctccccaaaccctggaggagacgaggtgccactttctgcctggcaggagccttggcctctgccggtctcaccaggaccttgtctggcttgacagccccagctgggcatcccattagcactgctggtctctctcagacgttgccgtcagctccttcacggaaaggttcatcccctggagttacagcagcttcactgacctcccctgggccagcaggggttagcgggagcctgccttttccccactgcggatagttaggggggccgagggcaccagcccctggttgacagggatgaagccctgccaaactcccgccccctccctgccgtgtcctcgtgaagtgggagtgaagtgccactggggccagaggggctgtgccgagcatgtggccccagctccacctcccaccacaccctgagcaggtcgggaagcagaggccgcagaagtgacagcgtgacaaggctgggcgagtctcttgggaaggaaagtgatgccaaattctggggtcagaggtcgagcagatgggcacttacctacccagaacagagtgggtcagtggccttgctcaggcatgggcaggcagaggctggcacttgtcaggggcctgatggggttcccctcatcgtggaggcctgttctcccctctcctttccagtctctatgttgcccagagcctcctggcctattcccccacaggctgggagagaggcagatggaggccagggtcttcttgggaactacagtgtaatggaggaggtgaggcagacacaccagaagcatgcaggaaagtgggtcacgggcttacctggtcatttgtgggctggtttgccagggctggggctgaaggccagctgggacaggcactgagcaggcctcgcaggctgtggaggccatgtcggggcggagtgcccaaagcaagcggggccatctggagaggaggaaatgcctgggcatggggngcactcagtggctgagcaggtggaaagacaggagctgggagtgggcgtgcccggccggcagggacagagtcagacaaggtggagggtatgggtgctggtggcagggctgggcagggcggggtaggggtgtggttggtggagagctttatagctaatggttgggagttttaattttatttaaagggcatttaggagtcataataggctcttgagaagggaatttatttatgtatktatttatttatttatttattttattgttttgagactgagtcttgctctattgcccaggctggagtgcagtgacgcagtctcggctcattgcaacctctgcctccctggttcaagcgattctcctgctttagcctcccaagtagctaggactacaggtgccccccaccatgcctggctaatttttgtatttttagtagagatggagtttcgccatgttggccaggctggtctcgatctcctggcctcaagtcatccgcccgcttaggcctcccaaagtgttgggattacaggcgtgagccaccgcgcccgacttgggggttgatttaattaaagctctatgtcaccaatctcctcctctgagccagagcctgctttcaacactttacaacttttttttttttttgagatggagtctcactctgtcgcccaggcttgagtgcagtggcgtgatttcggcgcactgcaagctctgcctgctgggttcacaccattctcctgcctcagcctctcgagtagctgggactacaggctcccgccatcatgcccagctaattttttttgtattttttagtagagatggggtttcaccgtgttagccaggatggtctcgatctcctgacgtcgtgatccacccgcctcggcctcccaaagtgctgggactacaggcgtgagccaccacgcccagcctcacactttacaacttttaactcgctttgtcctcccagccaccccaagagggaggcactgtcatcatcctcatcctattttatagacgaggagagggctgcgttgtatattgaaggtcacaactctgtggccgtttgagtaaatcaaggcactgggaccaaagccgggtccagtcctgtcctccacccggcagcaggggccttctgagcccctgccccttcctggaggccttgtgcttgggtccagctttgccctgcctggggtgatgggaggggatagggaggtctgaaggacaraatagtcagctgtaggcccaggtctctaagcttctgggtcagtgacttttttctgtggccccttttgccctcctggctcaggcgaggggaggaaatgctgtgatcattgtgtgagctcaggcacctgtatgtagcccccaggctctctccttggccattctgcaagtaaaactctaaaagtccagactagaatggacctgagagcatatcctgcttagtggctttcaaactttgtttgtttgtttgtttgtttgttttttgagacagagtctagttctgtcacctagagctattttgggaggccaaggctggctggagtgcaatgtcgcaatcttcgctcactgcaacctccacctcccggttcaagcaattatcctgccatagcctcccaagtagctgggattacaggcatgcaccaccacgccccgctaattttttgtagagacggggtttcaccatgttggctaggctggtctcgaactcctgacctcaggtgatccagagcagctgaaagctgctgtggttgacattgcctgcaagcccactgaagcctgcccactatggccacctcccctcatctggggtccctgagggcttctggaaacccactgaagagcactgagatccccctcattgagcacagaaggagaggagggtgacagagggaggggacggggctgcagcctgtgtgccattggtggtggcaggtgccacctccctctccagtctctgtgggggcaggggatgttggcccttcctgtcacatactagagctctgcagaacctcttcccctggggaaagagctcctgttacgaagtcacttgatccctgcttgcttccgagatgcccggggtacagtcgaagggaaacccaatagcccagttggccagcctgtgccctagatggccatgcagcttagggaggtggcccacgaagcctccccacctttgagcagcaggcacccacaccagccagaccccgagggccaacccacagcctgaggagaggaggcagcaggaccagggctcagggtaggctgggcaagggggcgggggccccaagaggggaggcatcaggctaggtgtgcccacttagcatatcattaacagcttcattagggggcccctaatgaagtggaaggtactaattcttcactgaggcgttgccagcacccagacggagtctcctctcaaggaagttctgagaagccagagcgctgggattcgtgctgggagctgatgaactgcctggcaggggggccatctggggagtgaggtcccagcaagtggctcctaggagagggggtgactctggggggaggagcagagggtggggccagtggaaagctggaagggcagatgggcttaaagggaggggggaccgctacctctcagggcatcctgcgtttgagctgggaaggggcctgcaatgagacaccctgaaactcaaacatgcaagctgatagatgcggggcatcctggcaggatctcaggctttggagtgttctagagtcttgtggccttgggcgagaactctgtggctcaagctgtcccaggggtgttgggtcccctctccctgggtggttgtggattaaaggaggcagtgccagtgcggccgtgctgggctcctaggagttggagctctccctttccaagaaggcaagtcagaggattatgcaggctggaagggtgagggcaggtgtgggtcagcctgctcacctgtctgtttgggaagattgacttagatcgcggagagttattgcccctgccatgcaaggtgaggtaaaggttctgcgcacactggggagacatggttactaaatcacaatgatggcagctcctgttttctaagagctgagcactttatgtgcgttatttcgttaactcctcatgactcactcactatgaagtgagtaccttcattattccatcttacagatgaggagactgacgctcagtgaagtgacagtcatagacaactagaagtgatggaactaagattcaaattcgggctgccctgctctggggccagaaggcaggcctcggtcagctcattggatggccaccccctccaagtcgctgcctttgagagagtcgcgttcccgggagagtggggtaaagacgtgttagggcatgaggggactgaccaagaagaccaccggggcaggtagaaaggacgaaaaccacagacacccttccccacagacaggcaggagaaaacagcctggtgccacccagtgtggggcggtgtcggcctttgcgtgagggcttggagatccaggctgcccggccgcacccatcacagaggccagcagaacccgcctgtctgggcctctccagaggggatgtggacgtgtgggacaagggcttgttctgagtttcagaaaaatgaataatctccaaggaagaatccagaagccagacctggtctggccagagcctgggggactccttccactgttggaaaacattgtcggagcacaggactgagtgggctctgatgtgaatccccctgggaagagaggtcagaggaaggctgggggcaggaggagggcccagcctggtcgccagggaagggtgctgctgccctcctggccctcacttcccgctccccagcagccagccatctttccaaaataaccagcaggaaacgaaaggcctcaattgattcccagggagttggctggtgtcagtagcagggctggtggcagatggcaaattctgctcattgtggatgagtagaaaataattagcgtgagaacgagtagctggagccttggtaataaatggagccctggtgaagccttctggggagaggcctggagcacaggccctgcaacctcaggcctggctctgccgctgaagagctgantggccttgggcaacttatttagcctctctgggcctccatttcttcatccataatacagggcataagaggttgttaaaaggattacattaaaggaggtaatttttgtgaactgcttgttaaagtaaccagcatgtagtaaatgctatataagagtttgtttttaaataaacacgatcgagtaattgttggaactatttctgggtccggcccaggctggcattgcccccaagtcactggagcttctctttccgtcctcctccctgaactctgtgcccagctccctgactgctgttttataggggaggggtctctggccaagaagcacgaggagggcacagagagaacacagcaggtagacctggcttcagagcctgacttggacactcacttgctagcttctttaaattcttggagcctcagtttcccgatccatgacatgcgaacagctagacccacccctggggttgtagtgaggatggttatgtggctggcacatggtgaggggtggaggaggtgcctcctctggtccttccaggccatcctgggggagagtgggaaaggcgtttgttagcctaagaccctgggcggcgggtaggaggggacaaatgtcagtggcctcccactcctgcccctggctgcacaaggcacactgttttcatccctaggcctgggcgtgtgaggacctatctcatgctgaaatctggccccagtcctgggcaggctccgctctgccttctgctctagcgcagctgatgtgtgaaaagcgacagctttcaggcccctaacttgggttgcacacacccaggtacaggctggtggcgcacgtggcccccagcccacacgtgctttctctccgtcgtctcccttgycacctctcccctcctgtgctttcagaggccagcctctcggccactgggaagaaggggaaggtactgtagccccgggagcctggggtgggacctgtgggtcctactgtctctgtgtttgtgacaataaggagtcagactgacaggcagagagggtatttttttcttgcaagtagttcaaggaagctacttgaaatcccagctctgcgatgtcctcgtggagggatcttcgtgcaaaccattttgcctctctgagccttggtttcttcatctgtaaagttggggtaataccctgtggcctgatgaggctggaggtggatgacacatagtgtttctagtgccttgctctctcccgactccacagcctgctccgtggaattcccctgggctcagttttcctcatctgcagaatgggtcccgtgctatcccacatgattgtgagtctgaagctagatgaagacccagagagctcctcagtctgtaagaagaggcttagagccagcttttgagttcagaaacaggcatttagctgaatcctgcttctcagaaacagcatgcagaggtaaagacctgggttctgggcctaggctgtgtggctgtgggcaagtcacttcagctcatctgtcaaataaggggaagggtagtacctacctcacaganctgttatgaggactaggtgagttcatgtttgtaaagggcatagatgtgcgccgagaccttgtaggcaattcataaatgttaggagaaccgaagcagcccagtccccaacttataggtggctgagatcattctgtccctgtcactacccaggatcctggagcctgcagtttcaccagtgcagagaggttaactcgctaccacagtcctgcagccacagtgaacagctggaatctcaccacgaccaaagcctgtgctaaagagagcaggacctgtctgccagcccagcgaggccagacagcgacctgctggtgagcccaccctagctggggtggagcctctgaacacaacgcctctgctggggggcgggccaccagtgtcctgcgggycaccactggggggcccagcctcactgtgctgagtcccgcagatcagatgcccacccccagaccagataagctccagtgcccaacaaggcacattcaaaatcggatggaccacgagagcatagcaggcagtaggcatcagttcctctccactattttggaccaccttccaatttcaaagccctttcacataggaatcccattcgtcatggaaatgggagtcctgggctctcccttcaggacaccaagggncaaaaaaccctgcagagcgaaaaagagcccttacaaacttgccagtttccacatttactttggcaaccaggaagtgtggcgtccagtgctagttttacatatagcaaccgtgggggcccttatgtctcacatgtgtgcaatggactcatcctcccsgccctcaattttgatttactggggcctagaggggttgggactttctgtcctggggacactgctcttcattcagcaccaggcagctctaggatgtggctggacctggtccccatcaccagcccccagaggcaggagtaaaatgggggcccagggaaggtggctctctggatctgtctgagagtctcctctctgtcaccacagctgctgcagagcaacagggactccacygctggaggcaggagagccagccgcaggtgactgaagtaggcacatggttgatgcctccctncagntttatctcctgtgagggagcttctgtggatgttgctggcttctaggagggttaggcatcttcaagatcgtgaaagagaggatctcagcccaggctccctgtggtgacacgctantaatgctgttgtcactggggagtttgagtggggtatgtagtgaggtagaagggagcaggctggcttgggggcttgggttgtgtgtccagcacctggcagtgacgctgctgggatggatatcacgggaagagctagggcctctgtgttctttctgaacctcagtttcctcgcccatgaaaggggacagtgggactgttctgagactccttttaactctgacctttgttaggtgtgggctttggatggcagcaggaatgacctgcgcctcctgcctgcctggcctcttgatcctcggatggtgtcaggcagtctctgcatctcagtctcattcttcagtagtaatagtaatggcagtggcagcatttgctgagcagttaccagatgacaggcgctgtttgaagtgttgactgatttaaccctcctgataattcggaggtaggtactcttcttatccctggtttagaagtgaggagactgaagcacagagaggttaagtaccttgtccaaggtcacacagccagtaagtggcagagccaagactcagatgcagcctgttttagagtgcagggtcttaaccaccccttgcacacactgtggaatgagagcgacactgcgaccctgtgttactgctgtgaggactgaagccggttagtccaggacttgggacacagaaggtgctcagctaatgtcagatggatccctatggctggacctggctgtcatcccctccttcaggcacaacctctatcccatccccaggccaatgaccaaagccatctctggccagatgggaaatctcatgggctggaggtggcactcgcgggggttcccaagctcattgtccagttccctgtggacactccagagggctgagccagtaccttcttcccccccatccccctgggagctcttggagccccatctgctgggagtcttgctgccaagggactctgctccttaaaatctgctcccagggccaagcccacagggtaccttaggacgagggggcgaggcccagcctggggtgcttttaccagcagcaccggagcactcatggtgggggcaggctcctcggtcagggcttctgtttgctcactccagccctttctgaccagctgggcaccagcagcaccttccagaccccagcacccagtcacaggtcacatcacaggaggtccccacaaagcccctcaggtgtctgctaatgcaacagcagccatcagcagatccttggggtgtgcaggacctgtgcagagtcctgtagtgacatcaccccagtctgttctgaccacagccttgagagggatgttgttagccccattttacaagagaagaaactgaggtcccagaacagttcatctagccagaggngggggagagggttctccctgagctgtcagggaagacactggggtgggaacccagcctgacagtcaggaagggagggacgtttccccagaagggaagggtgtgagctcagagggggaaggagccactgtctcagcccttgtgactgggaggggagctgtgctgaggaggccatggggtgggactgaggtgctggagccaggcactgcagctggcacccagaggtgtggcgatgggtactgtgagaccctggccccggggactgttgagctggggtggggatgggcagcaaggagtcagcaggttaaccgtaacacagtgtgaccagggccatgctgggggaaggggtctagggttcccataagggagcagcctgtttcccaggaggagagtgggttgcatgagggctgtcagggagggcttcaaagaggaggtgacttttagctgacctagagagatgagttggatttcacccatcagaactggagtaagcaaagcatggacccttccagtgatgtgtttctggggagcagcatgtttggggtgtcgagaaagaaggatgtggcagtgtaagaaggtgctggagagcctctccagccagaaggatttgtcagctgagggtgggctctgtgctggagtctgtctgcaccaggatcgctttctgctcaggtgataagggaatgcgtggattcagagagggcgaggcatatgcctgaggttgcaccgcctgtcgctgccgcccgaggggcttggactttgtcctgcaggccatggggagccaggaaggtttttaaagtagggggcagcatatgcatttttaaaaagagtttgcatttttagaaagaggaactcccagaatggttagtacttagtccaggggcctgaatcaccagcaggaaaattgggctgtgtgggtgggggaagaaggaggcttccttgggctgcttaagtcattccatccatgtgagaggggtcctggcaccccattcacacttgcctgtgctgggggtccaaccagaggcaggaggagcccccagcagtgcccctgtggcccctgctggaaggtatgccgtgcctgccctggaagccccactggtgtgggataggaagggcaggcagcgcctacccccgccccactgtggctgttagaggggaggaccctntgccccaggggaggagagccagaagaggtgctttgtggcagccccagaccaggaagtagcctctgccctccccgctcctgagacatttcctccagatgaaatcacatccccagcaggggaacaggcccttattgtgatgggccggggtctctagagaaagggcaccattcaaggcccttaaaaatagccccaagagatgtatgaattggcctggagagtggtgcagcccacccccaacccttatgcagcacaggccctgccacccccaccccagaccttgacttgttggtgaccagccggagattccaccagcccaggcgggaggggtggctggtccagcaaggggttccttgcactccctccgcctcgcccgccccagctaagacagctagagcctctgcaganctctcatgtgattctcaccaggactttaggaggtagggataatcgacattttacaaatcgacattttacagttgaggaaactgaggcacgactaataagtcacacagtgggtacgtggtagagcccaggttcaaaaccagccagcctggcacttgtgtcccagcctctgtgcctcggattctatggtggtgggccggccactggtgcaggcctgtcactgggtacccagcagggtcggcccccaggagccccgcctcatactctaggtaggtactgctgttgaccatggcaattggcctcaggctggtcaccctgaggtgggggcagtggttaccactggtcatatccctccagcgtcttgacagtccttcagccacctcacctctgcagggcccagggccaggttcggctcactccttccagcctgagagctgaagcgagcgggcattgttcgggcagaggaggggagtgcagagtgagtgtgtgtgttgggtggatggtgtgtgatctcgaggagtgttagctatcctgggttccatgggtccaagggtgggagtgagaggagggacctcccagggtgactgagaggggccatccatggggtggacctgagaaggagatattcttggctgctggcagaggcaggcctgggggcaggctgggtagggccagaccctagccctccagccagcccctctgggacagcactgctccctcctcccctggtctggccagatcagagcaggatgcggctctacagcacctgcgggggcgtactgcccccccagcctctagattcattccatttcattctgttccattcatgtgaggggctcctggcagccccgacagccccctgagcccgacccagcgctgcaccttaccctctgtgagctacttggagacagggagggggcggcaataccagctgttggcagctctgttctgccccagcccaactgccacccacggtgccccagccccccctcctgtcctatcgtgtccaaccctaatctgaagctggtgctgtcagccacatgtcacaggcactgctgacgccccggacccctgcagtccacagaccaccccccacccccaaagcccagccaccccaccaccatgctccctcactctccacccttctccctgcctcccagaagctgagctccgactcctccttggagagagagtgggatgatgtcacttcctgagggtggggggaggagtaggcacgaccccggcaggctagcccgccagcccgccaggccacagctcgccaagtggctgcaccggggatagggaggcgggccgggcggacatgygggctggccacctggccccacgccctctcgcccaccctgggggctatgcccactggccaagggagacttggctgcttcctccccgaatgatgccgggctcctcggacacacattttccctggagccgccactggggagaggaggatctgccgcctgccccggaccaggtgccatgtaagcctctactggcccccggcgggggacagctgcccaccaacttggtccccagccccctgcagcagtttagtgcagagctaccctggagccctttatgggtatctctggggacctagctccctgtggggtcacctcccacccatgctgcttcctttctctttgggatgctaaggagtgagggccctgagttcctgggcactctttcctgagcttgcttggggctgatttgaattcagctacttcagagagttgaaaatccagctggaaaagctgcatggctcagggtgggcttgggaggtatggttgccaggaggggtgtgaccctgcagggcttaccccatccttccagcagtgtggggtggaaggtgtcccaagccctactcctgaccctgcacctcaaccgtgctcttccctccctggaggcatagctgtggtggggacttctgtctgatgggttcaaaaccaagtcatagagcacgctcttggcttccagcaaagcaggaaactgaagccttcattcaagaaatacttactgagcacctgctctatgccaggcactcctcaccttccatgtttgtcagtcccagctgccaaccatacagggtcccttgcccccaccttcccaaggccttcagccttcctcctgccctgctgggctttgtgctgttgggtgggcttgttcttggtctgggaagcccctcccttgactccaaggacagtgtgcactgggccaggtctaaagattatagggtttgagggctgggctgagggtcccactgatcccatgaaggaggaaacggggtctttaatagagctcaacagtgactgctggggtaaccccaggtagaagccgatccctagtggccagtaccagtctcgggggacaggagagactccagggggaaggctgaagtctgtgtcctgctgctaaggtcctttgtgttggctcctgcccggaggtgggtcagcacttccagtggccagctccaaaaatgcctgtgcttctggccacaccggggactggtcccgtggcccaaggaatgcagtggccctgggtgccttcacctcctcaggcagctataaggtcctctgctttctttcaggaggtgagcaccaggcccactgagcctctgcagagccaccagccatgcccgggatcgtggtgttccggcggcgctggtctgtgggcagtgatgacctcgtcctaccngccatcttcctctttctcctgcataccacctggtgagtccccaggcccggggccacaggcctgggtttggagagaaaggtctggaaggacgctttctggccatttgttcctccctgcttgggcccaagtcccaaccctgtcatgcccccagctgcccggaggaggtgcctgaaacatctagccccttagggcaatgacacccctgctaccattgctggacctgaccccaacactggggggagttgctgctactrtctccccatggctgaccctgagtcttttactggccgcccatgcccttctaggcattcgatgccaggtggacaatggtcttatggaggaggtgcctgctgccagccctccttccactgaatctgggctggggaagggcctgcctgctagtagcatctcgaggtacaggggccacctggccttgctcacacgggcgttcctgtgacaggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcagtacgtgctctacgtgcgcctgggtaagggccacccaccctggggtgctgccccagacaactcccacctctccattcactcagccagtatttactgcgcacatgttgcgagccaggccctgttttagcactggggtacagcagtgaactaaggccttctgtagcttacattctagactaggggccagcaaactgcagcctgagggccaaatccagcctgctgtatgtgttattaaataaggttttaggctgggtgtggtggctcatgcctgtaatcccagcactttgggaggccgaggcaggtggatcacaaggtcaggagttcgagaccagcctggcgaacatggggaaaccccgtctctactaaaaatacaaaaattagccaggtgtggtggcacacgcctgtaatcccagctacttgggaggctgacgcaggagaatcacttgaacccaggaggcagaggttgcagtgagccgagattgcgccactgcactccagcctnggtgacagagcaagtctccatctcaaaaaaaaagaaaataaggttttattggcacatatccattcagtaaggtattgtctccagctgctttgcccctacagcagccgagttgagtagttactacagngactgtaggactcccagagtccaagatatttgctctctggccctttacaggaaaaggtgctgaccccatcctcaaccatgtgcatctcttcaaagcatatcttccttgtgatccttctcaaaacaggccttctgcttcctgggaaccccctcaggagtctgggccagctccccagaggaccagcctgtgtcctcttcttgggcttaggttgcagccccttctggtcatttgtagtgaacactgctcttgtgcttctgtgcactgggctaggccctttttcctgtgttaactcacagggagtgggtgttattggtctccgtttatagatgaggaaactggggcccaggcctagctctcacacaactagtaagcgtgtaaatgtcggagctgggatttgaacccacgctgtctggctccaaagtctggtctctgagctgccacactgctgcccgtgcagctggggctttccaggctgcccccatgaggccagcagatctccttctcagccaccactccatacccctcccctccagtctcagcccctgaggggcctgagctggatgcagaccagctgctgggcccttcctctctcctccatcaggttccagaggcctcttgctgggaaatagtttccatgaagtgaacacgctctcatctaatttttgcacagtcctatgacataaatgttgtcactcccattttacagatgaggaaatggaggctcagagagattaggwaacttgcctaagatgtgtctgattccacagttcagacatgattctgagatcctgatagaatgaggaaatgggccaggcgcggtggctcatgcctgtaatcccagcactttgggaggccgaggcgggtggaccacttgaggtcaggagttcaagaccagcctggccaacatgacgaaaccccgtctctactaaaaatacaaaaattagctgggcctggtggtgggtgcrtgtaatcccatctaccctagggactgaagcaggagaatctcttgaacccaggaggcagaggttgcagtgagtcaagatcacaccattgcactccagcctggacaacaagagcaaaactccatcagggatgccccggggacttgagagcacagaagctaggagaggtggtgggcacattgcaagcggtcattcaggggccaacaggaccaaatggtgacaggacgggcttggggcctgggaggcggggggtggggggtctgctaatggcccgctgcctctgcctttgctactgagctggctgaaagcccagcrataggaaaggccaggccggggttctaggcccttccctggcatgcaagtggcagccatccttcagccaggcctgctctccttgcagccatcctggtgatcgagttcatctacgccatcgtgggcatcgtctggctcactcagtactacacctcctgcaacgacctcactgccaagaatgtcaccctcggtacgtctgggtgaggcctgctggagcctcagcagccccgggggcacaggggangagatcagtttagagaggaagaagcttgggcattgccagagggcagtgccttctgtgggggcaccagcaggttggctgggcgagactgcttccctcacccttgaggcctgccagctacctggtctggggtgggctgcagcaggcacagagctgctcaggtcaagccgaggctcctcagcacctccttggaaacccacagagctgcctgctctgagccaagagtggcccttggggttgtgggtgggcaatagggtggccacgtatgtggccagagactgggaccaggggctttggagcctggcttttgtccccagaagcatttggggttagggaggctccaatgtccctttcttcagagcgggtgagccagagaggtgtccccagcgcccctacmtaatgcctcccactgctgcccgcaggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggtcagtcagcgggctgggtgggcagtcccagggtgggctttgctgtctggtgygcagaggtctccattcttcagaaggctaccccaggcctcccagactgcatgccaacctcgtgtgagccgtgggcattagtcaaagggcttaactgctccctgcctcagtttccttgtctataaagtgggaataataacaattcttgtctcatgttgttgtgagatttaactgagctaatacctgcagagtgactaacacagtgctcacactgggtaagtgctcggttaatagtagttgttgtcatcattgtccactgctgataataacaatggtaataacagtgaagccaagcattgcgtgtagtaagttacaagtccaccacacagctgtcawcttccccataatatgggtggagaaactgaggtacagagagatgatgggacttgcctgaggttacacagctagaaaatggtaaggctgggaactagcccaggcagtctggccttagagtcctcgcttaactagctattaaattaggctaggctgcctctaggattcagagattgggagaggcaagtcaaggaaagcttcctagagggggtgagttttgcatgatgttttaaagatgggggaaagtgtgccatggcagacaaaatgagggagggcatccaggtagtgtcacaataatttgtttgttgaaagaaaaagagaggggcttccagggtgggtcccagtacctcctgttaatggggcttctacagtgcattatgtaaggagctccccatgccaagccctttacgcaattcatccatttaatccctttgtgaaccccggcatggttgtgagatccattctacagatgaggaatccaagtcccagagagggcaggtcacctgccgtgggtcttgctgctggggtgcagaactggcaccacacctgcagcccagagcagctggctcaagcacctggggagcaggctgtctggacccccgctgcccggmaggaattctcaccgtcccaccctcctgcactgctgtgttcggctccccgtggaccttccacgtcagctcagcactgcagccagagccacacccgtgcctgctgtggccacgtcccagcccaaaatgtcaggtctgggagccaaggccccaaagcccatattccctcccagcccagctggccaccaccacccatcccacagtgctctgggaaccctgcttggccagcacactgtcccttcatgccccagaaggtgggacattggtttaggatgtacagctgtccaagtccctaagagccagcaggtccccagagtagcaattccctgcacccttccctacctgcctcccgtagccctggaagaccctgttgccctccttctccttgtggccatttgccttatgaagccagggttggagagcgggaagcggtccttagacacacggaggagccaagaggctcaaaaagggcctggcctgtcactacagattgatgttaagtgccttgaatgcatatgagggccacccttgccttcctctcctgaccacccagcatcaggcttttaaggggccgcacatggcacaaaagcaagctagccccttcttgctcggtttggaggtctgcacttttaatgttggatctgttatctttatgctcaacacactgactgcagacatccagcctaggaggaacctctgtgaataactggcccattgctctgcctttgggtacagactcctggagaccctgattctccatctgagcagccagacccactggggatggggttggggggtgagaatagacaagggcaaccatgtgggtgaggggtagagccctctccctacctaggtatcagatccaaggaattgggaaatgcagagccttactcagccccatagatttcctgtaagtagagtatgtaagtatgtaagtgtctgaaatcctttctggggaaaagcaggtctttctggaaggtctgttccaggccttagaatgagacgacagggaggcccaacaccctgctgacctcccagggtttgagcctttggacacctgagctgcagggtagcccccacttagggctcccagctctgaagccccagagcctgcctgtgttcagtcttccaaaagccaaggagcctctcaactgctccccacctctctcttccacccacccacccttggccaacggcacacaccatcttaggctagcaggagtctgtcagggagggcccctgctggccagcagccaggccactggccaccagctctggcagggcctgggccctgttctcccccagaacccactgcgggaaccctttggtagggtcctgggaacagcctgccctgtttccataacgtctgggtcccagctcttctggtccagccctctgacctcacacataccgcctctcctgctttgcaggcaccgcttagaggagggtcaagccaccagctggtcgcgccggctcaaagtgttcctctgctgcacgcggacgaaggactcccagtcagtaagtactgggaggtcgctcccctctggctcacatcctgtggtcaggtgattaaggggctgttggctcctttggcaaagcaggatggggcagggctggtgggaaggagctgggtttccagcgtgagcaagtatggcctgctcacacagggcctgttattcactgagccactcgctccagcacgcaggaccacgtccacttgctttgtcaagggaacagaaagctgtgaagactgcatcaactcccttggaacttatactctagtttaggagaagaaatatgcaaagtcagggtgacctgaagacaaagaaaagtagcgtttcaccagcagcaaattaatcaagaaggcctggcaaagccgataggcgtttagcacggtcctagatggggacacatagccttcagcacctgggagctcagaggagtgaccagagggccggacttaatgccagggcactgcagaaggaagacagggccagctgggggcggcccccaaggggagggaagggaggcaggccccgggatcatccaggggtgccccgcagcgggcagggaccttagagatcatctagtcccacccctcattttacagatcaggcagctgaggcccagagaggtggagtgacttgctcagcgtcccacagctagttagtagcagagccagtgaggtcaggagaccactcctccctgaggcagacagcaaagtgccttccacggaagccaccgggaagcctcgagtggctcctgcccaccagcgtcccctggtgagccytagagtgagtaatcaagtgtaagaaagcccccgaggttccctggtgggcggggagcacccccttgggtctctctggggcggtctgaggggtctgggctgcaaggcaggccatgcagagggcagagagccggcccctggcggatggaggctggggctgctgtgtggagggcacgcctgcccctctgggtgcacgggcagagctggggctgttgtcagagtctggggaaaagatagcacatcacagcagagccccacggcaaaggtcctgttagacactgatggcctcagggggcaggtctggtcccaagcatgttttgatcagcgtgtgttgtgttgcttacacattttaattggatgccagcatttaaaaatcaggggtatttccataaacttctgtatttctgaatctggtgaagtgggccctggagggcctccggtcagctggagccgagcagtatctggctccgtttggctccattcggcatttgaatttgcagcccttgatttagtcacttacaagtgccaaacactcaggggcgagacccagtgagacagacttcattgccatgtggttgttcccacctcagcgtctcctaacaggttagggaagaggctctgggctgcagcctggggccaggaagggaagactaagagggcaccagccagcagggctcgcctcctgccctgaggcccagacatgcactgtcttcaggccaagggcctggagagaagccatgggggaccactgggccagagagtacacccccttctagggcacattgtgggggtcactgagccagcagcctgtgggtagctgggggaggggccctgagacctggcaggctccacagaggccttacgagggacttccaaggtcccagctggtgggtcagaggcagccaggagcttagtttggtttctgtgctggagagaatggctagaggagaaatgagccagagccacccggccttgattctagcgtctgggaaagcaaaaaggagtggctcaagttggcgcctgctcttggtagacagtgggcaccatgcgaattccaaggagaggagagggctgggtggctactgccaggtctaggagccctgggcagggccctcagggtcacagggccacatggggtcaggctcagtgggcgctgtggaggtgctggggagaacctgtccaggggaccccgagcagacacctgcttctgcagcctcccagccctgggggatttactcctggcctctcgtcctctctcctgctcccctgccactgcctcctgccttcctggacctcgtaggatgcctactcagaaatcgcctacctctttgcggagttcttccgggaccttgacattgtgccatccgacatcattgctggcctggtgctgctccggcagcggcagcgggccaagcgcaacgccgtgctggacgaggtgagcaccaccagccccttctccaggtcacctctccacaccacccttctttcaggccccttccctgtggcccctgcagcggagggctcggctcccacgcagctccccagtgaccacgcactctcttggaccctggaggtcacctttacctctggctccccctgccttcctgagcttgtccttyggccaggctttccgtgactactactctagggactttctgggtcgtgcatggctgcctctggggctggccctcaaaggacttctaaccacaggcttagtggacgtggtgagctcccgagtcggtcttctgcgtggccgctccgcccaccccacatccccaccagcacaccaaccccagttagggtttctcagtgtctcatacaaaatacctttcgcctgctgtgggccaggaatgtcctcaggggcttgatgttttgggtagaaggggagcatctggaaatatgggsaaacctcagattttggaaaagtggctgaatcttggaagaactngaagctgcatgctcgtttgggcttctcggcctttgggaagcaggcggacgccagggcctgggccccctttcccagccatgcagccgggcctgggccagtgattgtccttcttcacctgccggtcttacaggcaaacaatgacatcttggccttcctgtctgggatgccggtgaccagaaacaccaagtacctcgacctcaagaattcagtgagtcagacatcaactctcaccccaccccgtccccatccctcccactctgccacaatgacctaagcaaactcctcccagctgcccttgcagtgccagccacattgcccctgcccggtctccccccggctctccagagagcctctctgctcagatcatgcccctcacgagaaccacccacttcacaccggttcgacagacraatcccctgaattcctttaccaagttcagaagtgtctggtcctggcctcttgagatgacagagcactttaccagggtgagctgctagcatttttgctgctgctgctgctgttaatgaaacgcaatgggcgtagtacttggtttccaagcttttttagtagtggaaccttttctcaatcgcctttcgtagaaatccagtgtgtaatagggaaaggtggtgccagtaacatggtgggagaaccccagcccagggcccagcacacagcccagggcccagtacagcccagggcccagtacagcccaggctgaaaccacagctggcagccgggagaaacaggccctgcctcaggaagcaaatggctggagcgtgcatctgctctgatgcctgtcgctgcgacctccagcaggcccctcatcccctctgagctggatcctgaatctgtgaaatgacactaggcacaccttctaccagagctgtgctgagaggacacgagccattcccatcacagtgccaggaagcctcggtgccagccaggatgctgatggaaaggattccgtctcttagaaatctcagtcctttaggccacgtgtgctgccttgtgcctgcaatcccagcactttgggaggccgaggtgggaggattgcttgaggccaggagtttgagaccagcctgggcaacatagtgagaccctgtctctacaaaaaaaaaaaaaattagccaagcatggtggcacatgcctgtgaccccagctacttgggaggctgaggtaggaggattgcttgagcccaggagatcagggctgcagtgagctatgattgccactgcactccagctgcactgtcccttaaaaagaagaaaaaaaaaaaaccaacactcagtcctctagaaaagcctcagtcctccctgcctgtccctactccccactaaagcaggcatttgtatcctctctaaaaatagccacatccatagtaagtgccccaaaccagcccatttctgcttgccaggctctgccctggctgttctcaccaccttctccctcccactcctcacagggagcggggagggcaggcagctgtgactcccatcaagtgactcccatcgaggtgccagggtcacacctgccacctggcagaggctgccagggcccaccccgcccccagggctgcagggagcttctgacagggagaggataattacctctccactctcgttcctgaagagcagctgagctggccagggatgtttccacccctccgggccctgatcaaggtgccacctatttcacttcacaaggtgactaaccaccctccttaacttttacaaggtgactaattccctctcccggtgcctggggcactcgggaaagactggaagctggcagacactttgctggggcacccctgcctcttcctccctccaccccagcagccaataacctcctcagcatcaacagtggctgctgggcctcagacacactggctttcaaactggtgcctttctcccaagagatcccaytctcccaccaacgcagcccctgcccggagccctgggagcctgcagctggctgagtcaagttgaaggctcccaatatttgcagtcaaagaacccaagggccagagatttggtgattggtctcctggcctagcgtggctgccctgttgcccaaggcccacacacgccgcccagctggagggctggggcctctcagggctacattttcccagcatcaagggcccttctcagggctgattgccgaggtggggggattactactcacatccctcaactcttcccttctctggaaaacaggcaaggaaatggaccaagtgattttctgtccccaaatcattaattctgagactggagcaacaggacaggtctctgaggattcgtgtcctggttgcatggagataattagggaaatgcaattatcacctggaggagtgtccttcctccaaggcctgggccccacacctcaacaggggaccagcaacccctccctgccaggggttgggtccgcaggctcccaccctggggaactgctgggccctgaggctgtaggcaggaagggcaggaggtgaccgccctctgcctcctctcttctagcaagagatgctccgctacaaagaggtctgctactacatgctctttgccctggctgcctacgggtggcccatgtacctgatgcggaagcccgcctgcggcctctgccaactggctcggtcctgctcgtgagtacccctgtcccatcccccagcgattgcacctctcctcccgggtggtgtgtgaggaagggctaccgggctgcgcctactgctttgccctgaatggcttcttttctacaccttctctgggcctcaacctttctagttctgtgttatccctgagcagtgaagttgtaggcttcggagtcacacagttatgggttcgaatccagatgttgtcacttgcagcctggggcaagtgggtccacctctctgagcctcagtttctttatctgcgaagtggagatgttgatacatacctcgtggaattttttggagagggctagatgagatattgcataacacccacactgctgcctcccctccccttctggcgttctctctctgccccctcagccattcccttctgcccacatcttcccttctctcggctcccctcatgtgctctgcctttctagaagaaaggactttcctagtagagaggcccaatccatagaggtctttgaaaaggcaccaagaaggcctgttagttaaggctccaaccttcttcataggatctaggaaaggccttagccccagacctggcctgcagcctagctctgcgctcagcccaccgcttgggggctgggtggactctgcattcctaagtgggccagagaagggcgcctgctccaggaggaacccctccctgtcctgggtgtctccgccctcagctcatgccaggcagaaggaggacagttccctgggctcccgttctggaaaggctggcatgctgggcagcagcttctttccttgacacccctgcccttgggacccacagcagccacacccactctgcagcgccctccctgtcctcagaaagctgggtggctctcggggccttattctcaccatccctccagcgactgatcagagaggactagagcacctcatgcccccttcccatctttgtcagctgcatgtgcctggcattcttgcctgcatccctgggagtcccagctgtggcagagaactcttcaaaatgagcaccaggctccattactcactggtggtgtggggacagctcttagagcctttgtttcctaaactgtaacaggtggtatctgtcctgcctgcccatagggtgtttcagaacccagggtatcactggcaggcagggctctctggtgctctgcagacaggaggggtgctggcatttgtattaggtgccttagtgttgcagagagagcagagtccctagacctcatgagggcccagccaggcccctgcctggaagaaccaggtgcctgtggggcagagagaggcaggcctgcagcccagggtgttgggaggaggccagagtccagtgccccagcctgtccataacagcctggccagagggagaagggctgcccatctgcctcgggcccaggcctctcccctggcagcagttctcagcccatgcagagcacagcgagccaggcctgcttctggcttggccctagccctgccctggatgagccccagggccctcccatccggggtgctggccctgctcccctgactggtcctcctggcccacacatcactgactcagaggyagccctgtcaccggagaagcgaggagccactcgttattaagaacctattataggccagaccatttctgcatcttggacccttgatctcacaccagccttgtgaagtagctgtcaccacctgctcttacagaagaggaaactgaggcttagaatggctgagtgacctccaggcccttgcggtcaggaagtgatacagcaagggttcaaactcaagcctccagtctccaaaggccacactgttacagcctcatgctcagctgaggttggagagggaacagctgccgagcacaggagctcagcccctagaccctggcccatcaccacttgacctgcagtgtgggggaccatgctctcccattgtacatcggctttgtccccccagcaagcactgtggctttctcagcaaagtctctccccattggaaagtgtgtaatagtcactcaggtgatgctctgagtgaagacaaacctcctagcatcaccagaatccaagcttcttaataaaatctcagctgtcatcccgtgacagctggcaggcccagtcacgtgggctccagcgtctggtgccttagcagttggatgctggctccctctggtggcctgaggtgccgctgcacctagctgggtgcccagctcccaggctgcctcattcatttctgtggggaggctactgtgtacctggccctgtttgggtgctggggatacagctgtggacctctctgtggtgctcactgcccagcgaggaggcggacagcgcatagacaaggcaaatagggcacatggtggagcngatgggcactttggacccacataaagccaggtgcctgggatggggagtgctgggggcctggggagccctggctgttagatgaggtggcaagagagacctcactgtgacaggacgtttgaacagaggcccagaggagcaagggccaggccacgctgtctcaggtgctgctgaacacgctggcagcaggtcagagagaccagagccaggtggggtagacagggcgttgctgtagggtcttaaaaagaaaatgatgtggctcaacttatcttaaaagggccactctgttgctgagctgagagcgtaggggcaagtgcarggaggccagtcgaggccaccatgacagtcccaggcagagctgccagggcaggggtaggggaggtgagggagtgcctggagtccagctctgagtctgaagggaagccgagtacgtgtactgaccgagtggcatggccgtgggggtgagggctgaggagccacagacagttgcaagccagaggccaagccaccgaggggccttgggaagacctcaggagggttggggtacacaagcagggaaggggtttgagagctggcagggtgtcaggtgtccgagagaggtgctggctaggccattggatggaagcatctgggtgttggggcaggcctggggtggattcctgagcatgcagatggtgtctaaaacacaagactgcatgagtgcatggaggagccagtgcccccagagggaccccagggcttcagtgttgggtgcatcgctgagtaggccctgcccggaggggagatcccagagaggagggggccccagccaggtggggagagggaagggcccacagggtcaggtgccgccaagagctcagttaagaggaaggctaagagtggccagtggatttggtgacgtgggggtcactaggacttagcaagggcaatttggtagaggcagtggggctgaatgcccaactggaactggttccagggacagtggcaggagacatttgttccctcggggactccctggccctgaactctcttgtcaccccaccctaggtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtgaggccgggcagggctggggcctggtgtcaggagcaggcagctgagggcctagggtgctgaggctatccttccaggccggcaggagcccttgcttggctggtgctggctggctgcagcttccaggcatccctagctgggcagaccagaggtggcccccttctcttccccagaccctggcttgcctgtaccacctctggggctgggaaagcagacatcaaccccacacccagtgtttgggttgccgagccctagccctttagggaaaggaattgagggcagaagcagggaggggcagccatcacctggactcaggggcaagtggtggcactcagggctgccagagccagcaaggagcggggagggcagggcaggcctgtggctgggatcgggaggagatccccagtgaccctgggagcccgtcagcctttctggyggcagaggctccgtggctggtggagccagagttcctggccaggaaggagacctgcctaggtcactttccctgagtgtggccccaccagggccgctcaggctcacgagctgcccgcctcctaggtctatgaaacgcccttctacgtggcggtggaccatgacaagaagaaagtggtgatcagtatccgggggaccctgtcccccaaggtacgctgcccatggctcccagcccccgggggtgcctgcctccctcttcctgtcctctttagccgccccctcacctgtctcctctctccccaaggatgccctgactgacctgacgggtgatgctgagcgcctccccgtggaggggcaccacggcacctggctgggccacaaggtaacccacgtcatggaccccagggcccctgggcttctttcctgccctgccagtgtgcagaggcgtgtatggttgggggttcctccctgctcrctgggctcactggaagagattggtcagagaggcatgaattagtctggaaggcccgttgcggcccactgctgcgaccccactgccctgcacagcccagagcctgaccatggaagaacctgagaggcagctgcggagagatcataccagcttcattagccacactgcccctctgagcctcagttcccacctgtgaaatggaagtgacaggatcagcgtgtctgccagcccccacagctgggttgtcacraggcccaaagggaaaaatggatggggcagggttcctgagctgcaggtcactgtgggtttgctggtcactgggaggcctcccaccaacacctgcttctgttcctgcccacccagggtatggtcctctcagctgagtacatcaagaagaaactggagcaggagatggtcctgtcccaggcctttgggcgagacctggtgaggaattttccatggcaccaagccttttcacacctgggtccccctcctccaacgcagcacagagaggagaggatggatgggtgatggagcctcacaactcccacacaagccaggctcctgcaatcccttccagcctggctcccaacccctcctcttttgtgccaggtcctgtgggcatcctgctccgccccacctacagtcattgggcacctgattcatgccagacactagaggcacaaagatgattcagggcagacggcttttaagcctcatagctgcagaaccgtttgtcagaaggaaacatggagaggctcaaaatacagagcagagagaaggggtgctgctctacctaggggnnaactgagtcctgcccactggccacggtctgtgcaggtagctcctgaggtgccaccagctgccctttccaaagcaaagcaggctctggcctcaggagacttcagtctagtagtgagggtagagagatggggtcaggtaaccacatgtttatagtgataaaaagctccatcccaggtacagatgcaatgactagagggagtgagccactcctggaaaatcagaagggcttccccaaggacataacctctgagcaaggtttggaagcgtaaataagagtttattagaacagtctgcctaagcagtcgctctgtggggccctatcttggttctctgtgccctagcattcacacagcacagacaagatcccaggactctgggaagatgggaagaccctctgcctcccttgggttggctaagacagtcgcttggcgggcattggggcagggctctcaggcttctctcggtctccagggccgcggaaccaaacactacggcctgattgtggtgggccactccctgggcgcgggcactgctgccatcctctccttccttctgcgcccacagtatccgaccctcaagtgctttgcctactccccgccagggggcctgctgaggtgagccatctggggcttcagagttggctggggcagttgggaccagtggaggctgagggttggctggtgctaggggctggactgggagtctgacttctggtcacatggaggtctgggagtggcctggagggtggagggtgggggctctgaaatgccatgcgccccccaggatctacctagcaaagccttaccagtgggaaagacagagcagggagcaggcaacccagcctgccaccagccagctccccgggagccatcccaggagtgcaggagcagggcttgcttgtggctgggccccccgattccggaacaccaccaccccgcccccttggccttagcttctgcttcggcttcccttgcagtgaggatgcyatggagtattccaaggagttcgtgactgctgtggttctgggcaaagacctcgtccccaggtgagtccttggccccgctccatggtcccttgccaggctgttcctccctcctccaggcctctccccacccccagcccccgcatctctctcagtccgattcctgtctctcaagggaccccacgcccctccccacccttagttgcccagtggtgagaagcccaggtgaacgcacgtgctggcgcccgccctgcctgtcctctcactcctcagctctgctctggggagctgctctgtggacacctctccaccccgtgaccctggctgacgtgtcttcttgttccaggggctaggcgtgtgcctgcccctccgcccctggccccatacctctcatagccgctgaccaggcctggctgacygccctgtctcgttccctccccaggattggcctctctcagctggaaggcttccgcagacagctcctggatgtcctgcagcgaagcaccaagcccaaagtgagcccccacctggkcaccctgcctctgtgcagcctcatctgtccctgcccttgacccccaccggtttcttgggacaaagcacaagaggccctgccatggaaggccagggcagggtgtggctggtgttgtgggaacttcaggaagtcagaccctcagcatccccaagctcaacccatccatcccctgtcattgtgcagatggggaaactgagacccagagtgggagggacttgcatttgctcacataaaaagttagaacagaatcaggacaggaaccgagaggctcccatcacacagagctgggagctgcccacagtcaggagaaagcgatctggaggctttgagcggtgaggaaaggcctctgccgaagcctctgagattccctaggctcagggagggctgggaatgacctgtggagaggatttgggtacagtttgttctgattttctgctgtgaccaagaggagagggtcagcccttcctaatccgcatcaggtctctggaggacactggcagacggggtggccaggtgggggtggggacatggtggccaggcacactgaggcaggccagcgcaggaggagagggtcctctgtgtggtcacccctcctcaccccctgccccccgccccctgccccgggcgagccctcagcccattcaccatctcagccccgtctggaccgttcccagctttggtgccctagaccctgtggcaggcagggccctgggccaggtaccaggtgccaggcagtgagcagggcagcaaagctttgtgggactttgcctgyctggaggagcctggttctggggaggtggaactgctcccaccagattagtcctgggcttttgtcaggccaggcctggcaggtccagctggactcaactccagggtgtgtttggcctyggacttgtggagtgatccagaataagtccyttcccctcactaggcctgtctccccatctactagatgaggggttggctgggcttccagccccttgccagccctgaaattcaacaattccatgtcatctgtccttggcaccttattggccgtctggccaccgtgcacctcagccactgcctcttcaggtgggcaccgacctttaatgctctggccactgcccttcccctgcccctttgccatcttactgcccacctctcacctgctgagccccccttctcggtccccctgcccctgccccccagccagtgctacttagctctgtccccatctctcccactccaccccgcgcagtggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctggtaggttctgccagggtctgctgctgcagggggtagtggccagggcaggggcagtggagagcagggccggccttggctcaatcaccgctcggggctgggggtggaggctgggagaagatggcccagggcctccatggaggggtttccccagcatcgggctctggaaatggaacaaaaggccagccctgagcaggactccaggcgtctctctccatagtctggctttgcctccagtgtcagcccttccctggtgtgccccagggcagctctccccactggtggtccatttaaaagtaggtgccctggagggctcacccctcaggccctggccagctcacacctcagttgtcacttggtttcaccaagggaattcctcgaagacagctgtgagcaaggtgggggctgcgccaggagagagaataggagcaggcaagtsggtagacctttcccactgtgctccttcagacggctgygccctggctcctccctccagggtcggcttcctcccctgacacagctggtgagctgggccgtgcagcaggtggagcaggtgtggcccaggccaaaagcaggtcgaaggctgtggagggaccatggctgaggctcgaggtcagcctttcccaggctgagggcagggcaggagccaggccagggaacagagccctgctgccaggcaggccaggggcctccaaaccatgccagctctgctgagcagggcagagaacagagccaggaggccctggcaccgagggccaggccaccaccccacccttaactcccctctgtccatgtccctctcagctgctgtgagcaggaggagcccacatactttgccatctggggcgacaacaaggccttcaatgaggtgatcatctcgccagccatgctgcatgagcacctgccctatgtggtcatggaggggctcaacaaggtgaggcagytcccggcagggtaccaccagggaataaggcactgtcaccccatcagaaccccgtaagcaccatcagatcactgcccgattttacagacaagggtgctggggctcagagaagtaggtagctgggccagaaagccccactcaaatacttcaacctcacacccctggctctgtccacatcaccacgttgccccrtggtggggaggagataaggagactcccaggggcctgtccctgaggcaggctcagctcagaggcccggaaggccacctggcccttaacagatgaatgggcaagcagcgacagccrcagccatcccctggctgcggaaaggctgaaggcaggtagggcaggagcactcgccgggctgtggggcgagtcgtgaccagatgggcaagtctcaggccttggggagtggtgacctcaggaggaggagagtgggacccaagtgrctccatgaggctttgcttggcctgagaggcctgggccctggctccacatcggccccacgatggggcctgatgtccctccaccacccccagcctcctctgtcctgtcctcaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggtgagccttggccactcccagccccaccccagggtgagtgtggttcagagcacatagacttgtgtgcacatgcattttgtgcatgcactgggctcagctctgcacacgtgcacaggaggggtcaaactcaccctctgtgctctagggctctcttgctgtgctccagctgtcccacagcctgctgtccctgaatcctacatgagccaggggaggcacacagacccacaaaccctgggccacaaaagcacagattcactctttttttttttttttttttttgagacgaagtctcgctcttttcccccaggccggagtgcaatggcgcgaccttggctcactgcaacctccacctcccaggttcaagcgattatcctgcctcagcctcccaagtagctgggattacaggcrcctgccaccrtgcccagctaatttttgtatttttagtagagatgggatttcaccatgttggccaggctggtcttgaactcctgacctcaggtgatctgcccgcctcagcctcccaaagtgctgggattataggggtgaaccaccatggccggcctgcacagattcactcttacacacttagacgcaaacagatggacacccatttacttacatatttgtattgaagcttacacacatacatgtgcacacaattattagttataagtacacaggtcaccccctacagacatgcacatgtacaagacacacaccaagacaaaggtggagacacatatacaaggacacatgtggacaggcagstgctcatggaaatgcatgaatacacctgtgcacagacccagacacacaagccagctgacatacacagacgtctggtctacacactcatacacatgaacagaggcgtgcacacatgctcacaggggcacgcacatgggggccacagcgcccttgctattcacacactctttgaggggtgcgaggctcttaagtggtagtccttccaggggaggattgtcctgcctttctaggaccttcccacacaggccctgtgtgcttggtcacagatctggtcaagaggctgcttcctggcccttggtagggacaactggacgtctctccctgccatttgtgcatttcctgtggcagctgcacaacccgatgaagaagccagtgtccatttccggctgcggtgactgctgcaagccacccactccctgccctgtcactcattccctgcaggctggtctgcggagccaggggcactaggctccccacccagcagagggctgcggcccatgggagacaggaggagacccggatgaggaaggaagtgatgagatccctgggagtggcacccagggttgctggctctgagattggggtggaacacagttggcatgctatgtgcagggcatctctcccattcactctctccctccatgccctctgtccctccctctgtctctctcattccactgtggcctcatgagtgacctggggcaggctcatgagtgatctggggcagccagtctatcagagcctcattctcacattggtacaatgacrggggttctggtgcagagaaccccagcagcactcctgaagtcctagtgctgccagcagggccttagcccctcagggaccccgcggctcaacccagcatcaactcttttgtcttctatcttgggttcttgtgagttgtttttaaaaaataatcattcctggctgggcgcggtggctcacgcctgtaatctcagcactttgggaggccgaggcaggcggatcaccaggtcagcagattgagaccatcctggctaacatggtgaaaccccatctctactaaaaaatacaaaaaattagccaggcatggtggcgggcacctgtagtcccagctactcgggaggctgaggcaggagaatggcgtgaacccagggcggagcttgcagtgagccaagatcgtgccactgcactccagcctgggcgacagagcgagactccgtctcaaaaaaaaaaaaaaaaaaagaaaataagcattccctgctgcacatcatcaacaactgctaaatgaactgtaccctttattccctgcaagttccttttagccagggagctggggttcagtcccctctcccttctgagtcttataccccctgctctcctctccctctgcaggagcaagtcccagtctgagatgagcctggaggkcttctcggaggggcggctgctgtcgccagtggttgcggcggcggcccgccaggacccggtggagctgctgctgctgtctacccaggagcggctggcrgcggagctgcaggcccggcgggcaccactggccaccatggagagcctctcggacactgagtccctgtacagcttcgactcgcgccgctcctcaggcttccgcagcatccggggctcccccagcctccacgctgtgctrgagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggcyggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgastacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccrtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcnaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacragccatcagggacagaccccccacccccaaggctgcagccacaccatgtttcaggcttggggctggggcaggcttgggctcaatcctgggcacccaggggcagcccacccctaacctggctcctacccaccttgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagcacgctggctgcctcgaatgtctttgcatcaggtggggactgggtagaaatttgatgtcgaggttgcagcagagcagggggttggcatggggccgggggccgggggggcctctgccactgttccctggatggaacagaaagcctaagggggaaacagattccttgggaccagagcccgtttcacccacaagacgcagggtgtgtttgggtggttcaggtccagccctttgtctgtattgggttagaacttcgtttctcaaagttcacggtgctcatgactcactggggcgcttgctaaatgcaggtgcgggtttagtggtccggggtggggcccaggtatagatttcttacctgctcctgctcggctagtgccctggcccggggccacactttgagttgcagggagggagtagaagacccttgaagccccctgtgaatgagggcagccacttgcggagtcctgcctgtgtgagagatgtaccagcgggtgcacgttcatactacagcctggaaagatacagcttgctggcctccccttcctccctgaggggtctgagaggattagctgcccaagactgccaagctggcgactgggggaccaggctagtctgaccatgcccacctccctccccaacaatgcagacagctagggcaggcaggggtggaagatcccagtgggacagcactgaaatgcaggggccactagaagtctttgctgagggctttcctgagagggcgcaaaatacctggccagacccagtgcagcccaggaaccccaggccagcatagcttccgggcagtgaggcctagggagtggctggaaggcccaggtggtggggcctgccccctctacacagcaggtggcgctgttcagccagtcagtcccgccttggccgcagagtctggcctcggcactgacccagccaagctgaccggacctttcccttcccctgaccctgcccccatctcggcccccagtgtccagtggctctatttggtgaggggctggggagagtgatagaagaatgcccccagccttagagcctgtcttcacccacagccactgaacagaagcagaaacgggccaaacaagggtgaagacctgcccaaggtcgcatgggaggtggggacagactggggaccagaatcagggcctctcagcctaggactctggcctccaccacacctgatggctttcagaggttctttgccctcagtggtctcaatggtctgcaaattatcctgtccagtgagcacagcacaggcagaagaaactgaaggccagggaggctctgtggcttgcccggggctgcagccagggtgtggcattggggagggtcttgagagggcagtgctgggaagggctagagaggcactctgcctcacgctccactcaatacctgcagcagccccctcctgtcccggtgcccctgcagtcaggaaggggtctaccctgcaggaccccacactcaggtgtgcccttgggccctagtccggggaagctggaccaccagcctcactggcttgctggattgacactcaccccactttgagccctcctcttcctctgcgaaatggcctgatgccagtgctgtgtgggtccacaggaggccaggagagtcccacggtggggaggacagggctgtaccttctcctgggctggcctctacgcccattacccattaaccctcaggtgccagcatccctctccccagtgctgccttcggtctaccacctcctcctggccctgctcccactcaagggacagtgatgggtgctgagagctgattggaactggagagggcaccatttactgatcactgacctggcactttacctccactgtaaggcagggatactgagtgtgctttatagatgaggcctctgaggacagagggcaggccttggggactaggtggagctggctacaggggacagccatgtctgctgggctagggctgaaatctcagcccctcactcactgtggctcggtagagaagccaggggcacagatgaggactcatctccattgatgggcccccctaggtccttgtatgcaagtcccctgggctactttcaccggcccagccaccttcctgccccagcctctgccccagcgctgcttgggacccaacttcattatggagttggcagatggcagcctcaactcttggctgagcccttgagtctgggacatttcagccacctctttcctccagtccagagatgaaaatccctggggacagttgctcctttgctcagtgacctagtgtaacaggggagatggcagggcctgagctcccttagccaggtcagctgctacagggttaacaggaggctccattccaccccttccaacttcaaggctaccctagagattgaataatctatactcttaattgattataatgcaatggagttggggcgttagggacaaagtacgagtcttcccttctacctccagcccttgctgaccaggacagggacaatgtgtagctcaacggatggtggtgagaacttagatgatggtcagttatgcagtatgtgggatacggaggaaagatccgtgggtatgtggaggcttgtagagaagctggttctgtggctggtcccaggcgactcgtaatgtaaatccgtttctcagaatcgcgtggtgtaggcgggtgtctactttgtccgcaggcaggcctgaccccgggtggaggaggggcagggtggagaataacaattgtcttaagggagtctgcggagggagaaaaacctctggggtgtatcagctggaaaagaataggagtctcagtgtggcccctctcccccctctcagcccagcccctgcgggggcggtgagggagctgcggtcagcacacacagctggggcctccagcaaaatcccattctatatatctaagagcaacagctctgagagcggcccccagagggacaaaacctcattgtgaggcacccgccggcctcagcaccccctcccccaaccccagaactgtcgtggcattgacccttttcggcgggccaccatgggcctgctgactgggccacatctggggctcaggcattggctgcccctcccccacggctggccactgagaactgacagggaggctggggtgggagcggcttccaggcctctcaccccatccccacggggtggcctggcttgtgccccaccctccctggggatgctgcaaggcagaggtgagagtccgaagctggctacgttggcatcttgatctgccagcagtcccccacacctctggcctctgtttagtggcttgtcaaacagtggttgggtggggtaggtttttccagcttttacgtgctgccttgaagggtcccgagaggcttcaagttgagccactctgaagcgggatgattctctaggtctgggattccagaattatccgctcccaaggtttcagaggtccaggattctgtagatttttgtttgtttgtttgtttgtgtttggagacagggttttgctctgtcgcccaggctggagtgcagtggtgcaaacatggctcactgcagcctcactgcagcctcaacctcctgggctcaagcgattctccttcctcagcctccccagtagctgggatcacaggcatgtgccaccgtgcctagttaattttttaattttttgtagagacagggtcttgccatgttgcccaggctggtctcgaactcctggcctcaagcaatcctcctgcctcaacctcccaaagtgctgggattacaggtgtgagccactggagcctgactggattcggtagtttgaagatgccaccatacattcattcaacacatttattgagcacctactgtgtgccaggtcatgttcttggtgttgaagctatagcagtgaccgatacagaaaaatatcttgccctcgtagggcttccattctagagcaagaaggataataacagaaactaaataggaatcttttacatggtgagcaagaaaggcctaggtagggagaactgctttaggtaggctggttggggacatgacatttgagctgagaccaactgctacaaagaagtagccatgtggagacaagcattgtaaacagatggaatagcatgtgccaaggccctgtggcaggtgtaggccttgcatgtttgagcaatggcaaggaggtcttggtggctgttattcagtgagcaatggagagaggggaagagctgaggccagtggtagaggcggggcctgagaaaccagagcaagacattcagatattgttttgagtgcaaagggaaacttagttttgcaaaggaatgacatgatcggatgtatgtttcagaaagggtgatttgggagaactgaaggggatatcagtgagacgagaggctgtgcaagttgggcaggacagagatgtggaggcagtcagtcataagggtgaaggcaggggcacaaggacaaccgctttatcctggacttatatcgagttagaacctccaggtttcattataccagacagggccacggcaaaggagagttcggattcccggggcagccaggatttggctctgaactttaatgaccttgaaactcttaggcagggcggggagcggtggctcatgcctgtaatcccagcagtttgggaggccaacgtgggctgatcacctaaggtcaggagttcgagaccagcctggccaacatgaggaaaccccgtctctactaaaaatacaagttagcccagcgtggtggcgcctgtaatcccagttactggggaggctgaggcaggagaatcgcttgaaccgaggaggcagatgttgcagtgagctgagatcgcgccattgcactccagcctgggcgacagagccgaactccatctcaaaaaaaaaaggagcttttagacctgcattgtccaataccacagccacacgtaactgtttaattacaattaaacaaaatgaaaaaatcagttcctcagtctcaataggcacatttccagtgctcacttgtggccagtgactaccatactgaacaacacagggaacatttccatcatcacagccacaggacagggcttcctggcagtccttaatgcattgagcctcagtttccccatctgtaaaatgcaggtaacaacagcatctccttgataaggtgcctgtgaggagtacatgagataatgcctgtgtggcctggcacataacacacgttccctaaatgcaggttgttattgttgctgagcggggtgtgtgggtggctaacgagagggatgggggctgtctctgaggtttggattcggaatcgtgacatcttgtcccgtgcaagacgaaggcgaggacggcgagggcacacccttccagtcccgaccccacagaggccaagcggcccttcgcccccaccccgacccgggaaggccccgcgcccctcaagcctgggacggtctcgcgtcccccgacccgggacggccccgcgccccgcaagcctaggactgcccagcgctgagcgccgcctgcaggagtcgggagcgtggtgcccgcggccgggctgggcgcggcgcgggccggcagggggcgctgggcgcggcgggcggggcgcgtggggcgggcaggggccgggccagggacgcgcggggggcaagcgcggcggcggaccgggcgggaccgtagccggagcccagccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggtgagagaccgcgggctggcggcggcgaccctctggcgctgggaacccccggctgatctccccgggaactggggctcctcgctgtgtttccgcctcctctggctgggaccctccttcaggctggcaccagcccgccaagacaggctcccggggctgggagtcccccagcggttaccacccaccgccgctgaagttgggctccccctccccgctcct
